United States Patent 8,299,318 (NUCLEOTIDE SEQUENCES AND CORRESPONDING POLYPEPTIDES CONFERRING MODULATED PLANT CHARACTERISTICS) - sequence listing, part 14

SEQ ID NO: 40899 - DNA, 887 bp, Panicum virgatum
  misc_feature: Ceres CLONE 2005192
  misc_feature: Encodes the peptide sequence at SEQ ID NO. 40900
ctctgctctccctccccctcgcaccattctccataggccactgtggccagcagcttctccagtgctcctctggcaccatcactgctcatctctccatagcaacacctcctagttttccggcagcatctccctgagctttactacgttgtttgatggaagagcctacacgagacacaagctagctctctcccttcaataatcttgctagctccaagaagatcttgcctgcttccctttgccgcggcctccatcgacctgcccatacatctatacattcctggctgtaagagatggtctcatggccgtgagctcacctcgccgggcactcctcgccgccgtgttccttggcttcctcctcggcgccgcgaccagcatccgcacggcgacgttttcctcttctcagaaccttgcggaggacaagtcgcggctggggtcgacgccgccgagctgccgcaaccggtgcagcgcgtgcaacccctgcacgcccgtccaggtgacgaccgtgccggggctcggcggcggcgcccgcgtcaccgacgacacggtggccggcttctcacgctactccaactacaagccgctggggtggaaatgccgctgcgacggccgcctctacgacccctagcgtgccggtgtcgcttctcttctccatggcgccgtgcagttcgtgcgtactactctgcttgctccgatggagattctggtctgctctcggttagctagctagctcatctgctctactcccccagattcttcttctcggacgtgtcgtctgttcttgcggcctcgccgtcgcagcttgtactgcccgtagcagtagtttttttttttttttttgctctccgctgaagcaatttactcgcgtgtaaagagtgattgggagcagc

SEQ ID NO: 40900 - protein, 108 aa, Panicum virgatum
  misc_feature: Ceres CLONE 2005192
  misc_feature: SWISSPROT Homolog: EC 3.2.1.15 Polygalacturonase
MAVSSPRRALLAAVFLGFLLGAATSIRTATFSSSQNLAEDKSRLGSTPPSCRNRCSACNPCTPVQVTTVPGLGGGARVTDDTVAGFSRYSNYKPLGWKCRCDGRLYDP

SEQ ID NO: 40901 - DNA, 406 bp, Panicum virgatum
  misc_feature: Ceres CLONE 2005204
  misc_feature: Encodes the peptide sequence at SEQ ID NO. 40902
ctcgagcgagctccagctctcaagaaaccacgccggatcatggccatggcgcctctccctcgcccgctcgtcctcgcgctcctgatcgcgtcctgcgccgcgcagcaggcgccgccggcgcagcccccgcagacgccgaacgccccgccgcaggcgcctccggctccccaagcgcctccggcgggcaacccgccgccggctccccaggcgcctccgaccggaaacccgcctcccgcacccaccactcctcctccggctccgacgaccacgccgcccccggcaccgaccacccctccggcggccccaaccacgccgcccccgggcaccggtgactgccccgccagcccccagcaagcaggcgacgtcgccggcgatgtcaccacaccccgctgacccacgaccacgg

SEQ ID NO: 40902 - protein, 115 aa, Panicum virgatum
  misc_feature: Ceres CLONE 2005204
  misc_feature: Functional homolog of the protein sequence given in SEQ ID NO 51611
  misc_feature: Useful for making plants with altered cell wall content and/or composition
MAPLPRPLVLALLIASCAAQQAPPAQPPQTPNAPPQAPPAPQAPPAGNPPPAPQAPPTGNPPPAPTTPPPAPTTTPPPAPTTPPAAPTTPPPGTGDCPASPQQAGDVAGDVTTPR

SEQ ID NO: 40903 - DNA, 685 bp, Panicum virgatum
  misc_feature: Ceres CLONE 2005226
  misc_feature: Encodes the peptide sequence at SEQ ID NO. 40904
ggatactgatgttgtatcagcacgatttcagaggagagacgtatacggtgcttgggaacaataccttggcttggagcacactgatacaacatcaaaaaggtcttacacagccaatcagaatcgtcacacatatgagaagcctgtgaaaatttataattgagaaaccttcatctggacctccatccaacaaaggcctctcatttgagtcagtttgccaaagattttaagagacgtcccagaaagaaaaagggcagagaaatcaattgctgcttgtatgccgaggccttcatgactcagcaatggcgccaacagtcggtatccctcctgttgttgattggccaaagggtattctttccgaggctttcccatcttgcttccaagcaaccaagcatgtgtgttgtttttttcatcgtgtcgagtatgatggcccctgctaggataggtgtttgcttaatttgtagagcaaagctagtacataagaaaaaagattttggtagggggcatgtatacaggattatagccggagactgattgctgaattggcgcctcttgtagcttgggggaacaatgggagagattgtataatgggtttggtattggttccaattttccgtgttgttgagagatgtaagatgataaccgagcagatagtacagttttgagttccagcgtagtcaatcttgtt

SEQ ID NO: 40904 - protein, 52 aa, Panicum virgatum
  misc_feature: Ceres CLONE 2005226
  misc_feature: SWISSPROT Homolog: EC 3.1.2.15 Ubiquitin thiolesterase
DTDVVSARFQRRDVYGAWEQYLGLEHTDTTSKRSYTANQNRHTYEKPVKIYN

SEQ ID NO: 40905 - DNA, 700 bp, Panicum virgatum
  misc_feature: Ceres CLONE 2005266
  misc_feature: Encodes the peptide sequence at SEQ ID NO. 40906
cccgagcggcctcgcgagaaaaaaaaggcgcagcgccgccgccccgcttccgtccagcgccgttgtcctgcctccgccgcccctactccgtcaagcgccaccgctccgtctctatcccagtgtcgccgctgctccgcctctttcccaactccgtcgagccccaccgcttccccgtcgagatgccgccgcgccgatctacatcgagacctccacctcggccggctgctccgcagcttgtattcgtacttgctcatgtagtaggaacaccaagtcacatgtgcccggaacttcttgtggatataccttatggtaacaaatccgatatttggtcgctagtgtgctgcatgtatgaaacggctgcactcagacccgcatttaaagcttttgatatgcaagcccttatcaataagattaccaagtcgattgtatcacctttgcccacaagatattctggtgcattcctgtgcaccgcgtgcttctacttctgctgttaggctgccacgagacatgcaagtgcagcttctgcttctgcgtgcttctgcttctgtcttcatgaatttctcaagaattttatcctgttgtgtgatggatgaattggacgtgttgggatttgatcgatggaaaactactctgtcttgcattggggtcggttgagaatgaattgaatatattttgtacgtcgcaaattttgagttttcac

SEQ ID NO: 40906 - protein, 104 aa, Panicum virgatum
  misc_feature: Ceres CLONE 2005266
  misc_feature: SWISSPROT Homolog: EC 2.7.11.1 Non-specific serine/threonine protein kinase
MPPRRSTSRPPPRPAAPQLVFVLAHVVGTPSHMCPELLVDIPYGNKSDIWSLVCCMYETAALRPAFKAFDMQALINKITKSIVSPLPTRYSGAFLCTACFYFCC

SEQ ID NO: 40907 - DNA, 543 bp, Panicum virgatum
  misc_feature: Ceres CLONE 2005273
  misc_feature: Encodes the peptide sequence at SEQ ID NO. 40908
acctcgagaaggcaaatcacgcgcaaagccacctccgcgtcatcgtcgtcgtctcctctccaagcaagcgaagcggcctcgagatcttctccgcgccgccatggacgccgtggactcggtggtcgacccgctccgggagttcgccaaggacagcatccgcctcgtcaagcgctgccacaagcccgaccgcaaggaattcaccaaggtggcggcgcggacggcgatcggcttcgtcgtcatgggcttcgtcggcttcttcgtcaagctcatcttcatccccatcaacaacatcatcgtcgggtcaggctgatccggtcccagcaggtgaggggccgcaggactggacaatggcaacaataccttggaagcagttttcagccctatatcataaagaatcatttaggttttctttttgttaaggactgctcctcctgttttgtctcgaaagatttggtacacttgaaactctttttgtaacctgatactgattaggcatgcgtgagctaacaggtaacaaaatccaatggtgacagtttccgcacc

SEQ ID NO: 40908 - protein, 69 aa, Panicum virgatum; identical to SEQ ID NO: 11942
  misc_feature: Ceres CLONE 2005273
  misc_feature (10)..(66): Pfam Name: SecE Pfam Description: SecE/Sec61-gamma subunits of protein translocation complex

SEQ ID NO: 40909 - DNA, 628 bp, Panicum virgatum
  misc_feature: Ceres CLONE 2005279
  misc_feature: Encodes the peptide sequence at SEQ ID NO. 40910
accgagccatacgtgctttcagcatcatctgatggtcaagttcagctgcgggactatgagaagggaatggtgttaaataaatcgttttctgtgataccatgcggcgggccatgtctggcgtttgatccatccggcaagagttttgctagtgcttgcggtgattcaataaagattagtaatctccatgatgatgtatgtaagatactattgcgtgggcattcacgagaggttacttgtttggagtacttcgctcatcgagagacgacatacttgatcagcggttccgaagatggaactgccaagatctgggactgcaagaaagggcattgtgtaaagacactgcaagtgttttcacctgttcgtacggtgtgctcccatccggttcttccagtgctaattataggttcttatgacgggtcagttcgcgtatggaactccactaccttcaggcgtgagcgcagaattaaacttggtctcaaaggtttatcggctatagcatgtttgatgggatcaacaaggattgtgattggacattacaatggtttagcacttgcggaaattcggcgcgaggaaccaaaagcattgtaagcttattacaacggtttaacccttgcggaaatggtttagc

SEQ ID NO: 40910 - protein, 195 aa, Panicum virgatum
  misc_feature: Ceres CLONE 2005279
  misc_feature (64)..(104): Pfam Name: WD40 Pfam Description: WD domain, G-beta repeat
  misc_feature (108)..(145): Pfam Name: WD40 Pfam Description: WD domain, G-beta repeat
  misc_feature: SWISSPROT Homolog: EC 2.7.11.7 [Myosin heavy-chain] kinase
TEPYVLSASSDGQVQLRDYEKGMVLNKSFSVIPCGGPCLAFDPSGKSFASACGDSIKISNLHDDVCKILLRGHSREVTCLEYFAHRETTYLISGSEDGTAKIWDCKKGHCVKTLQVFSPVRTVCSHPVLPVLIIGSYDGSVRVWNSTTFRRERRIKLGLKGLSAIACLMGSTRIVIGHYNGLALAEIRREEPKAL

SEQ ID NO: 40911 - DNA, 652 bp, Panicum virgatum
  misc_feature: Ceres CLONE 2005304
  misc_feature: Encodes the peptide sequence at SEQ ID NO. 40912
atccgccgccgcgcagaaaccctagcctccgccccccgccgccgccagtcatccccttcctcctcgggctcgctctccctccctcgtcgatccaggatgaagtttgttgctgcctatctgcttgctgtcctcgctggcaaccccagcccctctgcggaggatttgtcggccatcctggagtccgttggctgtgaaattgacaatgaaaagatggagctcctgctgtcccaactgagtgggaaggacattactgagctaatcgctgcaggcagggagaagtttgcttccgtcccatgcggcggcggtggtgtggctgtcgcagcagctgccccagctgctggtggagctgctcctgcggctgaggcgaagaaggaagagaaggtggaggagaaggaagaaagcgatgatgacatgggcttcagcctcttcgactaggctcgtgcagttatcagagttgtcttttggtcagaaaaaatcaagagtcatgatgtttggatttcaaccatgttttattttgctaatcaccggaacaactgttgctgtcttgaatcttgatatgtagtaattcagatgtaggttactatgctggttggggtttactgctgaaccagagttttccctatcctatatatcagatgaatgaattggttgc

SEQ ID NO: 40912 - protein, 112 aa, Panicum virgatum; identical to SEQ ID NO: 40124
  misc_feature: Ceres CLONE 2005304
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 40913 - DNA, 644 bp, Panicum virgatum
  misc_feature: Ceres CLONE 2005329
  misc_feature: Encodes the peptide sequence at SEQ ID NO. 40914
agatcggcagcattcgtgctccttgcgagctgcctgcaaatttgcttgctagggttccgtcggtggtctgtgggctctccaggatcccggaattgcatccgcgccgagggcaatggcgggaaggcataccatcattctcatgcaaccatcgcagaacagagctacgaggacatttatggacttcgattcagttaaccacgcactggatggaatatgtggcctctatgaaaggaaaatcaggaacatcaacccgatggtcaggaacttgacttatgatatcagtgacctgtacaatttcatcgatggcctgatggacataagtgcactggtgttcgacgactccctccatgctttcctgccatatgaccgccagtggataaaacagaagctgtttcagcacctaaagaggctggctgaacagtagagcatgatcaccgctggttttcggcaccgcatgcgtcgaggacgaaggtgcccggttgctggttcaggcttggttcgaaattcctggcatgttgtgtaaaggtctatctggcgctctggcagtgtgtagtgtttgacgtgaaccatgtggtttgcacggcgaccaggcactatatggtgaactgcggaacaaatgcaagcttccagatgatcatctcgtc

SEQ ID NO: 40914 - protein, 103 aa, Panicum virgatum
  misc_feature: Ceres CLONE 2005329
  misc_feature (3)..(103): Pfam Name: ER Pfam Description: Enhancer of rudimentary
MAGRHTIILMQPSQNRATRTFMDFDSVNHALDGICGLYERKIRNINPMVRNLTYDISDLYNFIDGLMDISALVFDDSLHAFLPYDRQWIKQKLFQHLKRLAEQ

SEQ ID NO: 40915 - DNA, 713 bp, Panicum virgatum
  misc_feature: Ceres CLONE 2005331
  misc_feature: Encodes the peptide sequence at SEQ ID NO. 40916
acaaatatacacggcgaggcccgggctgcttggtgacccacccaaacccaaaccctccccccatttctttcttgcctcccacgccgccgccgccgcattccgccatggccgatccgcggctgttcccgtcgggatctgacgaccgccgcgacgactccggccgccgcctctacaacccgtaccaggacctcaacatcccctacaagcagctctacgacctgcccacctccccggagttcctcttccaggaggaggccatcgcgcagcgccgctcctggggcgagaacctcacctactacacaggtatcggctacctgggcggcgccgtggccggggccgcgctggggctccgcgacgccgcgcggggcgcagagcccggcgagcccgccaagatccgggccaaccgtgtcctcaactcctgcgggagctcgggccgccgcttcggcaacacactcggggtcataggcctcatgtacgccgggatcgagagcgccatggtcgctgcccgcgaccgcgacgactggatcaatagcgtcgcggcagggctaggcaccggcgcgctcttccgggccgccaacgggccgcgctcagccgccgtcgcgggcgccgttggaggggttctcgccggcgccgccgcggccgccaagcaggttggcaagagatacgtgcccgccctctgatgcctccgtacggtactctctctgctgtgatca

SEQ ID NO: 40916 - protein, 191 aa, Panicum virgatum
  misc_feature: Ceres CLONE 2005331
  misc_feature (51)..(184): Pfam Name: Tim17 Pfam Description: Tim17/Tim22/Tim23 family
MADPRLFPSGSDDRRDDSGRRLYNPYQDLNIPYKQLYDLPTSPEFLFQEEAIAQRRSWGENLTYYTGIGYLGGAVAGAALGLRDAARGAEPGEPAKIRANRVLNSCGSSGRRFGNTLGVIGLMYAGIESAMVAARDRDDWINSVAAGLGTGALFRAANGPRSAAVAGAVGGVLAGAAAAAKQVGKRYVPAL

SEQ ID NO: 40917 - DNA, 876 bp, Panicum virgatum
  misc_feature: Ceres CLONE 2005369
  misc_feature: Encodes the peptide sequence at SEQ ID NO. 40918
tgctaattcgctccggaggagaaacgcatccttacgctcgcgagcccacgatggagacgagaagaattccgcgccctgtaatcctctccccaccttttgtttccgctgattcgattgattattgtgatgtttcggggggttcgttcgtttggtccccgatccaagcggcggcattcttatacgcaggcggcgctgctggcggcgtgcgccggcgcgtcccgggcggggtgccggaagcacgtggcgaagatcacggagtacggcgccgtcggggacgggaagacgctcaacacggcggcgttcgccaaggcggtggcggacctgtcggcgcgcgcgcggcgcggcggcgctgcgctggtggtgcccccggggaaatggctcacggggcccttcaacctcaccagaaacactactcacgtggattcacggtcgctcccctgcactctgttcggcagctgcagcggcctccagaccaacagtatttttttctcagatcgctccagcaccaatttacagccaccagccaaccaataatatttttctctcacaccactccagccatcagttccagctcaatccagcgaacagagtggtcgctagggacaatgaccttttgccttggggcccctgatcccttcttttctaagcaagccactgccatcatctgtgcaacgcctagtgtcgttgtgctcttgaatcttcggatagattcgagtgtaatttccttccatcgatgccatggttccatgtgatggcacagtagtatgccataaagccatagcctgcaaatctgcataaaacgcttgcgaatggttgtagtgtatccaagacgtttcagagaataatgcagttactgcagtctgcttaagaatggct

SEQ ID NO: 40918 - protein, 135 aa, Panicum virgatum
  misc_feature: Ceres CLONE 2005369
  misc_feature: SWISSPROT Homolog: EC 3.2.1.67 Galacturan 1,4-alpha-galacturonidase
  misc_feature: Functional homolog of the protein sequence given in SEQ ID NO 51432
  misc_feature: Useful for making plants with altered carbohydrate content
  misc_feature: Functional homolog of the protein sequence given in SEQ ID NO 51622
  misc_feature: Useful for making plants with altered cell wall content and/or composition
MFRGVRSFGPRSKRRHSYTQAALLAACAGASRAGCRKHVAKITEYGAVGDGKTLNTAAFAKAVADLSARARRGGAALVVPPGKWLTGPFNLTRNTTHVDSRSLPCTLFGSCSGLQTNSIFFSDRSSTNLQPPANQ

SEQ ID NO: 40919 - DNA, 684 bp, Panicum virgatum
  misc_feature: Ceres CLONE 2005374
  misc_feature: Encodes the peptide sequence at SEQ ID NO. 40920
agagcaaaaaccactcaaacacaattcaagcaggacccaaggcagcaacagcatcccgggctcaagcaatcttcaagtgatcagaattccgaacaagatgtgcccaatcaagagggagatgagcgccgagtcgtcgggctccccgtgcagctcagccacgccctcgacctcgtcggagcagcaccagacggtgtggacgtcgccgccaaagcggcccgcggggcggaccaagttccgggagacgctgcaccccgtgttccgcggcgtgcggcgccggggcaacgccgggcggtgggtgtgcgaggtgcgcgtgccgggccggcgcggctgcaggctctggctcggcaccttcgacaccgccgagggggccgcgcgcgcgcacgacgccgccatgctcgccatcgcgggcccgggcgcgtgcctcaacttcgcggactcggcgtggctgctcgccgtgccggcctcgtacgccagcctcgccgaggtgcgccacgcggtcgccgaggccgtggaggagttccagcgccgggaggcgctcccggaggaggaggaggacgcgcgctcggccacgtcctcgacgccgtcgtcccctgccagcgacgacggcagcgccaccgacggcgaggggtcctctgactcctccgcggccaccggggcctcgccgttcgagctggacgtcttcag

SEQ ID NO: 40920 - protein, 195 aa, Panicum virgatum
  misc_feature: Ceres CLONE 2005374
  misc_feature (52)..(105): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1248 in the 10/374,780 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 752 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1229 in the 10/374,780 US patent application
  misc_feature: Functional homolog of the protein sequence given in SEQ ID NO 51026
  misc_feature: Useful for making plants with modulated water use efficiency
  misc_feature: The sequence is a functional homolog of SEQ ID NO 692 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1236 in the 10/374,780 US patent application
MCPIKREMSAESSGSPCSSATPSTSSEQHQTVWTSPPKRPAGRTKFRETLHPVFRGVRRRGNAGRWVCEVRVPGRRGCRLWLGTFDTAEGAARAHDAAMLAIAGPGACLNFADSAWLLAVPASYASLAEVRHAVAEAVEEFQRREALPEEEEDARSATSSTPSSPASDDGSATDGEGSSDSSAATGASPFELDVF

SEQ ID NO: 40921 - DNA, 724 bp, Panicum virgatum
  misc_feature: Ceres CLONE 2005381
  misc_feature: Encodes the peptide sequence at SEQ ID NO. 40922
aaaccctcttcctcccttccccacctctccagcggatcactcgccgccgccgctgccgccggacgccgccgtgatgctgtccctgtcgagggctctcgggaggcggctcttctcatccgccgcggcggtgtccgagtccgccgcggccgcgtcgacgtcggcggtgaggaaggcgcagaaccctctcgaggagttcttcgaggttgagcggagcaccgaggaggacaagccccgtccctactacggtcgtagttggaaggcttctgaattgcgcctaaaatcgtgggatgatcttcagaagcattggtatgttcttatgaaggaaaagaacatgcttatgactcagcgacagatgctgcatgcagagaacttgcattttccaaatccagagcgtatttccaaggtgaagaaatcaatgtgccggataaagcatgtcttgactgagagggccatagctgagccagacccaaggaggtcagcagaaatgaagcggatgatcaacaccctctgattcactcacatgctttcctgtgggactaaggttgaaaggctaagtagcacttagaaagatttgcttcgttgtgttgtatgtttatcctagaagacgtgtaagaccgatccttttttatgtccgtggtatgcctgcaacacgccttgttgacattaacatctggggttcaataattgagcttttatgtaaaatatacatacatacatatataca

SEQ ID NO: 40922 - protein, 145 aa, Panicum virgatum
  misc_feature: Ceres CLONE 2005381
  misc_feature (38)..(125): Pfam Name: MRP-L47 Pfam Description: Mitochondrial 39-S ribosomal protein L47 (MRP-L47)
MLSLSRALGRRLFSSAAAVSESAAAASTSAVRKAQNPLEEFFEVERSTEEDKPRPYYGRSWKASELRLKSWDDLQKHWYVLMKEKNMLMTQRQMLHAENLHFPNPERISKVKKSMCRIKHVLTERAIAEPDPRRSAEMKRMINTL

SEQ ID NO: 40923 - DNA, 646 bp, Panicum virgatum
  misc_feature: Ceres CLONE 2005382
  misc_feature: Encodes the peptide sequence at SEQ ID NO. 40924
ccccaccagcctcccaaagcctccgcctccccctgcctcctccgccgccgccgcgcgcgcagacgacccgcgacccacaggcatgggcgtgtacaccttcgtgtgccgcaacaccggcggcgagtggacggccaagcagcactccggcgagatcgaggcctccgccaccaccccctacgagctgcagcgccgcctcgtcgccgccgcctccgcggccgactccgcggccggcgtccagtcctccttctccatggtctctcccagctccgccgtcttccaggtgattgttggtgctgtcggtggcggtgcgatgatcagtggaggtgctgcagttggtggcgctgctgcctcaggtggtggtgcggctgagccccccaaggaggagaagaaggaagaggagaaggaagagagtgacgatgacatgggtttctccctgttcgactagattatttagctcccataagtggtggtttggtcctattatggtacttaattttgctgtcctgtctacacaagccagtggcttgtgaacctgaaaactctgttaattcaggcaatgaagttccttggcttgccgcactcgggatgacggcgagagactacagccattgttgcactcacgagcagcagcgtgtttcccaaccat

SEQ ID NO: 40924 - protein, 120 aa, Panicum virgatum
  misc_feature: Ceres CLONE 2005382
  misc_feature (41)..(119): Pfam Name: Ribosomal_60s Pfam Description: 60s Acidic ribosomal protein
MGVYTFVCRNTGGEWTAKQHSGEIEASATTPYELQRRLVAAASAADSAAGVQSSFSMVSPSSAVFQVIVGAVGGGAMISGGAAVGGAAASGGGAAEPPKEEKKEEEKEESDDDMGFSLFD

SEQ ID NO: 40925 - DNA, 609 bp, Panicum virgatum
  misc_feature: Ceres CLONE 2005390
  misc_feature: Encodes the peptide sequence at SEQ ID NO. 40926
tatgaggagctaatcgcattgggtgaagtagttggtacagaaagcagaggtctctctgctgatacacttgcctctttaccttcagtgaagtacaagacacaaaatgttcaggatgacaacgcagagcaatgtgtaatttgccgtgtggaatttgaggaaggtgaatctttgattgcacttccctgcaagcactcataccaccctgaatgcataaaccagtggctgcaaataaataaggtatgccctatgtgcagcacagaagtttcaacctcgggcaacaaggaggcagaagtttcagcctcgggcaacaaggaagcgtgacccactctcatatgaccattttcggcacttaatgggaataactagcagcatcagtgtagcatctgtattgttgaagcaaaagcagaaaaacgtattagaacatgaaaggatattgtgtttcaaacaaaaaaaaacatgcaaggaggtcaggaaatatttaatcctcgtttcactctttttctcttggctatgctcactgaactttctctgccttgccgaaatgctttatgtacccttgggacgccttgtggctgtaatatgatccataaatgcactgattatatttac

SEQ ID NO: 40926 - protein, 106 aa, Panicum virgatum
  misc_feature: Ceres CLONE 2005390
  misc_feature (44)..(84): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: Functional homolog of the protein sequence given in SEQ ID NO 50438
  misc_feature: Useful for making plants with altered terpenoid content
YEELIALGEVVGTESRGLSADTLASLPSVKYKTQNVQDDNAEQCVICRVEFEEGESLIALPCKHSYHPECINQWLQINKVCPMCSTEVSTSGNKEAEVSASGNKEA

SEQ ID NO: 40927 - DNA, 671 bp, Panicum virgatum
  misc_feature: Ceres CLONE 2005415
  misc_feature: Encodes the peptide sequence at SEQ ID NO. 40928
atcatttgtctggtgatcctaattgtcttgagacacttcaacgcacagatgcaatcaagcatctgataccgattcttgaacttcatgatggacctctggtatatcaaatacatagtgaggtcctcaacgctttgttcaacctttgcaagattaataaaagaagacaggaacaagcagctgaaaatgggatcatccctcacttgatgaattttgttatgtcagactcacccctaaggcagtatgccctgcctttgctgtgtgatatggcccatgcttctcgcaactctagagagcagttgagggctcatggagggctagatgtgtacttaaatcttttggaggatgatgcatgggcatgcacagcattagattctattgctgtttgtttggctcatgataatgatcacagaaaagtagaacaagcgctgttgaagaaagaggcaattcagaaattagtgaaattcttccaagactgcccagaacaatattttgttcatacattggatgctttcttgaagataatcacgaaatcttctcggataaatactgcaatggccaccaatggtttgacaacattgcttattgcaagacttgaccatcgagaagctattgctcgcttgactttgctgaaactcataaaggttgtctatgagcaccatcctccaccaaaa

SEQ ID NO: 40928 - protein, 222 aa, Panicum virgatum
  misc_feature: Ceres CLONE 2005415
  misc_feature: SWISSPROT Homolog: EC 2.7.11.1 Non-specific serine/threonine protein kinase
HLSGDPNCLETLQRTDAIKHLIPILELHDGPLVYQIHSEVLNALFNLCKINKRRQEQAAENGIIPHLMNFVMSDSPLRQYALPLLCDMAHASRNSREQLRAHGGLDVYLNLLEDDAWACTALDSIAVCLAHDNDHRKVEQALLKKEAIQKLVKFFQDCPEQYFVHTLDAFLKIITKSSRINTAMATNGLTTLLIARLDHREAIARLTLLKLIKVVYEHHPPP

SEQ ID NO: 40929 - DNA, 692 bp, Panicum virgatum
  misc_feature: Ceres CLONE 2005425
  misc_feature: Encodes the peptide sequence at SEQ ID NO. 40930
cttctccactccctcccccgcctccactactcccatcccaggcgctgcccaggtaagtcggcggcgatgacgacccgcttcaagaagaaccgcaagaagcgcggtcacgtgtccgccgggcacggccgtatcgggaagcacaggaagcaccccggtggccgcggtaacgccggtggcatgcaccatcaccgaatcctcttcgacaagtaccatccggggtacttcggcaaagtgggtatgcgctacttccacaagctccgcaacaagttctactgcccggctgtcaacgtcgagcgcctctggtcgatggtgcccgccgagaaggaggcgggggccggcgccgataaggccccgcagatcgacgtcacccagttcggctacttcaaggtgctcgggaaggggaagctgccgtccaagcccatcgtcgtcaaggccaagctcatctccaaggtcgccgagaagaagatcaaggccgccggcggcgccgtcgtgctcaccgcttaggtttcagtccttgcttgcctctgttttgagatctatatctgaactagtactgccttcctgtctcagctatttgtgttaagaagacttgctagctttttaaattgccgtggctactgcctggtggaacagtacttatgaggatttttgcacttagtgatgccagttcatatcaaatatctcagatatat

SEQ ID NO: 40930 - protein, 145 aa, Panicum virgatum
  misc_feature: Ceres CLONE 2005425
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNKFYCPAVNVERLWSMVPAEKEAGAGADKAPQIDVTQFGYFKVLGKGKLPSKPIVVKAKLISKVAEKKIKAAGGAVVLTA

SEQ ID NO: 40931 - DNA, 712 bp, Panicum virgatum
  misc_feature: Ceres CLONE 2005450
  misc_feature: Encodes the peptide sequence at SEQ ID NO. 40932
agtggggcttcaggactcgacctctcgcgccgccgccatgaccttcaagcgccgcaacggcggccgcaacaagcacggccgcggccatgtcaagtacatccgctgctccaactgcgccaagtgctgccccaaggacaaggcgatcaagaggtttcaggtgaggaacatcgtggagcaggcggccatcagggacgttcaggaggcgtgcgtccatgacggatacgtccttcccaagctctacgccaaggtgcaccactgcgtctcgtgcgcgatccacgctcacatcgtccgcgtccgttcccgtgagaagcgcagggaccgcaagccaccggaacgcttcaggcgcaggctatcatctcaggacagagcagcattttcaggaaaaaatagtttcctattgtttggacatcgatgctggaaattttgttgaagcactcctcttcacaacgtacaacctgatgcttcctcctctgctatcggagaatcacttttggagcacactgcagctgctcttactggtacactttatttggcggccacaacttatggttattgaagcgttacgcacgctgggaaattgccatatgaagcccggcccgtttctttttgttttaagattaccagcccgtttcgttgacccgaacgaggccttggtccattatttgtctcgttgcggtctcttagtttttttctttgaaagagtctcttctta

SEQ ID NO: 40932 - protein, 130 aa, Panicum virgatum
  misc_feature: Ceres CLONE 2005450
  misc_feature (1)..(114): Pfam Name: Ribosomal_S26e Pfam Description: Ribosomal protein S26e
  misc_feature: Functional homolog of the protein sequence given in SEQ ID NO 50755
  misc_feature: Useful for making plants with modulated nitrogen use efficiency
MTFKRRNGGRNKHGRGHVKYIRCSNCAKCCPKDKAIKRFQVRNIVEQAAIRDVQEACVHDGYVLPKLYAKVHHCVSCAIHAHIVRVRSREKRRDRKPPERFRRRLSSQDRAAFSGKNSFLLFGHRCWKFC

SEQ ID NO: 40933 - DNA, 447 bp, Panicum virgatum
  misc_feature: Ceres CLONE 2005452
  misc_feature: Encodes the peptide sequence at SEQ ID NO. 40934
actgctcgagcgagctccagctctcaagaaaccacgccggatcatggccatggcgcctttccttcgcccgctcgtcctcgcgctcctgatcgcgtcctgcgccgcgcagcaggcgccgccggcgcagcccccgcagacgccgaacgccccgccgcaggcgcctccggctccccaggcgcctccggcgggcaacccgccgccggctccccaggcgcctccggccggcaacccgcctcccgcacccaccactcctcctccggctccgacgaccacgccgcccccggcaccgaccacccctcctccggcccccaccacgccgcccggggcaacggtgactctcccgccagagccgacaactccgccggcagcgacgctcgcgtgaccccaggccgtccccggccgcacgagacgatgtccgtcccccatgattccggaaacgaccctggc

SEQ ID NO: 40934 - protein, 110 aa, Panicum virgatum
  misc_feature: Ceres CLONE 2005452
  misc_feature: Functional homolog of the protein sequence given in SEQ ID NO 51459
  misc_feature: Useful for making plants with altered cell wall content and/or composition
MAPFLRPLVLALLIASCAAQQAPPAQPPQTPNAPPQAPPAPQAPPAGNPPPAPQAPPAGNPPPAPTTPPPAPTTTPPPAPTTPPPAPTTPPGATVTLPPEPTTPPAATLA

SEQ ID NO: 40935 - DNA, 684 bp, Panicum virgatum
  misc_feature: Ceres CLONE 2005453
  misc_feature: Encodes the peptide sequence at SEQ ID NO. 40936
acactgcttataaaaagaaaaaaaactctcgcttctgctcttctcctctcccccacgagatctcctccacgccgcatcctctctctctctcggtcccggcgttcctctcctcagctcctcccgccggtgatagggccagtggcgccgcgccacctttggccagttcttcgttgggcgctgcgccgaggacgagcatccgacagggctgacaggaaatttacctttatctatctattccacattcttttgcgattatggcactagctgctatctacagccttttcatcattaacaaatccggtggccttatatactacaaggactatggttcagcagggaggatggacaccaatgacagtctcagattggcaagtctctggcattcaatgcatgctatctcccagcaactctcccctacccctggctgtaatggcattgacctcctacaagcccataatttcgatcttcattgcttccaatccctgacaggtacaaaattttttgttgtatgcgagactggcgcaccaaatatggaaatgctgctgaaagtgatctatgagttgtacactgactttgttttgaagaacccgttctatgagatggagatgccgattcggtgtgagctctttgatctcaacctggcacaggtgatccagaaggaccgtgttgcactcttgggtcggt

SEQ ID NO: 40936 - protein, 143 aa, Panicum virgatum
  misc_feature: Ceres CLONE 2005453
  misc_feature (6)..(136): Pfam Name: Sybindin Pfam Description: Sybindin-like family
MALAAIYSLFIINKSGGLIYYKDYGSAGRMDTNDSLRLASLWHSMHAISQQLSPTPGCNGIDLLQAHNFDLHCFQSLTGTKFFVVCETGAPNMEMLLKVIYELYTDFVLKNPFYEMEMPIRCELFDLNLAQVIQKDRVALLGR

SEQ ID NO: 40937 - DNA, 648 bp, Panicum virgatum
  misc_feature: Ceres CLONE 2005474
  misc_feature: Encodes the peptide sequence at SEQ ID NO. 40938
gaaaggagagcagcagagcaacaggaaagactccgtcagatcgagccttgttctccctctcatccaagaacagcatcaaacaagaaaccagagaggtagaacagagcaagatggcctgagccaggctaagccaaacgcacgcacgctcctcctagacgcacgcacgcacgtagaggacggacgcgcaggaaggacttgcactccggcgcatgggtctcctggaccagctgtgggatgacacggtggccgggccgcgcccggactccggcctcggcaagctccgcaagtacgcctccttctcgccctcctcctcctcggtgtccaaggccgcggccgcgtcgccgcccgcggagggggcggccgggggcgtggcgccaggggtgacgcgcagcatcagcatgctccgcccctcggcgctgtccgtcgtcacgtcgccgcgcagcgagtccagctctgcgccgtcgtcgccggccagcggcgctccggactcgcccttcggcgcagcgacgacgcccgagggagagggctggaagaagctgcgccggaaaggcaggatggccgccgacggcgccgacgcccccggcacgccgaggagccccaccgtctacgactgggtggtgatcagctcgctggaccggtgaacgacag

SEQ ID NO: 40938 - protein, 143 aa, Panicum virgatum
  misc_feature: Ceres CLONE 2005474
  misc_feature (7)..(143): Pfam Name: Auxin_repressed Pfam Description: Dormancy/auxin associated protein
MGLLDQLWDDTVAGPRPDSGLGKLRKYASFSPSSSSVSKAAAASPPAEGAAGGVAPGVTRSISMLRPSALSVVTSPRSESSSAPSSPASGAPDSPFGAATTPEGEGWKKLRRKGRMAADGADAPGTPRSPTVYDWVVISSLDR

SEQ ID NO: 40939 - DNA, 631 bp, Panicum virgatum
  misc_feature: Ceres CLONE 2005490
  misc_feature: Encodes the peptide sequence at SEQ ID NO. 40940
aatggcctaatctgtccaccacgccagctactcctctactcgccgagtcgtccgccggcgccgcctccctcgccctcccctcgacctcgtgcccgcggcggccgctgctcatctgctccgatggctactgtgccagtcaaccctaaacctttcttgaacaacctaacagggaagcctgtaattgtcaaacttaagtggggtatggagtacaaaggttatcttgtttctgttgactcctacatgaatcttcagcttgctaacacagaggagtacattgatgggcaattctctgggaacttgggagagattttgatcaggtgcaacaatgttctgtacctccgaggtgttccagaggatgctgagatagaggatgcggagtgagaagacttgaaccatgtttagattgattgatgtaaggacgtgtgtttgggtgtgccggggacaacctattctgccgaatcctagctttgaactttatgattgatgaagtgtatcctgctttcagttaggctatactgtcatgaacatttgaagtttgaactgaaagctaggactagagatgatgttcaaactttcagttaagagtattctgtcattctgctgaatctgagaagcatcagatttcctgacc

SEQ ID NO: 40940 - protein, 86 aa, Panicum virgatum; identical to SEQ ID NO: 24879
  misc_feature: Ceres CLONE 2005490
  misc_feature (10)..(75): Pfam Name: LSM Pfam Description: LSM domain

SEQ ID NO: 40941 - DNA, 699 bp, Panicum virgatum
  misc_feature: Ceres CLONE 2005495
  misc_feature: Encodes the peptide sequence at SEQ ID NO. 40942
ctgatccacaggcagccatggcgttgcagcggatatcggaagtgatccgatttctgcactcgcccccgcatcgtgggttgatggtccgctccgctatcctctgggggctcggcgacgtcgccgcccaggccatggtccactactccgctcaggataaagatgaggagtccatttctttcgggaataaagataaggagttcaaaatcaattggtatagagtgtacaaaacaagtgtttttggagcttttgcttgtattggaccagctgcatattaccggtttaggtttaataagaggctgtggagctccattactacagctgaagttgttagctcagcagctcgtgaaggtctctgggcaactataaatcttgccacgttcttcccgttcgtgggttccacgccaaggactaggagtgtggagcaggccaaggaagacatgaagagaggtttcacccctgctctagtgctgggcggagctgtggtgccaaccttgctgttcacaaactggcgcttcgtccccacgccataccagcttcattgtgccagcttgttcgccctggtaggcagctgttccctctcattgattgacttgagcaccacaaggatgatggcgcagcgtttctggaaggatggaacgagtatggcttgatctgacatctgcttttgagctagtagtagtcatgtgtgtatgtgggtac

SEQ ID NO: 40942 - protein, 210 aa, Panicum virgatum
  misc_feature: Ceres CLONE 2005495
  misc_feature (126)..(196): Pfam Name: Mpv17_PMP22 Pfam Description: Mpv17 / PMP22 family
MALQRISEVIRFLHSPPHRGLMVRSAILWGLGDVAAQAMVHYSAQDKDEESISFGNKDKEFKINWYRVYKTSVFGAFACIGPAAYYRFRFNKRLWSSITTAEVVSSAAREGLWATINLATFFPFVGSTPRTRSVEQAKEDMKRGFTPALVLGGAVVPTLLFTNWRFVPTPYQLHCASLFALVGSCSLSLIDLSTTRMMAQRFWKDGTSMA

SEQ ID NO: 40943 - DNA, 722 bp, Panicum virgatum
  misc_feature: Ceres CLONE 2005499
  misc_feature: Encodes the peptide sequence at SEQ ID NO. 40944
ccatcccgcaggccaaccaacagtgacgcgagcacgagcacccctcccccacctctccttccgcgtcgcgtgccctcgccgcagcccatcctcatggcggaccagctcaccgacgagcagatcgcggagttcaaggaggcgttcagcctcttcgacaaggacggcgacggttgcatcactaccaaggagcttggaactgtgatgcgctcccttggccagaaccctactgaagcagagctgcaggacatgatcaacgaggttgatgctgatggcaacgggaccatcgacttcccagagttcctgaacctgatggcaaggaagatgaaggacactgactctgaggaggaactcaaggaggctttccgtgtcttcgacaaggaccagaacggtttcatctcggctgctgagctccgccatgtcatgaccaaccttggtgagaagctgaccgatgaggaagtcgacgagatgatccgcgaggctgacgtggacggcgatgggcagatcaactatgaggagtttgtcaaggtcatgatggccaagtgaggagcggtcccccataaataagtctgtcaggagcaaaccgaattatcaggctcacaagctgtactttgtcatgtcccgttgatgagtacgtatcagtatcatgcaggtggtaatgttgagtagtggtcgggttaggtggtgtagtcatgggaacgcgacatcagatacctgtttctttt

SEQ ID NO: 40944 - protein, 149 aa, Panicum virgatum; identical to SEQ ID NO: 9768
  misc_feature: Ceres CLONE 2005499
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 40945 - DNA, 648 bp, Panicum virgatum
  misc_feature: Ceres CLONE 2005517
  misc_feature: Encodes the peptide sequence at SEQ ID NO. 40946
atcagttcatcagcaacctatgcattacatctagctagcagcagctgagtaccgacagaatattctgtgaacattcagccaggaaagcaggaaaagcaaccatgatcactgccaagagacttgttcagatggcgaagaagtggcagagaatggccgctctggcgaggaagcggctcacgtcgacaccaatgaaagaagctgaaggatcatgcggtacctcatcgtccatggccagcaagggccactgcgtcgtgtactcggccgatggccggcgattccaggtcccactggcgtaccttggtacggcggtcttcggcgagctcctaatgatgtcacaggaagagtttgggttctccagcgacgaaggcaggatcacgctgccctgcgacgctgcggtcatggagtacgtgctgtgtttgcttagaagaaacgcctctgaagaggttgtgagggcgttcttgagctccatggtcaggccgtgccacaatgtcagcggcgtggtgccatgcaaccagccgttagctgtttgtgtatagcctttttttagctcctgacgcactataccatttttggttcaaccggatgtaaagttgtagaatcatgtaggagattgaaatcatgaaatgttgttatatcacaagcctcact

SEQ ID NO: 40946 - protein, 144 aa, Panicum virgatum
  misc_feature: Ceres CLONE 2005517
  misc_feature (10)..(108): Pfam Name: Auxin_inducible Pfam Description: Auxin responsive protein
MITAKRLVQMAKKWQRMAALARKRLTSTPMKEAEGSCGTSSSMASKGHCVVYSADGRRFQVPLAYLGTAVFGELLMMSQEEFGFSSDEGRITLPCDAAVMEYVLCLLRRNASEEVVRAFLSSMVRPCHNVSGVVPCNQPLAVCV

SEQ ID NO: 40947 - DNA, 667 bp, Panicum virgatum
  misc_feature: Ceres CLONE 2005525
  misc_feature: Encodes the peptide sequence at SEQ ID NO. 40948
gtcactctcttccccagcggccggctctagtgagctcttcagatcaggctcgccttcccctcccgctctcccgccgccgccgccctcgtcgaccccgtgaactgcgccggagcggcgatccgtcgaaccacctggatcgacctcttctgccgctggaccaagatggacgttattatcatcatctctcttgtcattcttttggcactaggagctgtctttgtgatcccgaagtcccaaaacaaaggtaaatcaaagggaactgattcagtagatggaatgacatctaagaggtatacaaaggaagagatctctgaacataacacaaggaaggattgttggatcatcatcaaagacaaggtctatgatgtcactccttatgtggaggaacatcctggcggagatgccattctaactaatgctggtggtgattccacagaaggcttttttggaccacagcacggcactagagtcttcgatattatcgaggatttctgtatcggacagttgaaggattcatgaaattgagggtagattgtattgatttcatggaattttcctggcatcagtttatgagaagctatatatatggtagccatgttttcagccttgtcaaggtccaggtgtgatatgtcagagtcaaactgttctgcactcgtgatcagggctg

SEQ ID NO: 40948 - protein, 118 aa, Panicum virgatum
  misc_feature: Ceres CLONE 2005525
  misc_feature (43)..(116): Pfam Name: Cyt-b5 Pfam Description: Cytochrome b5-like Heme/Steroid binding domain
MDVIIIISLVILLALGAVFVIPKSQNKGKSKGTDSVDGMTSKRYTKEEISEHNTRKDCWIIIKDKVYDVTPYVEEHPGGDAILTNAGGDSTEGFFGPQHGTRVFDIIEDFCIGQLKDS

SEQ ID NO: 40949 - DNA, 664 bp, Panicum virgatum
  misc_feature: Ceres CLONE 2005537
  misc_feature: Encodes the peptide sequence at SEQ ID NO. 40950
gatcgcatcgcattctcgctctgttgtgtgactgattgccaagaaggaaacgctctctgcttgtgttccagcctctgaatctcgtgtgaggatgtcgtgctgcggaggcaactgcgggtgcggctccggctgcaagtgcggctccggctgcggagggtgcaagatgtacccggacatggctgagcagggcaccaccaccaccaccaccaccaccacccagactgtcatcatgggcgttgcaccaaacaacaaggggcatgccgagggcgggttcgaggctggcgccggagccgagaacggcggctgcaagtgcggcgacaactgcacctgcaacccctgcacctgcaagtgaggagctcatggccatggccggaccggaggagatctcggaaggacaaaaaagctagtatagcagtgttgtgtatgtgcgtcgttcgtttgtctgaaagtgtgtgtggcatgcttagtaacagtgttgcgcgtgctgctagtagatggtactgatgaggaacaataataatgatggtgctgagatgtcgtcggcgtcgccgccgtcgtgtccttcctccccggccggtcgagcacctgtggcggtgctctagcagtgtgtcggtgtgtgcagcaggccatgctctgatctgtggtgtaggtgtgtggcctgctt

SEQ ID NO: 40950 - protein, 86 aa, Panicum virgatum
  misc_feature: Ceres CLONE 2005537
  misc_feature (1)..(85): Pfam Name: Metallothio_2 Pfam Description: Metallothionein
MSCCGGNCGCGSGCKCGSGCGGCKMYPDMAEQGTTTTTTTTTQTVIMGVAPNNKGHAEGGFEAGAGAENGGCKCGDNCTCNPCTCK

SEQ ID NO: 40951 - DNA, 692 bp, Panicum virgatum
  misc_feature: Ceres CLONE 2005538
  misc_feature: Encodes the peptide sequence at SEQ ID NO. 40952
atatcatacatctgttcccgatactatcgggctccagagctcatatttggtgccactgaatatactacagcaattgacatttggtctgctggatgtgttcttgctgagcttatgctaggccagcctttgtttcctggtgaaagtggcgtggaccaacttgttgaaatcatcaaggttcttggtacccctacaagggaagaaattaagtgcatgaacccgaattacacagagttcaaattcccacagatcaaagcacacccatggcacaaggtatttcacaaaaggatgccaccggaagctgttgatctggtgtcccgactgctccagtactcccccaatctaagatgcactgctgttgaggcacttgttcacccattctttgatgagctccgagatcctaatacccgtcttccaaatggacgctttctgccaccccttttcaacttcaagccgcatgaactgaaaggagtcccagcagacatttttgcgaaattgattccagaacatgcaaagaagcaatgcccctatgtgccttgaggccataacccgccactgcatctgtgcattttcccttggaatttggatgattggcggcctgcacacctgttggttgaagatgctaggtcacctgcgtgtacaagtacaacagctgtgacctgtgtagttgagtagtgtatgtcgcaatgacatgt

SEQ ID NO: 40952 - protein, 178 aa, Panicum virgatum
  misc_feature: Ceres CLONE 2005538
  misc_feature (1)..(127): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50366
  misc_feature: Useful for making plants with modulated water use efficiency
  misc_feature: Functional homolog of the protein sequence given in SEQ ID NO 50365
  misc_feature: Useful for making plants with modulated biomass
ISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALVHPFFDELRDPNTRLPNGRFLPPLFNFKPHELKGVPADIFAKLIPEHAKKQCPYVP

SEQ ID NO: 40953 - DNA, 518 bp, Panicum virgatum
  misc_feature: Ceres CLONE 2005539
  misc_feature: Encodes the peptide sequence at SEQ ID NO. 40954
agcggagctgagggctcagttgaagagctcaggttatgcttcgacaaagaattgaagcctcgtgattgccttactacttctttgacgaatggaagtgtgtcaaaaacaaagcattgcccacagtacatcacactgccaaaatatgatccccttgtgcttgccaattcaactggagagatcatgaaacagttcgatgactttgaggtgtctgcagcaatttatacagcctaacatgtagttgttgcagcagagcaatccatggctgtgacgaaacaaatgtcttcagggccacgaactgcatttatgatagcaggtggttgcctgagcattccagggaaattgatgtctgtgaatcaattatttgtacactaggaagagaaccgtactcttttagatccatgcgaattgaaatttacaggttttacgaaaccttgaaggtcggatcaatgtatatacacattccatagctggatggtgtccttgttgccattattctaaaggtttctggtgcaagtttt

SEQ ID NO: 40954 - protein, 76 aa, Panicum virgatum
  misc_feature: Ceres CLONE 2005539
  misc_feature: SWISSPROT Homolog: EC 3.1.27.1 Ribonuclease T(2)
SGAEGSVEELRLCFDKELKPRDCLTTSLTNGSVSKTKHCPQYITLPKYDPLVLANSTGEIMKQFDDFEVSAAIYTA

SEQ ID NO: 40955 - DNA, 663 bp, Panicum virgatum
  misc_feature: Ceres CLONE 2005553
  misc_feature: Encodes the peptide sequence at SEQ ID NO. 40956
  misc_feature (585)..(585): n is a, c, t, g, unknown, or other
tgattgatgagacaaactcaatgtcagacgtctatactgctttctatgagttttctttattgctcgaatcaaagattgacgacaatgatccaaatgctgcactaacacgaaaacgtgttgattcaataaagcaaacttgcaggtcatcaagtttgctaaagagcagggggtaccatttggacaagtcaccttacaagcatattctgctcatgattgttcttctggtggtggctattatatttggggtactgtataccaagtgaagccctgctagttggcctttttttttttcatatggagacttaagagagcaactacgccaatacgattttgttttgtactttgtagtctacaaaggctgtgaaaatccagaagtagtgactgtagatggaatgctggatatggctgcatgctactgtttccgcaatcctatgttccttttctttcctcgcgtgttgcaccgtttgaagctgtttcaagggaatagaaactagttgcgctgacatgtttcctcttcctttatttacaaaaacccgtgtaaaagcattgtgtttttccggaatcgtgtagtggaaagaacatcangcgtgttgagcagcctatgtatgggcgataacaggcgaagatatgatgtgtaaataaagacctgttgatgtacagctt

SEQ ID NO: 40956 - protein, 86 aa, Panicum virgatum
  misc_feature: Ceres CLONE 2005553
  misc_feature: SWISSPROT Homolog: EC 2.5.1.21 Squalene synthase
IDETNSMSDVYTAFYEFSLLLESKIDDNDPNAALTRKRVDSIKQTCRSSSLLKSRGYHLDKSPYKHILLMIVLLVVAIIFGVLYTK

SEQ ID NO: 40957 - DNA, 964 bp, Panicum virgatum
  misc_feature: Ceres CLONE 2005591
  misc_feature: Encodes the peptide sequence at SEQ ID NO. 40958
gaactcaaactcctcggctcacagagtcagtcacatgagcgagggagtgagaaacagagaaagggggaagacgccgccgcggccatgaagatcttagttgcggtgaagcgggtggtggactatgccgtgaaggttcgtgtgaagccggaccggacaggcgtggagacgaccaatgtcaagatgtcgatgaaccccttctgcgagatcgccgtggaggaggcgctccggctccgcgaggccggcgtcgcaaccgaggtcgtcgccgctaccgtcgggcccgcccaatccgccgacaccctccgcaccgcgctcgccatgggcgccgaccgcggcgtccacgtcctccacgaccccgaccccgcgcgcccgctccttcccctcgccgtcgccaagatcctccgcgccgtcgccctccaagaaaagcccgggctcgtcatcctcggcaagcaggcgattgatgacgattgcaaccaaacaggacaaatgttagctggattgcttcaatggccgcaggggacatttgcctcaaaggttatactgggcaaggagaaacaaaaggctactgtggagagggaggtcgatggtggaatcgaaaccatctgccttgatttaccagctgtgatcaccactgatttaagactgaaccagccaaggtatgcgacattaccaaacataatgaaggcaaaatctaaagttatcaagaaaatcaccccccaagagctcaatgtagatatcagatcagacttggaggtcgttgaggtcaatgagccaccaaaaaggaaagcaggggtaattctttcatctgtcgatgagcttcttgacaaattgaaaactgaagcacgtgtcttgtaacaatttgtatattatttctgatatggtctggtgttttaagtatgtaagtaaataaaatgcctttgtgaatgctcaaactgttcatactattcacaaataaaatttagttgac

SEQ ID NO: 40958 - protein, 255 aa, Panicum virgatum
  misc_feature: Ceres CLONE 2005591
  misc_feature (23)..(217): Pfam Name: ETF Pfam Description: Electron transfer flavoprotein domain
MKILVAVKRVVDYAVKVRVKPDRTGVETTNVKMSMNPFCEIAVEEALRLREAGVATEVVAATVGPAQSADTLRTALAMGADRGVHVLHDPDPARPLLPLAVAKILRAVALQEKPGLVILGKQAIDDDCNQTGQMLAGLLQWPQGTFASKVILGKEKQKATVEREVDGGIETICLDLPAVITTDLRLNQPRYATLPNIMKAKSKVIKKITPQELNVDIRSDLEVVEVNEPPKRKAGVILSSVDELLDKLKTEARVL

SEQ ID NO: 40959 - DNA, 670 bp, Panicum virgatum
  misc_feature: Ceres CLONE 2005602
  misc_feature: Encodes the peptide sequence at SEQ ID NO. 40960
actattctcaaggaatctattctgagaacctcttcccacactttccccttcacccttgagaggccatctccaattcatcaccctgctattccttcatactcaggccatcatcatacgagatttgacaatcagcaaagactggtaagaagatgctgaagaaattgttgccaaagactaagagcaagaagaagaaggacgcagcctcctctgcgatacccacgttggatcggctccatgagactctagaaatgctggagaagaaagagtgtttccttcagaaaaagtgttctgctgaaatagaaaaggctaaggattatacaaaatcgaagaataagaatgctgcaattcagtgtctaaagaaaaagaagctgtacgagacacaaattgaacagctatcaaaatttcaattgcgagttcatgaccagattataatgcttgaaagtgcaaaggcaactaccgatactgttgatgctttgcgttctggatcatctgctgtcaaagctattcagcaatcactggacatcgatgatattgagaacgccattgatgaggcaaacggacagacagaaaatatgaggcgaggcgaggcttcgacgcgagacctggaggcggcggtgcgcgaggcgaggcagcagcgatagcgcgcgaggcgccaaggcggcggcgcgag

SEQ ID NO: 40960 - protein, 163 aa, Panicum virgatum
  misc_feature: Ceres CLONE 2005602
  misc_feature (23)..(160): Pfam Name: Snf7 Pfam Description: Snf7
MLKKLLPKTKSKKKKDAASSAIPTLDRLHETLEMLEKKECFLQKKCSAEIEKAKDYTKSKNKNAAIQCLKKKKLYETQIEQLSKFQLRVHDQIIMLESAKATTDTVDALRSGSSAVKAIQQSLDIDDIENAIDEANGQTENMRRGEASTRDLEAAVREARQQR

SEQ ID NO: 40961 - DNA, 642 bp, Panicum virgatum
  misc_feature: Ceres CLONE 2005605
  misc_feature: Encodes the peptide sequence at SEQ ID NO. 40962
aatgtgcaagctagctcactgcgacccagtgtgtgatgatggctcagggaagaggcagtgcaagctgcggcgccctcgccgccgcggcgctcctggtcatcggcctcctcgtgatggcgacgagcgcgccgctcgccgaggcggcggcgtcgtacatggtcggcgactacggcggctggaagttcaacgtcgaccggtgggccaaggggaggaccttccgcgctggcgaccagctcgtgttcaactacaaccgggcggtgcacgacgtggcggcggtgaacgcggcggcgtaccggagctgcgtggtgcccaggggcgccagggtgctgcggagcgggcgcgacaaggtgaggctcggcaggggcacgcactacttcgtctgcaccgtgcggggccactgccaagccggcatgaagatcgccgtcagggccgtgtagggggctgggctgggctgggccgtcgggcggcggctatatccgacttccagagtccagatccaaatccacgccagaaacgccaaaaactttgtggtagctcattagtttgcttagttatactctagtggcgtgcaatctggtggtggtgttgtttctaatgtacgtccaggcttcgtttgccaagtggcttctgtgctgtcactgt

SEQ ID NO: 40962 - protein, 132 aa, Panicum virgatum
  misc_feature: Ceres CLONE 2005605
  misc_feature (47)..(125): Pfam Name: Cu_bind_like Pfam Description: Plastocyanin-like domain
MAQGRGSASCGALAAAALLVIGLLVMATSAPLAEAAASYMVGDYGGWKFNVDRWAKGRTFRAGDQLVFNYNRAVHDVAAVNAAAYRSCVVPRGARVLRSGRDKVRLGRGTHYFVCTVRGHCQAGMKIAVRAV

SEQ ID NO: 40963 - DNA, 669 bp, Panicum virgatum
  misc_feature: Ceres CLONE 2005621
  misc_feature: Encodes the peptide sequence at SEQ ID NO. 40964
aaggcctaagcctttcttccccgcaaagaaagaaacgagcagcagcagcggaacgagagagaagcagcagcagcgacgatggcgagcggcggcatgaagagggagatcagcgagacccacgatgccctccgcttcggcatcaacgccggcgtcaaggccgacctcgcgccgccgcatcctctccagtccaccatccaatcggaggccaagttctgggcggacaagaagaggttcgggacggaggctatctacggatccgccttcaacatccgcaaggatctcgatgcccaaatcctctccaggttccaaaggccccctggtgctttgccatcatctatgcttggatatgaggcactgacaggttccttggatgattttggatttgaagattatcttaacatgcctcaagattctgacagtttccgtcaacctgacatgcaccatggaatggaagttcgccttggcttgtccaagggacctatctgccctagcttcaattgatccatccatgtagttctgcagtacgttgtgcaccacacagtccagtacatcggtcaatagaccatattatcatggtgaaaagtgaaaaccgatgagccttgccacctgttcagtgttcagtgttcagtgtcatgtttcagtcaacaccgaatttagttcttatcccta

SEQ ID NO: 40964 - protein, 140 aa, Panicum virgatum; identical to SEQ ID NO: 10287
  misc_feature: Ceres CLONE 2005621
  misc_feature (2)..(131): Pfam Name: UMP1 Pfam Description: Proteasome maturation factor UMP1

SEQ ID NO: 40965 - DNA, 948 bp, Panicum virgatum
  misc_feature: Ceres CLONE 2005624
  misc_feature: Encodes the peptide sequence at SEQ ID NO. 40966
atccggccatcccccctcccaggaagcgaagcatcccagtcagagtcagccggagcaccacccacccccatggcgcacgcggaggcctccttcgatctgcgccgccggaggatgcaggaccaacgcgccgccatccagcgccggatcacccacgcccgagaccgcgcctccgcaacagccgacgccttcagcgccgccctcctctccgcgcgctccatcgccaaccaaaccgtctccaaccgagcacaactcaaccaactaaaacaacagctccggaaattagaagcggatcttgcacgagccctctccgtccaaacaagcaaaacgtcaaaacacaagctcatgggcgactcaattttgaacaccactgcaacgaacgagcagctcaggagcctgctcatggatcagagggctacaagagatgaatatgtgaatgccatatcaaaccaatcccaagctgttgaatccattaaagctgagagtgatgcaaaaggggataagaacctagacaatgctatcatgtggtacgacaagtttcttggttttcaagttgttggaggagaaggggtgagatttgtgttcagcaaaatagacatgcaaagtcctgacaaggagtattctttttgcataaagcttattgatgaaagatacatcttagtccattgtgctccctttgtgcatggctccgaagaacttgtgaaggatcttaactgcaacaatgagctgtacaaatttgtgaggaccatgagagagaggttccagatcgctacaatcagtggtactttatgatacatattctctttacctgttctgtttcagaaaagaatgtctacattaatggaacttcaatcatgtcaaaggttccaggttcaggagtattgagcatgacaaagtcttatgaacttgactccactatctgtgtatgtgcgtcagtgaaacttcacagcc

SEQ ID NO: 40966 - protein, 239 aa, Panicum virgatum
  misc_feature: Ceres CLONE 2005624
  misc_feature (153)..(230): Pfam Name: Spindle_Spc25 Pfam Description: Kinetochore protein Spc25
MAHAEASFDLRRRRMQDQRAAIQRRITHARDRASATADAFSAALLSARSIANQTVSNRAQLNQLKQQLRKLEADLARALSVQTSKTSKHKLMGDSILNTTATNEQLRSLLMDQRATRDEYVNAISNQSQAVESIKAESDAKGDKNLDNAIMWYDKFLGFQVVGGEGVRFVFSKIDMQSPDKEYSFCIKLIDERYILVHCAPFVHGSEELVKDLNCNNELYKFVRTMRERFQIATISGTL

SEQ ID NO: 40967 - DNA, 672 bp, Panicum virgatum
  misc_feature: Ceres CLONE 2005625
  misc_feature: Encodes the peptide sequence at SEQ ID NO. 40968
atagaagtggtttaatagctgacaaactggaaaaggaaccatcacttagctaccaaactgatgattattggtctcagattgttgataaaaggtacatgtttgatatgccaaaactggaagctgaagagcttaggacaattaagaaggctgatgttatcgattggtataatacatacataagatcaccggccccaaagcgtagacgactagcaatccatgtgtatggttgcaatgcggacattgctgaggctgccaaactccaggaacagttgtggactgcgattgataacgtacaatcgtttaaggtttcgtctcaattttattcaagcctctgctgaggatggcactatctgttgctgtgaaatcacaattcctacagatgagcatctccaaagaaacatcacaattcctacatatgagcatctccaaagaaacaatttttagcagacatttgtggacgtctggatgcacaactcggacattccggaggcatgccaaggtgcaagagtgtcatggacagatggaccataacaaatgactcaggatcctgctgctgatagacgccatgtgaacctgtagttggtctacaggcaagaaattgaagagcattgttgtgacctagcatcaacgttcataatcccattgtttcttatatagttgggcaagaatcag

SEQ ID NO: 40968 - protein, 111 aa, Panicum virgatum
  misc_feature: Ceres CLONE 2005625
  misc_feature: SWISSPROT Homolog: EC 3.4.24.56 Insulysin
RSGLIADKLEKEPSLSYQTDDYWSQIVDKRYMFDMPKLEAEELRTIKKADVIDWYNTYIRSPAPKRRRLAIHVYGCNADIAEAAKLQEQLWTAIDNVQSFKVSSQFYSSLC

SEQ ID NO: 40969 - DNA, 720 bp, Panicum virgatum
  misc_feature: Ceres CLONE 2005639
  misc_feature: Encodes the peptide sequence at SEQ ID NO. 40970
gcgaaagagggagagagggaggagcttagtttaagcggctgcctccccgtctcctgtgccccggcccccgcccccacgcgcgcgccaccgcctccgatccgagctgccgcctacagagtcagcccaggcaacctcaatgttccttgtgagataacatgtctgaacagcaggaacgtgttagcaaaagctcttcctcgagtattagcagcagtactcaggagagtgaggaggaagtgaccattggtacacttataactgaagcaacaaacacaacaaacagtgggaagagccttggaaggcgcctgtcccacttagattcgatcccacacactcctcgagtgaatgggaaaattccagattttaataatgcgacgatagatcatgaatcgttattggaaagattgggcacgtacggcttagctgaatatcagatagaaggagatgggaattgtcagttccgagccctggcagaccagatattccggaatcctgactatcacaaacacgtgaggaaggcagtagtaaagcagctaaaggaattcaggaagcactatgaaggctatgtaccaatggaatataaggtttatctgaagaaaatgaaaagatctggggaatggggagatcatgtgaccttacaggcggctgcagacaggttttctgctaaaatatgcctgttgacatcgtttagagacacatgcctagtcgagataatatcccgag

SEQ ID NO: 40970 - protein, 188 aa, Panicum virgatum
  misc_feature: Ceres CLONE 2005639
  misc_feature (94)..(186): Pfam Name: OTU Pfam Description: OTU-like cysteine protease
MSEQQERVSKSSSSSISSSTQESEEEVTIGTLITEATNTTNSGKSLGRRLSHLDSIPHTPRVNGKIPDFNNATIDHESLLERLGTYGLAEYQIEGDGNCQFRALADQIFRNPDYHKHVRKAVVKQLKEFRKHYEGYVPMEYKVYLKKMKRSGEWGDHVTLQAAADRFSAKICLLTSFRDTCLVEIISR

SEQ ID NO: 40971 - DNA, 603 bp, Panicum virgatum
  misc_feature: Ceres CLONE 2005643
  misc_feature: Encodes the peptide sequence at SEQ ID NO. 40972
atcacaccactcgaattctcgcgctcagattccccaattttccctcctccaaagctctcccgaagcgcggcagcggcgaccatggacgccagcggagccaccgggaaggtgaagaagggggcggccgggcgcaaggcgggtggccccaggaagaagtcggtgtcgcggtccgtgaaggccgggctccagttccccgtaggccgcatcgggcgctacctcaagaagggccggtacgcgcagcgcgtcggcaccggcgcccccatctacctcgcggccgtcctcgagtacctcgccgccgaggtgctggagctggccggcaacgcggcgagggacaacaagaagacgcgcatcatcccgcgccacgtgctccttgcgatccgtaacgacgaggagctcgggaagctgctggccggcgtcaccatcgcccacggcggcgtcctccccaacatcaacccggtgctgctgcccaagaaggccgcggagaaggcggccagcggcggcgccaaggaggccaagtcgcccaagaagggcgccaaatccccgaagaaggcttagacagtagagactccagtagcactgtggtgtaacatgttggtgtttaga

SEQ ID NO: 40972 - protein, 157 aa, Panicum virgatum; identical to SEQ ID NO: 40238
  misc_feature: Ceres CLONE 2005643
  misc_feature (29)..(102): Pfam Name: Histone Pfam Description: Core histone H2A/H2B/H3/H4

SEQ ID NO: 40973 - DNA, 241 bp, Panicum virgatum
  misc_feature: Ceres CLONE 2005645
  misc_feature: Encodes the peptide sequence at SEQ ID NO. 40974
gacaccattacagtacgcactccggctgacgcgccccgcactctctcacaaagctcaagcctttcgctcgctcgctcgctcgcggctacatctacaatggcgcgcttccagctcgcggccctggccatggccatgctcttcgccgcggcggcggcgcaggccccggccgcccccccgacgccggcgcccagggcgtcccccccgccggcgacccctccgccgaccacggcgccggtgtctc

SEQ ID NO: 40974 - protein, 48 aa, Panicum virgatum
  misc_feature: Ceres CLONE 2005645
  misc_feature: Functional homolog of the protein sequence given in SEQ ID NO 50206
  misc_feature: Useful for making plants with altered carbohydrate content
  misc_feature: Functional homolog of the protein sequence given in SEQ ID NO 50194
  misc_feature: Useful for making plants with altered cell wall content and/or composition
MARFQLAALAMAMLFAAAAAQAPAAPPTPAPRASPPPATPPPTTAPVS

SEQ ID NO: 40975 - DNA, 704 bp, Panicum virgatum
  misc_feature: Ceres CLONE 2005651
  misc_feature: Encodes the peptide sequence at SEQ ID NO. 40976
agcagtcactgagccaagagggccaaggcggatacagcgcccaacgccaccatctcgccggggacggtcgcttctggccacccacagagctttggagtggtgggatggccacccataagaactttcaggatgaacagcctattcaaccaggccaaagacaatgcttcagaggctagcaccaagaaggccgctgatgaatctgacatgcagaaagacgaggagagcgagaagaaagggcgggttgtcggttgggtgaaggtgaacatggatggagatatcattggaaggaaggtcgatcttaacgcccatcgttcgtataagactcttgcctcagcacttgagctgatgttcatgaagccatccatcagtctttacacttctagtagtgcaaagtctctgaatctattggacagctcatcggaatatcagctcacctatgaggactgggatggggattggatgctcgtcggagatgttccatgggagatgtttgtaggttcagtgaagaggctcaagatcatgagggcatcagatgctaatggtctgggtctgcgattccaaggggttcacagagctgcagctttcacaagagctagaacttgagaagcactgatggcgttcgatctagagagctataccactggtgaagcttgaaatttgtttcatatcacataacagcagtccgtatctttggcatagttgtg

SEQ ID NO: 40976 - protein, 157 aa, Panicum virgatum
  misc_feature: Ceres CLONE 2005651
  misc_feature (2)..(143): Pfam Name: AUX_IAA Pfam Description: AUX/IAA family
  misc_feature: The sequence is a functional homolog of SEQ ID NO 1149 in the 10/412,699 US patent application
  misc_feature: The sequence is a functional homolog of SEQ ID NO 742 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: Functional homolog of the protein sequence given in SEQ ID NO 50146
  misc_feature: Useful for making plants with altered terpenoid content
MNSLFNQAKDNASEASTKKAADESDMQKDEESEKKGRVVGWVKVNMDGDIIGRKVDLNAHRSYKTLASALELMFMKPSISLYTSSSAKSLNLLDSSSEYQLTYEDWDGDWMLVGDVPWEMFVGSVKRLKIMRASDANGLGLRFQGVHRAAAFTRART

SEQ ID NO: 40977 - DNA, 686 bp, Panicum virgatum
  misc_feature: Ceres CLONE 2005653
  misc_feature: Encodes the peptide sequence at SEQ ID NO. 40978
actattcgcctttccgcacccgccgctcggtcgccttcgagttccaccagccaccaaacccgccggggagaagtcgagaggagcaagtcgccgagaagaggagatggcccgtacgaagcagaccgcccgcaagtccaccggagggaaggcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagcttcccttccagcgcctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcaccatcatgcccaaggacatccagctcgcccgccgcatccgcggcgagcgcgcgtaagccgcagccgccgctgccgtaccagtagtggagatggaggaggtcaagatggatctggatttagctgtactagttgtcgttctcggtttggttagtgtaaaaacaggtttacaagtctattttgtgcttcgctgctattgtggctctcgcttcatgatgaagcgaccttgtt

SEQ ID NO: 40978 - protein, 136 aa, Panicum virgatum; identical to SEQ ID NO: 9871
  misc_feature: Ceres CLONE 2005653
  misc_feature (58)..(132): Pfam Name: Histone Pfam Description: Core histone H2A/H2B/H3/H4

SEQ ID NO: 40979 - DNA, 701 bp, Panicum virgatum
  misc_feature: Ceres CLONE 2005663
  misc_feature: Encodes the peptide sequence at SEQ ID NO. 40980
ccagcccctacccgcccgtccagccccacccgcccatcccccgacgccgcccccagacccccgcttctcgtcgccacctcctcgcggcccgcctccgccgcccgcctgccgccgcaagcccgcagcgccgccacccactggtaagccacacagccccctttccccacctcgatctcgcacgcctagggtttcgtctcgccgccttccaccaccgccaagatgccgaagaacaagggtaagggaggcaagaaccggaagcggggtaagaacgaggcggacgacgacaagcgcgagctcgtcttcaaggaggacgggcaggagtacgcccaggtgacccgcatgctcggcaacggccgctgcgaggccatctgcgtcgacggcacgcgccgcctctgccacatccggggcaagatgcacaaaaaggtctggatcgcggcgggcgacatcgtcctcgtcggcctccgcgactaccaggatgacaaggccgacgtcatcctcaagtacatgaacgacgaggcgcgcctgctcaaggcctacggcgagctccccgagacgctcaggctcaacgagggagtcgacgtcgacgggcccgaggacggcgaggagggcagcgactacatccagttcgaggacgaggacatcgacaagatctaagattcctgtttctcctcgcggttactttcttatatgcgacttattgt

SEQ ID NO: 40980 - protein, 144 aa, Panicum virgatum; identical to SEQ ID NO: 10083
  misc_feature: Ceres CLONE 2005663
  misc_feature (30)..(94): Pfam Name: eIF-1a Pfam Description: Translation initiation factor 1A / IF-1

SEQ ID NO: 40981 - DNA, 955 bp, Panicum virgatum
  misc_feature: Ceres CLONE 2005675
  misc_feature: Encodes the peptide sequence at SEQ ID NO. 40982
atccatcacacccagctcccactctctcctccatcctacagctatagctagtagctactctactccaagggcatgaagagcaggaagggctacggcgggcagcagggccacctgctgagcccggtgggcagcccgccgtcggacaacgagtccggcgcggcggcggcggccgggtgcgggagcagcgcggggtacgccggcggcggggactcgccggccaaggagctggaccggttcctgccgatcgcgaacgtgtcgcgcatcatgaagcggtcgctgccggcgaacgccaagatctccaaggaggccaaggagacggtgcaggagtgcgtgtcggagttcatcagcttcgtcaccggggaggcctccgacaagtgccagcgcgagaagcgcaagaccatcaacggcgacgacctgctctgggccatgaccacgctcggcttcgaggcctacgtcggcccgctcaagtcctacctcaaaccgctaccgcgaggccgagggcgagaaggccgccgtgggcggcgcgcggcacggcgacggcgccgccgacgagggcccgctcggcgcgggcgccgtcgcggcggcggcgcccgctgaccgcgcgggccaccacgacgccggcggctcgatggacgtcgggctcttgatgggggtcggcgccggcaggttcggcgccggcggcgggacgtcgtcgtactactcggcggccgcggggagggcgtacggcggggacgggtccaaggtgctggagttcgacggcgaggaggagaacggccgcggcatgcagagggggttcggcgccggccacctccacggcgccgtgcaattgtgaagggcgcgccgtagctgtagttgtaggaggcgacgaacggcatatgcttcgtaatcgtaattaattaactaaatttgcttcgcgtactaatgaactgttgccgctctgcagctgttaagcagc

SEQ ID NO: 40982 - protein, 174 aa, Panicum virgatum
  misc_feature: Ceres CLONE 2005675
  misc_feature (54)..(119): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 791 in the 10/374,780 US patent application
  misc_feature: The sequence is a functional homolog of SEQ ID NO 60 in the 10/675,852 US patent application
  misc_feature: The sequence is a functional homolog of SEQ ID NO 62 in the 10/675,852 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 44 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 66 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 14 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 64 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: Functional homolog of the protein sequence given in SEQ ID NO 50465
  misc_feature: Useful for making plants with modulated biomass
  misc_feature: The sequence is a functional homolog of SEQ ID NO 12 in the 10/675,852 US patent application
  misc_feature: The sequence is a functional homolog of SEQ ID NO 42 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: Functional homolog of the protein sequence given in SEQ ID NO 50466
  misc_feature: Useful for making plants with modulated drought sensitivity
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 793 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 803 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 795 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 22 in US patent 7166765
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
MKSRKGYGGQQGHLLSPVGSPPSDNESGAAAAAGCGSSAGYAGGGDSPAKELDRFLPIANVSRIMKRSLPANAKISKEAKETVQECVSEFISFVTGEASDKCQREKRKTINGDDLLWAMTTLGFEAYVGPLKSYLKPLPRGRGREGRRGRRAARRRRRRRGPARRGRRRGGGAR

SEQ ID NO: 40983 - DNA, 705 bp, Panicum virgatum
  misc_feature: Ceres CLONE 2005688
  misc_feature: Encodes the peptide sequence at SEQ ID NO. 40984
gagccgcccattcgcgccgccgccgctcgccgccacccttagcgccgccgccctcggttgtcgccgcccgcggccgctcgatccgatggctcccacgaagaagtcggtacgaaccctaaccgatcttctcgtgcactattcctcccatttcgcggtcagtgttttcgcccgtgttgttgttttcctgatggttttcgatctgtgcagaagaagagcacggagagcatcaacaacaagctgcagctggtgatgaagagcggcaagtacacgctcggctacaagaccgtcctcaagacgctgcgcaactccaaggggaagctgatcatccttgcgaacaactgccctccgcttaggaagtctgagatcgagtactatgccatgctcgccaaagttagcgtgcatcatttccatggaaacaatgttgatctcggcactgcctgcggcaagtactacagagtgtgctgcctcagtatcattgacccaggtgactcggacatcatcagcaccacccctggcgcccagtgagcaaagaagaggagcgagctttgcctatccctagttgagatgagatatagggctcagaccttgccaggccaatggccgtttcttgtttgtctttagtctatgatgagttgatcttgcatacatacctcatggttgttatgtatggcatatctatggttttgtttgatgagatcgtcataa

SEQ ID NO: 40984 - protein, 91 aa, Panicum virgatum
  misc_feature: Ceres CLONE 2005688
  misc_feature (1)..(85): Pfam Name: Ribosomal_L7Ae Pfam Description: Ribosomal protein L7Ae/L30e/S12e/Gadd45 family
MKSGKYTLGYKTVLKTLRNSKGKLIILANNCPPLRKSEIEYYAMLAKVSVHHFHGNNVDLGTACGKYYRVCCLSIIDPGDSDIISTTPGAQ

SEQ ID NO: 40985 - DNA, 705 bp, Panicum virgatum
  misc_feature: Ceres CLONE 2005726
  misc_feature: Encodes the peptide sequence at SEQ ID NO. 40986
cccccgagccctatccttttcccctcccctgggtctccccacccccaaggccccaactcctatcctctcctcacctcacccgcgccgccgcagcagcgccgccgccgccgcggcttcccttcctcacccgagccaagatgaatgttgacaagctcaagaagatggcaggtgccgtgcgcaccggtggaaagggtagcatgcgcaggaagaagaaggcagtccacaagactacaaccacagatgacaaaaggcttcagagcaccctgaaaagagtaggagtgaacactatccctggtattgaagaggtcaacatcttcaaggatgatgttgttattcagtttgtgaatcctaaagtgcaagcttctattggtgctaatacatgggtggtcagtggaactccacagacaaagaagctgcaagatctgcttccgtcgattatcaatcagcttggtcctgacaacttggacaacctgcggaggcttgcggagcaatttcagaagcaggttcctggagcttcaagcgctgaggctggtgctagcacaggtgctgctcaggatgacgatgatgacgttcctgagcttgtccctggagagacatttgaggaggctgctgaagagaaaaaggagtcgtcataatgttgctgcgtgcctgctgttgtgaagggtttataagtcaagcattgccattagaaaagacattctgttg

SEQ ID NO: 40986 - protein, 165 aa, Panicum virgatum; identical to SEQ ID NO: 39828
  misc_feature: Ceres CLONE 2005726
  misc_feature (34)..(92): Pfam Name: NAC Pfam Description: NAC domain
  misc_feature: Functional homolog of the protein sequence given in SEQ ID NO 50156
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
  misc_feature: The sequence is a functional homolog of SEQ ID NO 1614 in the 11/479,226 US patent application
  misc_feature: The sequence is a functional homolog of SEQ ID NO 784 in the 10/412,699 US patent application

SEQ ID NO: 40987 - DNA, 693 bp, Panicum virgatum
  misc_feature: Ceres CLONE 2005737
  misc_feature: Encodes the peptide sequence at SEQ ID NO. 40988
aaaggcgacgaccttttccacgagagagagggatgggctgctgcagcagccggagcaccgattctccggccagccgcgcgacgcggtggcgctccacgggcatcgtcgccctccgcgacgccaggttgaaggaagtgccaaatgaagtgctgcaagtgggaaattccttgagaactctggatttgacaaacaacaaactagttgagattccccaggatgttggcagacttgtgaatatgcaaagacttgttttggctgctaatttgattgaaatcattccagctaactttggacacctgcggaatcttaaaatcctcacccttgacagaaataggatctctatgttgcctgaagaattgggttctttgtcaaaccttcaacaactttctatttctcagaattctttactgtgcctgcctaagagtgtaggagatttgcgcaatatgtcaatactcaatgtatttgataacaaattaaaggaacttccggaatcaattggaggttgcaattccctggaagaattgcgggcaaatggtaattcaattgaagacatgccctcgtcaatttgcaaccttgtgtgccttaaatccttatcactgaatggaaacaaaattcgtcagctttcgcaaaacttactgaaagactgcacggctcttcagagtatatcgctgcatgacaaccccatcacaatgg

SEQ ID NO: 40988 - protein, 220 aa, Panicum virgatum
  misc_feature: Ceres CLONE 2005737
  misc_feature: SWISSPROT Homolog: EC 2.7.11.1 Non-specific serine/threonine protein kinase
MGCCSSRSTDSPASRATRWRSTGIVALRDARLKEVPNEVLQVGNSLRTLDLTNNKLVEIPQDVGRLVNMQRLVLAANLIEIIPANFGHLRNLKILTLDRNRISMLPEELGSLSNLQQLSISQNSLLCLPKSVGDLRNMSILNVFDNKLKELPESIGGCNSLEELRANGNSIEDMPSSICNLVCLKSLSLNGNKIRQLSQNLLKDCTALQSISLHDNPITM

SEQ ID NO: 40989 - DNA, 594 bp, Panicum virgatum
  misc_feature: Ceres CLONE 2005756
  misc_feature: Encodes the peptide sequence at SEQ ID NO. 40990
cccgattcgatcagccgccatggcccgctcctcctcgcagtcccagtcctccgtcggcggcgccggcgctggcgccggagcccgcccggccaccgttggcccgcgcggcacggccgcagctgccgccggcatgcgccgccgccgcgccaccgccagcgccgggggagggggcttctccggcggcggagggagcaacatgcttcgattctacaccgacgaggccccgggtctgcgcctctcgccaaccatggtgctcgtcatgtcgctgtgcttcatcggattcgtcaccgccctccacgtcttcggcaagctctaccgctcccgcaccgcagcagcctccgcgtgatccatcccatcgcatccctccggcgcgagtatcatcagatcacaaggttttcaatatatcatcatcagtctacttactcgtgtcttgcctagctttccttcctgtgctagatctggagggagatgaatggaaccctacaacttaaatgatgccccttcttttgccttgttcatcccctttccttttttttagtgcctttttatttactcccaagatgcaaagagttgtgccaagtcactgtaatcatg

SEQ ID NO: 40990 - protein, 108 aa, Panicum virgatum; identical to SEQ ID NO: 27967
  misc_feature: Ceres CLONE 2005756
  misc_feature (54)..(99): Pfam Name: Sec61_beta Pfam Description: Sec61beta family

SEQ ID NO: 40991 - DNA, 650 bp, Panicum virgatum
  misc_feature: Ceres CLONE 2005779
  misc_feature: Encodes the peptide sequence at SEQ ID NO. 40992
ttcctcccacaacattggtccgaagcatacatagggggaagagctttaagattgggtcactgcagatgttcatggagaacagtggaagcactgaggatatgggtcctcgagctttccctgtcaaggaggttcacaaaatagcagttttggatattaggttagcaaatgctgatcgtcatgctgggaatattctagtgcacaaggaggaagaaggtgacaactacaagctgattccaattgatcatggctactgcttgcctgagaagtttgaagactgtacatttgagtggctctactggccccaagcccgtgagccattcagcggtgaaactgttgaatacatcaaatcacttgatgctgagaaggacatcaaacttctcaagtttcatgggtgggagctgtctccgaaatgtgctcgtgtcctgcgcatcagcaccatgcttctcaagaaaggtgcagctcgtggcctcacaccatttgacatagggcgcatactgtgtagggaaactgtgaatagagactctgagattgaggacatcatccaggaagcagaggattctgttctcccagggtcaagcgaaaatatgttcttagagaccatatctgatatcatagaccgtcacctcgacaaggagtttgcttagagtttt

SEQ ID NO: 40992 - protein, 213 aa, Panicum virgatum
  misc_feature: Ceres CLONE 2005779
  misc_feature (1)..(168): Pfam Name: PI3_PI4_kinase Pfam Description: Phosphatidylinositol 3- and 4-kinase
PPTTLVRSIHRGKSFKIGSLQMFMENSGSTEDMGPRAFPVKEVHKIAVLDIRLANADRHAGNILVHKEEEGDNYKLIPIDHGYCLPEKFEDCTFEWLYWPQAREPFSGETVEYIKSLDAEKDIKLLKFHGWELSPKCARVLRISTMLLKKGAARGLTPFDIGRILCRETVNRDSEIEDIIQEAEDSVLPGSSENMFLETISDIIDRHLDKEFA

SEQ ID NO: 40993 - DNA, 223 bp, Panicum virgatum
  misc_feature: Ceres CLONE 2005791
  misc_feature: Encodes the peptide sequence at SEQ ID NO. 40994
acagtacgcgctccggctgacgcgccccgcacacaaaagctcaagtcttgcgctcgctcgctcgcggctacgtctacaatggagcgcttccagctcgcgaccctggccatggccatgctcttcgccgcggcggcggcgcaggccccggccgccgccccgacgccggcgcccagggggtcccccccgccggcaactcctccgccgaccccggcgtaacgagtgt

SEQ ID NO: 40994 - protein, 45 aa, Panicum virgatum
  misc_feature: Ceres CLONE 2005791
  misc_feature: Functional homolog of the protein sequence given in SEQ ID NO 50206
  misc_feature: Useful for making plants with altered carbohydrate content
MERFQLATLAMAMLFAAAAAQAPAAAPTPAPRGSPPPATPPPTPA

SEQ ID NO: 40995 - DNA, 866 bp, Panicum virgatum
  misc_feature: Ceres CLONE 2005798
  misc_feature: Encodes the peptide sequence at SEQ ID NO. 40996
agcaatctttgcggccaaaagaaaagggtggagaagcgaggaggaaaagggtggcaagaaaccacggagcgtcttcctcctaccgtctataaattcccctccctttctccttccctatataggaggcatcgacgccaagaagagggaggagcaccaaggacttccggcgcctgttcaggatctacatcttcccgagcgagttcttggttgatctcttcctcttcgaccacctcccaggcccttggtgtagcttgccactctcgccagtcaagttttcatgtctgatcttggcattcagatcccaactgccttcgatccctttgctgaggccaatgctggggactctggtgcggcagcaggatcaaaggactacgttcatgtacgcagccagcagcgtaatggtcgcaagagtctgactactgtccagggattgaagaaggaattcagctacagcaagatcctaaaagatctcaagaaagagttctgctgcaatggtacagtggttcaggacccagagcttggacaggtcattcaactccagggtgatcagaggaagaacgtctcaaatttccttgtccaggccggcattgtgaagaaggaacatatcaagattcatggtttctgagcaaccgtcgggtctatagcaagccctgcatgcaaagcagctatatatccggggtggagcatatccggctgtgtaaaagcaggcctacgcctgtgcgttctaccatacacataaaacctagccacctctctgcttgtatgcttgttaccattgtgtccaaacctgtacgaggcaccatcgttcgatggcttgcttctctatcagaaggttgaataaatgcaatttcgctatgctgtgtgcc

SEQ ID NO: 40996 - protein, 115 aa, Panicum virgatum; identical to SEQ ID NO: 12590
  misc_feature: Ceres CLONE 2005798
  misc_feature (27)..(108): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time

SEQ ID NO: 40997 - DNA, 597 bp, Panicum virgatum
  misc_feature: Ceres CLONE 2005827
  misc_feature: Encodes the peptide sequence at SEQ ID NO. 40998
agttgctgtttttatatcattctttgtttctgctgtactccacgagctatgtgttgctgttccctgccacatactcaagttctgggctttcttaggaatcatgttgcagattccccttatcgtattgacatcttacctcaaaaataaattcagagacacgatggttggcaatatgatcttttggttctttttctgcatctacgggcaacctatgtgcgttctcttgtattaccatgatgtgatgaacaggatcaactagacaacataaacttctgcaagtccttctttgcgagtcactcttccatcatggaatctgaaaagcaataatttgtgttcactccgccaactgcatatattttttatccctttgctacggccatccaggtttttcaagggaatccagtgtatatcattttatcatgtgtatgatagctagccttatctcactcttgtatctgtacataagcttcattctggtgaggttctacatgtaactgtaatggaaatattattcccctttctgcactggtagtgcactagtgccacatgctgacctgctcatgatgctagtataacatcatttggtgtctagcatgg

SEQ ID NO: 40998 - protein, 85 aa, Panicum virgatum
  misc_feature: Ceres CLONE 2005827
  misc_feature: SWISSPROT Homolog: EC 2.3.1.20 Diacylglycerol O-acyltransferase
  misc_feature: The sequence is a functional homolog of SEQ ID NO 2 in US patent 7067718
VAVFISFFVSAVLHELCVAVPCHILKFWAFLGIMLQIPLIVLTSYLKNKFRDTMVGNMIFWFFFCIYGQPMCVLLYYHDVMNRIN

SEQ ID NO: 40999 - DNA, 645 bp, Panicum virgatum
  misc_feature: Ceres CLONE 2005856
  misc_feature: Encodes the peptide sequence at SEQ ID NO. 41000
cttttctttcccgtctccccggttctcttcctcctctgctctctctctttctccggcaaccgagcgcacaagagtggtgaggaggcccgccggcccggtgccgccgtgggacccctcactggcgagcgcgctccctttggggtgagcgcgctgccgtcgagtggcctcgctgtagtgcccagagggcacgcgcagcgctcccagacccggagctccggggctatacggtggctgtaggcagccgcgccggcggtgacccccacgaccaggaggccagaaggctcgcgatgagattgacgcatgcgtcgggaaaccaaaacgcctactggaggcgaccgacgtccccaagctgccatacctgcgatgcatcatcctagagacgcttcgcctgtacccagttgtaccgcttctagtccctcgtgaatcctctgcagactgcaccgtcaatgggttccatattcccaaaggaaccatgcttctcgtgaacacatttgtgatctatagggatcctagggcatgggatgacccagaaacgttcctcccggaaaggtttgaggatggcaggaacaataatcaagctggtaagatggccatgtcatttggcatggggagacgacggtgcccagcagagaaccttggcatgca

SEQ ID NO: 41000 - protein, 57 aa, Panicum virgatum
  misc_feature: Ceres CLONE 2005856
  misc_feature: SWISSPROT Homolog: EC 1.14.13.89 Isoflavone 2'-hydroxylase
  misc_feature: Functional homolog of the protein sequence given in SEQ ID NO 50626
  misc_feature: Useful for making plants with modulated nitrogen use efficiency
MLLVNTFVIYRDPRAWDDPETFLPERFEDGRNNNQAGKMAMSFGMGRRRCPAENLGM

SEQ ID NO: 41001 - DNA, 705 bp, Panicum virgatum
  misc_feature: Ceres CLONE 2005888
  misc_feature: Encodes the peptide sequence at SEQ ID NO. 41002
aaaaaaaaactctccgactcctccccttggtcttccttcctggcggcggcgactgggcgagcggcggcgctactcgtcacgtcttcgcccagccctttgccggcgacgagcatccaccaggggaaatggttgagtacctcttggacgataacttcagtgtgagcaggctcgatcctgatggcaagaagtttgacagagtcactcgcatcgaagctcataatgagcagatgcacatgcaactagatattgctactgagatttacccgatgcgtgccggtgacaagttcaacatggtgttagctcctactctgaatctggatggaacaccagacactggctactacacacaggctggaaggaaaacacttgctgacaagtttgactatgtcatgcatggaaagctttacaagatctcagaagacagttccaccagctcatctactaaagtggagatctatgcctcttttggtggcctcctgatgctgcttaggtgtgatagttccagtgcagctagcttcgagctggatcagaggctgtttcttcttatcagaaaggtgtaaacgtattggctactcgaaaggctggttaccttgttgactgtactcaacttccaccctatatgtactatcagtgggctttcaattggtagaaacaacttctaccatgcagtgatgtaatctcgctacaactgagcccgtgaagggc

SEQ ID NO: 41002 - protein, 144 aa, Panicum virgatum
  misc_feature: Ceres CLONE 2005888
  misc_feature (7)..(143): Pfam Name: RNA_pol_Rpb8 Pfam Description: RNA polymerase Rpb8
MVEYLLDDNFSVSRLDPDGKKFDRVTRIEAHNEQMHMQLDIATEIYPMRAGDKFNMVLAPTLNLDGTPDTGYYTQAGRKTLADKFDYVMHGKLYKISEDSSTSSSTKVEIYASFGGLLMLLRCDSSSAASFELDQRLFLLIRKV

SEQ ID NO: 41003 - DNA, 345 bp, Panicum virgatum
  misc_feature: Ceres CLONE 2005912
  misc_feature: Encodes the peptide sequence at SEQ ID NO. 41004
agaacccgcccctcctcctccgccgccgccgcacccgccggccgctcgccgctcgcgccatgggtatcgacctcgtcgacgggggccggaataagaacaccaagcgcaccgctcccaaggccgacgatgtctacctcaaggtcctcgtccagctgtaccgctacctggttcgcaggagcaagaacgactacgccgccacgatcatgatgcgtctcttcaggagcaagaccaacctaccgccgctctcgctcccccgcctctaccagtgcatggagggcaaggaaaactagattgctgtgatcgtgggcaccgtgaccgacgacaacagggtctacaaggtgccga

SEQ ID NO: 41004 - protein, 76 aa, Panicum virgatum
  misc_feature: Ceres CLONE 2005912
  misc_feature: Functional homolog of the protein sequence given in SEQ ID NO 50173
  misc_feature: Useful for making plants with modulated nitrogen use efficiency
MGIDLVDGGRNKNTKRTAPKADDVYLKVLVQLYRYLVRRSKNDYAATIMMRLFRSKTNLPPLSLPRLYQCMEGKEN

SEQ ID NO: 41005 - DNA, 675 bp, Panicum virgatum
  misc_feature: Ceres CLONE 2005940
  misc_feature: Encodes the peptide sequence at SEQ ID NO. 41006
actcactctccatccagcgcgagctcgcgagagggggcagcaggtcggcagcagagcgagagcgcgcgtgccagcccatggcgagcaccaacatggcgtcggccacctcgcggttcatgctggccgcgggcgtgcccgcggcggcgggcagcggcggccgcgtcggcttcgcgtcgccgcccggcagggtgcagggcaggaggctcgtggcgcgcgccgaggaggaggccgcacccgcggcggaaggggagggcgccgtggccaccaagcccaaggccgagaagccgccgccgatcgggcccaagaggggcgccaaggtgaagatcctgaggagggagtcctactggtacaacgggattggcaacgtcgtcacagttgatcaggaccccaacacccgctacccggtggtggtgcggttcaacaaggtgaactacgccggcgtgtccaccaacaactacgccttggacgagatccaggaggtgaaatgaaaatgagccaggctgcctcaagggccgccgtgcccccgtgttgtcactgtagcctgtgaaacgagggtgttaaagctgctgtgctagcgcgtcacgacatcttgtgtgtaatagcttaatctctgtaatcattgtgtaattgcttgcttgctacaccacggacgactcaataatctcctgctcttaa

SEQ ID NO: 41006 - protein, 136 aa, Panicum virgatum
  misc_feature: Ceres CLONE 2005940
  misc_feature (75)..(136): Pfam Name: PSI_PsaE Pfam Description: Photosystem I reaction centre subunit IV / PsaE
MASTNMASATSRFMLAAGVPAAAGSGGRVGFASPPGRVQGRRLVARAEEEAAPAAEGEGAVATKPKAEKPPPIGPKRGAKVKILRRESYWYNGIGNVVTVDQDPNTRYPVVVRFNKVNYAGVSTNNYALDEIQEVK

SEQ ID NO: 41007 - DNA, 638 bp, Panicum virgatum
  misc_feature: Ceres CLONE 2005962
  misc_feature: Encodes the peptide sequence at SEQ ID NO. 41008
aacagctagcgtagcgaggcgagcagagcagccaagcatggagtccgaaggcgccggcgaggtgcggcactgggccgcggacgtcaacggcatctccctccacgtcgccgagcgtggcccctccaccgggccggcagtcctcctcatccacggcttcccggagctgtggctctcctggcgccaccagatggccgcgctcgccgcccgcggcttccgcgcgctggcccccgacctccgcggctacggcgactcctctgttcccgccgacccagccgcctactccatcttccacatcgtcggcgacttggtcgccctcctcgaccacctgcgcctcccaaaggtgttggtcgttgggcacgattggggtgcgcatgtggcgtggcacctctgcttgttccggccggacagggtgcgcgccgccgtcatcctgggcattccctactttccccgcggccctcgcccgatgaccgagtcctttgcaaagctcggcgacggcttttacatcaatcagtttcaggtgaggatctcttgcgctgctcaactacttcagagctattatgtggactggaaatttcagtggcattgcaatgcttggtgatagtgaaatgctggtgggattatttgctacttttcgcaag

SEQ ID NO: 41008 - protein, 186 aa, Panicum virgatum
  misc_feature: Ceres CLONE 2005962
  misc_feature: SWISSPROT Homolog: EC 3.3.2.10 Soluble epoxide hydrolase
MESEGAGEVRHWAADVNGISLHVAERGPSTGPAVLLIHGFPELWLSWRHQMAALAARGFRALAPDLRGYGDSSVPADPAAYSIFHIVGDLVALLDHLRLPKVLVVGHDWGAHVAWHLCLFRPDRVRAAVILGIPYFPRGPRPMTESFAKLGDGFYINQFQVRISCAAQLLQSYYVDWKFQWHCNAW

SEQ ID NO: 41009 - DNA, 512 bp, Panicum virgatum
  misc_feature: Ceres CLONE 2005969
  misc_feature: Encodes the peptide sequence at SEQ ID NO. 41010
ctttcgatatgggtgctcctccacatggaggcattgcctatggattggatcggttggtgatgctcttggctggtgagagctcaatccgggatgtgatagcattccccaagactacgacagctcagtgtgcactcaccaaagcaccatctgctgtagatcctcagcaactgaaggatcttgccttcccaaagtctactttgtaacactgttgagaattttgggttatattttgaggcgcattctagttttgcatggtagggaatgcgctttgttcacgagaactttccaaccctggaaaatctatagaagacggttaatacaaagttcaggaaatatggattctcaagagtttcggcagcgatgctatgcatttgtatacatccgccttgtaaattattcaacataatacgaattgttgtgcaaaatgtgaactgcacggtgctccatttgtttgcacctggtagttttttcttcatgcaataaagatttctcccaggcttatgcttggaaat

SEQ ID NO: 41010 - protein, 66 aa, Panicum virgatum
  misc_feature: Ceres CLONE 2005969
  misc_feature: SWISSPROT Homolog: EC 6.1.1.12 Aspartate--tRNA ligase
FDMGAPPHGGIAYGLDRLVMLLAGESSIRDVIAFPKTTTAQCALTKAPSAVDPQQLKDLAFPKSTL

SEQ ID NO: 41011 - DNA, 622 bp, Panicum virgatum
  misc_feature: Ceres CLONE 2005975
  misc_feature: Encodes the peptide sequence at SEQ ID NO. 41012
cattagcgcttatatggtctgtgcggggaggaaactcttctcttctaccacaaacgctacagctggtgacagtaataacaaagcagaagctaaaatatctgtgacttttgtcgataaggatggtgaggaaaagcttgttaaagttcctcttggaatgtcaatgctagaggctgctcatgagaatgacatagaacttgaaggagcatgtgaaggctctcttgcatgttcaacatgccatgtgattgtaatggatgtaaactactacaacaaaatggaagatcctgtggatgaagaaaatgatatgctggaccttgcttttgggctcactgagacatctcgccttggctgccaagtaattgcaagccctgagcttgatggcatacgtttggcactgccatcagcaaccagaaatttcgctgttgatgggtatgttgcgaaatcacactgactgacggagagcattaagatcatgaaagtcgcatgttggaattgggtacctgctcagtttaacagaataagagaatcaaataaattttttcttatgcttttcttgtcatatcttcaattctgaaattcatattaacctggtttccttctctaattttggtgagatggaaaatcc

SEQ ID NO: 41012 - protein, 148 aa, Panicum virgatum
  misc_feature: Ceres CLONE 2005975
  misc_feature (37)..(122): Pfam Name: Fer2 Pfam Description: 2Fe-2S iron-sulfur cluster binding domain
ISAYMVCAGRKLFSSTTNATAGDSNNKAEAKISVTFVDKDGEEKLVKVPLGMSMLEAAHENDIELEGACEGSLACSTCHVIVMDVNYYNKMEDPVDEENDMLDLAFGLTETSRLGCQVIASPELDGIRLALPSATRNFAVDGYVAKSH

SEQ ID NO: 41013 - DNA, 635 bp, Panicum virgatum
  misc_feature: Ceres CLONE 2005979
  misc_feature: Encodes the peptide sequence at SEQ ID NO. 41014
attcccccacagcacacacagcagctaatccagactcacactactgcagcatttgcttttcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcagaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagaagctagctgctagctagcgagctatattcaggagaataaaataaagttgaggcaccatcagcagcacatcatctatatatattattgttgtactcgatct

SEQ ID NO: 41014 - protein, 126 aa, Panicum virgatum; identical to SEQ ID NO: 40598
  misc_feature: Ceres CLONE 2005979
  misc_feature (37)..(122): Pfam Name: Tryp_alpha_amyl Pfam Description: Protease inhibitor/seed storage/LTP family

SEQ ID NO: 41015 - DNA, 666 bp, Panicum virgatum
  misc_feature: Ceres CLONE 2005981
  misc_feature: Encodes the peptide sequence at SEQ ID NO. 41016
cttcgcacttccgctccgccccgcctcgccgtctcgcgccgccgctcgcctctccgcccgccgcgaggatgccgttcaagaggttcgtggagatcgggcgcgtggccctgttgaactacggcaaggactatggccgcctcgtcgtcatcgtcgacgtggtcgaccagaacagggcacttgtggatgcccctgacatggtcaggtgccagatgaacttcaagcggctctcacttactgacatcaagattgacatcaaacgtgtacccaagaagacaaccctgatcaaggcgatggaggaagctgatgtgaagaccaagtgggagaacagctcatggggcaagaagctgattgtccaaaagaggagagcagcgctcaatgactttgataggttcaaggtcatgttggcgaagatcaagaggggtggggcggtccggcaagagcttgccaagctcaagaaggcgtccacagcttagagtatcttttggagttttggtgaatggcatgttgagtttttggtaccttgttggatcagtcattcgtttgagtgttgttaaagccagaattagcactactgtttcctatgaactcttttcaaaccttaatcaagaatggctgtgctctggagatttttgtcatggatgttatgaaatatctaaggtagtttgc

SEQ ID NO: 41016 - protein, 134 aa, Panicum virgatum
  misc_feature: Ceres CLONE 2005981
  misc_feature (44)..(120): Pfam Name: Ribosomal_L14e Pfam Description: Ribosomal protein L14
MPFKRFVEIGRVALLNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAVRQELAKLKKASTA

SEQ ID NO: 41017 - DNA, 903 bp, Panicum virgatum
  misc_feature: Ceres CLONE 2005991
  misc_feature: Encodes the peptide sequence at SEQ ID NO. 41018
gcccaccatctccgggctcccggccaggtgcgcgcctcggcctccccgactcctcctttcttctctctctcgcctccggccacgggcaggaaccgatctcggagccctccccgtcgcggcgttgttcgttggcggttcggttgccgcttgatcgggcaagaagaagaagaagaagaagaggggagccgggagccgaaatggtgaaggacagtgcgtactacgacatcctggaggtcagcactgacgcctcagtggcccagatcaagaaggcctattacctcaaggccaagctggtgcacccagacaagaatcccggcaaccctgacgcggcacgcaagtttcaggaattaggtgaagcctatcaagttctaagtgatccggtaaaaaaggagtcttacgacaagtatggaaaggaaggtcttccccaagataacatgattgatccaactgctgtctttgggatgctttttgggagtgaacattttgaagattatgtcggtcaacttgcactagcatccgttgcttcggtagagattgaggaggaatcaactacacctgaggcaaggacaagggttcaagagaagataaaggacgtgcaaactgaaagagagcaaaaacttactcagattctaaaggagcggctccagctgtatgttgatgggaaccaagacgagtttggtgactgggcaaatgcagaagctcagcgtttgtctcaagctgctttcggtgaggctatgcttcacactatcggccatatttatgttcgacaagcagcaagagagcttggaaaaagcaaactgtatatgggtgtaccattcatagctgagtgggtaagggataagggccaccatgtaaaatcgcaggttaatgctgctgcaggtgcaatttctctgatacagctac

SEQ ID NO: 41018 - protein, 235 aa, Panicum virgatum
  misc_feature: Ceres CLONE 2005991
  misc_feature (6)..(68): Pfam Name: DnaJ Pfam Description: DnaJ domain
MVKDSAYYDILEVSTDASVAQIKKAYYLKAKLVHPDKNPGNPDAARKFQELGEAYQVLSDPVKKESYDKYGKEGLPQDNMIDPTAVFGMLFGSEHFEDYVGQLALASVASVEIEEESTTPEARTRVQEKIKDVQTEREQKLTQILKERLQLYVDGNQDEFGDWANAEAQRLSQAAFGEAMLHTIGHIYVRQAARELGKSKLYMGVPFIAEWVRDKGHHVKSQVNAAAGAISLIQL

SEQ ID NO: 41019 - DNA, 640 bp, Panicum virgatum
  misc_feature: Ceres CLONE 2006009
  misc_feature: Encodes the peptide sequence at SEQ ID NO. 41020
ccagctgctgcctgatcttttatcccccacttgccgcttgctgcccggggactgggctgctgggggaaggtcgccgacgggatcgatggaagattcgtctacgtttacggaaggagaggtggccgaagaagcgaaggggcaggctccaggccaaggaagctctgaaggtagtcatggtactcttttgcaagatataagggagaaggaaacaagaaaaggaaaggcggctgttggatccactgagctgatgagggaggatctggttcagagtgctgttagttttctgaaacatccaaaagtagtaacctcttcagacggacagaggcgatctttccttgaaaataaaggactcactgtggatgaaatagatgaagcatttcggcgtttacaaagcccatcttcacattctttgagctcaaatacttgcacatctcaaggggtgtctgatcattcgtgcaagattagtcaggaaactaaagttggcacaaagtgtatggatggttcagatagggttgaacctgaaactgaacctgtggcccctgtggtgcctcgtcatccaaaatcttatatggagatcatggaaatgatacaaaggggtgagcggccagatgatatacaggatattaatgatgaccctcca

SEQ ID NO: 41020 - protein, 184 aa, Panicum virgatum
  misc_feature: Ceres CLONE 2006009
  misc_feature (55)..(126): Pfam Name: Pex14_N Pfam Description: Peroxisomal membrane anchor protein (Pex14p) conserved region
MEDSSTFTEGEVAEEAKGQAPGQGSSEGSHGTLLQDIREKETRKGKAAVGSTELMREDLVQSAVSFLKHPKVVTSSDGQRRSFLENKGLTVDEIDEAFRRLQSPSSHSLSSNTCTSQGVSDHSCKISQETKVGTKCMDGSDRVEPETEPVAPVVPRHPKSYMEIMEMIQRGERPDDIQDINDDP

SEQ ID NO: 41021 - DNA, 622 bp, Panicum virgatum
  misc_feature: Ceres CLONE 2006014
  misc_feature: Encodes the peptide sequence at SEQ ID NO. 41022
aaaaaaaaaaaaccgcacacaaatcctcttccaccgcttcgtcctcctccaaattccaactcctccgagcggtcgcggcgagcgaagctcccggttcggcgatgtcggggcgcggcaagggcggcaaggggctgggcaagggcggcgccaagcgtcaccgcaaggtgctccgcgacaacatccagggcatcaccaagccggccatccggaggctggccaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctttacggcttcggcggctagatcggttcagcttctggtggcgaaggcaaactacatgtggtggggtgtgtgttctggtttagtgtagtcagggctctctgtatcgatgctgtgtcgtggtggttgtagtctatctactctgtgagtagttgtttgcgtttctagtcctctgcagtaatatctagttgctgttatcaatggaaaaccttggctctcgcctcagtttcgtc

SEQ ID NO: 41022 - protein, 103 aa, Panicum virgatum; identical to SEQ ID NO: 12044
  misc_feature: Ceres CLONE 2006014
  misc_feature (25)..(94): Pfam Name: Histone Pfam Description: Core histone H2A/H2B/H3/H4

SEQ ID NO: 41023 - DNA, 695 bp, Panicum virgatum
  misc_feature: Ceres CLONE 2006033
  misc_feature: Encodes the peptide sequence at SEQ ID NO. 41024
acacaaggtagataagcctttccagatcatactaaaccaagcagccacttcacactagggtacttggatcacacaagaaagttcaggtcggaagaagatgcaggccgccgccgctacagccgtcgggttctctgctgcggcgcccgtgaagggcgggccggcggcgaggagcacggtggtcgctcgtgtcccagccacaaggaggagcgttcgcgccgccgtggccgcggcggagcccgccgaggtcgactacagctcgagcttctccgtgttccccatggaggcctgcgagctgctcggcggcgacgcccgcagcgcgcagatgtacccggaggctaagctcgccggctcggctgaggcggccggcaggagggaggaggaggtggagagggactacctgtcctacgacgagccgaagacggtgttccccggcgaggcgtgcgacgacctcggcggcgagttctgcgaggcgccgtaccaggccggcgtgtccagggagctggcggcctggcgcacgcctgatcgggtcgaagggtgattggaagctagcagatgatgcttacgcggtagatggggagctagcgtacgcgcacgtacagaataacagcagccaagcaaggccaaggacttgtcacgtgtgtaaatgtgcatgtctctttggtcgtgtcagctgcctgtctgtagaaactaaagag

SEQ ID NO: 41024 - protein, 146 aa, Panicum virgatum
  misc_feature: Ceres CLONE 2006033
  misc_feature (1)..(126): Pfam Name: Lir1 Pfam Description: Light regulated protein Lir1
MQAAAATAVGFSAAAPVKGGPAARSTVVARVPATRRSVRAAVAAAEPAEVDYSSSFSVFPMEACELLGGDARSAQMYPEAKLAGSAEAAGRREEEVERDYLSYDEPKTVFPGEACDDLGGEFCEAPYQAGVSRELAAWRTPDRVEG

SEQ ID NO: 41025 - DNA, 631 bp, Panicum virgatum
  misc_feature: Ceres CLONE 2006046
  misc_feature: Encodes the peptide sequence at SEQ ID NO. 41026
acatacgaccatacccagtggaaaatacgggatcccgtccgctctcccatagtcaagccgctgaggggccgatcagtagttgggtcggtgacgaccagcgaatcccggctgttgtatgtgagcttatcgcttatcatctgcgcctccccatctctcccctgctcctccacctccttgtgatccatccaaaccaggggtagccatgtcggactccgaggagcaccacttcgagtcgaaggccgacgctggggcgtccaagacctacccgcagcaggccggtaccatccgcaagaacggattcatcgtcatcaagggccgcccctgcaaggtggtggaggtttctacctcaaagactggtaagcacggtcatgctaaatgccactttgttgccatcgacatattcaatgggaaaaagcttgaagatattgtcccatcttcccataattgtgatgtgccacatgtgaaccgcactgagtatcagctgattgacatatctgaggatggatttgtgagccttcttacttctgatggcaacaccaaggatgatcttagacttccaactgatgagactctcctgggccagattaaggaaggatttgacagcgggaaggaccttgtggtgactgtccag

SEQ ID NO: 41026 - protein, 142 aa, Panicum virgatum
  misc_feature: Ceres CLONE 2006046
  misc_feature (86)..(142): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTDETLLGQIKEGFDSGKDLVVTV

SEQ ID NO: 41027 - DNA, 593 bp, Panicum virgatum
  misc_feature: Ceres CLONE 2006057
  misc_feature: Encodes the peptide sequence at SEQ ID NO. 41028
gaagttcttcagcaacccaacgacagtcaatacaccagactaacaggattgccgccgcagccaaaccgtcaaaatggccatcaagaagagcaagaaggacgccaactctatcaactccaagctcgcgcttgtgatgaagtctggaaaggtcaccctcggctacaagtctaccctcaagtccctccgctccggcaaggccaagctcatcatcattgctggcaacactcctcctctccgcaagtccgagctcgagtactacagcatgctgtccaaggcccccatccaccacttctccggcaacaacattgagctcggcactgcctgcggtaagctgttccgctgcggcaccatggccatcctcgacgctggtgactcggatatcctctctgaccaggctgcttaagcggatgtgccttcaaaatgaaaatgcattgaacggcgttcgggggcaccatgggtttatgaggataccagtcaatgtgatgcgatacgagacggtcacagggaaagcgcaacgctgccctggtcctgcgtccgtcctttatgtgactggacgtgcaggattatttagcctcaatgataaaatacagctc

SEQ ID NO: 41028 - protein, 109 aa, Panicum virgatum
  misc_feature: Ceres CLONE 2006057
  misc_feature (11)..(105): Pfam Name: Ribosomal_L7Ae Pfam Description: Ribosomal protein L7Ae/L30e/S12e/Gadd45 family
MAIKKSKKDANSINSKLALVMKSGKVTLGYKSTLKSLRSGKAKLIIIAGNTPPLRKSELEYYSMLSKAPIHHFSGNNIELGTACGKLFRCGTMAILDAGDSDILSDQAA

SEQ ID NO: 41029 - DNA, 873 bp, Panicum virgatum
  misc_feature: Ceres CLONE 2006071
  misc_feature: Encodes the peptide sequence at SEQ ID NO. 41030
agatgtaacggtagcgactcaaatgagttgtttccctttctccgctaccacattcgatcggcttcgaggcaagcagcatcacaacacaacgtcctctcctgccggcggaccggatccacccccgcgccatgtactcccggcggccgccgcatccgtcccaccggagtccacggcgatcacccgccgcctactgtctcctcctcaccctcgctctcctcttcgcgtccgccgccgccaaatcctctcgccgccccatctccgtgcgtctccctctcctctttccccgctgacgcctcttccagcccttcctgcatccgtctcatcgtgcttgcggaacttcctggtgcaggacaacgagatccggcagaagaaggaggcctgctacaccgacgtcgcgaacgggctgtggggatgggtgtgcaggtcctcgccaacggagaaggagaactgcgtgctgcgctgcctctccccggagtgctacgacctcatctacggcggcgacccgcttgaagaaggggagctggattatgtccgcggccaggaatacaagtactgcatgcacaaatcatcccttggagaaagcttggatggcgttaaggggtccttcagctattcgttaagttagcaagaataaaaggctcccatatgtccaagctgcacttctcagttctcctctatacggtggtgttcagccatatccagctatcaacgtctccaagcatgggcaatcgataagttcatcgatgaaatccaaatcgattaaatgtgaaaattttcctaaaccctccaagcactgctgttgtgcatcctgatgggaaaagaaacctctttgtaatacaatttctccagctacatggtttgttttttcttttc

SEQ ID NO: 41030 - protein, 207 aa, Panicum virgatum
  misc_feature: Ceres CLONE 2006071
  misc_feature: Functional homolog of the protein sequence given in SEQ ID NO 51618
  misc_feature: Useful for biocontainment applications
DVTVATQMSCFPFSATTFDRLRGKQHHNTTSSPAGGPDPPPRHVLPAAAASVPPESTAITRRLLSPPHPRSPLRVRRRQILSPPHLRASPSPLSPLTPLPALPASVSSCLRNFLVQDNEIRQKKEACYTDVANGLWGWVCRSSPTEKENCVLRCLSPECYDLIYGGDPLEEGELDYVRGQEYKYCMHKSSLGESLDGVKGSFSYSLS

SEQ ID NO: 41031 - DNA, 611 bp, Panicum virgatum
  misc_feature: Ceres CLONE 2006093
  misc_feature: Encodes the peptide sequence at SEQ ID NO. 41032
atccaccctcatcggaagctccccaactccaagcctccttccagcagcgaagaagcgaagagccagccggagagcggcgatcgagcagcgtcgcgacaccagccagtcggatacaagcgatcccatggcgcccagaaggtcaccgtcgccggccgggagcagcggcagcggcagcgccgtgtgcgcgccggcggcggcggcggcagggcagcagccgaggctccgaggcgtgctccggccgtggggccggtacgcggcggagatccgcgaccccgtacgcaaggcgcgcgtgtggctggggaccttcgacacgcccgaggacgccgcgcgcgcctacgacgacgccgcgcgccggctccgcgggccacgcgccgccaccaactacccggcccgggacccgaaggccgcggcggcggacgctccggcggcgagcgggagcgggagcgcggtgctgtacgaggacgcctcgtcctcgtcctcctgccgggactcgccgctggcagtgacggtggccgtcgcggcgcacccgtcgctggacctgggcctgggcctgggcgcttaccggccatggcggccacggcgtcgtcgcaccacatgtccttggacccggt

SEQ ID NO: 41032 - protein, 162 aa, Panicum virgatum
  misc_feature: Ceres CLONE 2006093
  misc_feature (31)..(81): Pfam Name: AP2 Pfam Description: AP2 domain
MAPRRSPSPAGSSGSGSAVCAPAAAAAGQQPRLRGVLRPWGRYAAEIRDPVRKARVWLGTFDTPEDAARAYDDAARRLRGPRAATNYPARDPKAAAADAPAASGSGSAVLYEDASSSSSCRDSPLAVTVAVAAHPSLDLGLGLGAYRPWRPRRRRTTCPWTR

SEQ ID NO: 41033 - DNA, 681 bp, Panicum virgatum
  misc_feature: Ceres CLONE 2006157
  misc_feature: Encodes the peptide sequence at SEQ ID NO. 41034
gctggtgtttgtgtagctgcatcagaagcttcagtgggcagagaggaaggaaggagaggagagagatggggaggaagctgggcctcgacagggtcctggactgcttctcgctttcgctgtgcgccaatgcctgcgcctgcgtgcactcggtggagaaggacgaggacgaggccgacgagcgcaaggccctggtgagcagccagctggaggagctggtcaagctcagggacttcgtcgacggagcggccaagacccttgctttccatctagagcccaagacagtggagctcaaggtgtccatgcactgctacggatgcgccaagaaagtccagaagcacatctccaagatggccggcgtgacgtcgttcgaggtggatttggagaggaagaaggtggtggtgatcggggatgtcacgccgtacgaggtgctggagagcgtctccaaggtgatgaagttcgtggagctgtgggtggcgcccaaccccaagccgcaggccgcggaggagaggcagtagacgttgctaggtgctttggtcgccgtcgatctctcatgcgtccacggtctcggcctcgtctccagttctccacctaccatgcgtagcaagcagaaagaacacggccgctgtgacagacccgtcgggttgaaacgtttaattaagcgtaactgccaatatttaaact

SEQ ID NO: 41034 - protein, 149 aa, Panicum virgatum
  misc_feature: Ceres CLONE 2006157
  misc_feature (74)..(142): Pfam Name: HMA Pfam Description: Heavy-metal-associated domain
MGRKLGLDRVLDCFSLSLCANACACVHSVEKDEDEADERKALVSSQLEELVKLRDFVDGAAKTLAFHLEPKTVELKVSMHCYGCAKKVQKHISKMAGVTSFEVDLERKKVVVIGDVTPYEVLESVSKVMKFVELWVAPNPKPQAAEERQ

SEQ ID NO: 41035 - DNA, 440 bp, Panicum virgatum
  misc_feature: Ceres CLONE 2006161
  misc_feature: Encodes the peptide sequence at SEQ ID NO. 41036
ttggacattggatttcatgtggagtacattagtccttcaggggagaaaactctaattcttccctaccgacggtatgaagctgaccaaggcaatttttgcactatttcagcgggatcatacaaacttgtatgggacaactcatattcatcattcttcaaaaagagcctccggtacaaggtggatgctgtgccaccggttgtcgagccggccatgcccaccgtagagcccttatgaggcctgccttaatattgatgcctgtcatgaattagacggtgcaggtgcatcagaagccccaaacggtcttgtaaccaatacttgtatcataatcgcagggttctggtgatccatacacgtagctcccagtctgagagcaatatgtactgcgtgcacatggttacggccagttggccagttttccactgatgaatgcctaattctac

SEQ ID NO: 41036 - protein, 77 aa, Panicum virgatum
  misc_feature: Ceres CLONE 2006161
  misc_feature (1)..(62): Pfam Name: EMP24_GP25L Pfam Description: emp24/gp25L/p24 family/GOLD
LDIGFHVEYISPSGEKTLILPYRRYEADQGNFCTISAGSYKLVWDNSYSSFFKKSLRYKVDAVPPVVEPAMPTVEPL

SEQ ID NO: 41037 - DNA, 504 bp, Panicum virgatum
  misc_feature: Ceres CLONE 2006164
  misc_feature: Encodes the peptide sequence at SEQ ID NO. 41038
cgagggcaccccggccaccaccaccgacttcgacctcgacagaggaaggccagccagccatggatgcttcggtcctcaacaacccgcggctcaaggcgctcatagaggaggagagaacgaaggccttgacaaacgagctcgtggcaaagctgactcatgtttgctgggacaaatgcgttactgggagcatcggaagcagcttcagcaggagtgaggcctcgtgcttgtccaactgcgcgaaacgcttcgcagaagtgaagatgatgaccatgcaacgcatcaccgagcggtagctcaagtcacatcggcgtttctctacaactaaaattcttgtatcctctggagtatccaaatgaagtacaagtgttctgctgtagcacgagttctgttatcctttttctggcatactattgttggtgaagttgatagaaaggcatgcccaatgtagtacaatgttctgttagtacttctctatgttttaagctggagtgaagcagagcctac

SEQ ID NO: 41038 - protein, 77 aa, Panicum virgatum
  misc_feature: Ceres CLONE 2006164
  misc_feature (12)..(77): Pfam Name: zf-Tim10_DDP Pfam Description: Tim10/DDP family zinc finger
MDASVLNNPRLKALIEEERTKALTNELVAKLTHVCWDKCVTGSIGSSFSRSEASCLSNCAKRFAEVKMMTMQRITER

SEQ ID NO: 41039 - DNA, 437 bp, Panicum virgatum
  misc_feature: Ceres CLONE 2006165
  misc_feature: Encodes the peptide sequence at SEQ ID NO. 41040
ggcgagtggcatccgatggcgcggaactggggcgccaactggcactccctggcgtacctcaacgggagggggctctcgttcagggtgaccatcacggatgggcaaaccctcgagttcaccaacgtggtgccgcctggatggacgttcggcgtcacatttgcaagcaacttgcagttcaaataagaactgcttcattgggatttaccgcgattattgatgatctgagggccggaatcagatccatataataagttgctctcatgttgttcactacttgcacatgagatgacattggaagcgtgctctgtgtgtgtgtgtacacacaacaattgcagagttctattctagtaactctgtttttttttattgtatatgtatatatttatgaaattctaatgtatatataaagatgtctgtatatacacttattgtgagtc

SEQ ID NO: 41040 - protein, 60 aa, Panicum virgatum
  misc_feature: Ceres CLONE 2006165
  misc_feature (1)..(44): Pfam Name: Pollen_allerg_1 Pfam Description: Pollen allergen
  misc_feature: Functional homolog of the protein sequence given in SEQ ID NO 51623
  misc_feature: Useful for making plants with altered carbohydrate content
  misc_feature: Functional homolog of the protein sequence given in SEQ ID NO 50489
  misc_feature: Useful for making plants with altered cell wall content and/or composition
  misc_feature: Useful for making plants with altered lignin content
GEWHPMARNWGANWHSLAYLNGRGLSFRVTITDGQTLEFTNVVPPGWTFGVTFASNLQFK

SEQ ID NO: 41041 - DNA, 205 bp, Panicum virgatum
  misc_feature: Ceres CLONE 2006173
  misc_feature: Encodes the peptide sequence at SEQ ID NO. 41042
gacaccattacagtacgcactccggctgacgcgccccgcactctctcacaaagctcaagcctttcgctcgctcgctcgctcgcggctacatctacaatggcgcgactccagctcgcggccctggccatggccatgctcttcgccgcggcggcggcgcaggccccggccgccaccacgacgccggcgccaagggcgtccccaccgc

SEQ ID NO: 41042 - protein, 36 aa, Panicum virgatum
  misc_feature: Ceres CLONE 2006173
  misc_feature: Functional homolog of the protein sequence given in SEQ ID NO 50206
  misc_feature: Useful for making plants with altered carbohydrate content
MARLQLAALAMAMLFAAAAAQAPAATTTPAPRASPP

SEQ ID NO: 41043 - DNA, 574 bp, Panicum virgatum
  misc_feature: Ceres CLONE 2006176
  misc_feature: Encodes the peptide sequence at SEQ ID NO. 41044
ccaccactcctccccttccaaccccagcacccggcggcggcggcgagcggcggagatgacgacgagcctgaagaagaaccggaagaagcgcggccacgtgtccgcggggcacggccgcataggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgcggattctgagttttgagaa

SEQ ID NO: 41044 - protein, 147 aa, Panicum virgatum; identical to SEQ ID NO: 13747
  misc_feature: Ceres CLONE 2006176
  misc_feature (109)..(141): Pfam Name: L15 Pfam Description: Ribosomal protein L15

SEQ ID NO: 41045 - DNA, 902 bp, Panicum virgatum
  misc_feature: Ceres CLONE 2006182
  misc_feature: Encodes the peptide sequence at SEQ ID NO. 41046
gatctgattctcgctttcgtttcgccttttcctggccggcccggccggccccgtatttctccttctctgtctccgatccccggccggccggtaggataggctgctgggaaggtagattgtattggcagcgcgatgaaggtcagctcgggctttgagagcgcgagcgcgagcagcgccggcggctctgctggctcgggctccggcagcagctccggctggggctcgggctccttcaacctccggaacctatccaaggtcatcctgccgccgctcggcgggccctccggccacagccagctccatgccggctccgacaagtgggtcatctcgccgctcgactccagatacaggtgctgggagacgttcatggtggtcctggtggcgtactcggcgtgggtgtacccgttcgaggtggcgttcatgaacgcgtcccccaagggcggcctggaggtggcggacatcgtcgtcgacctcttcttcgccgtcgacatcgtgctcaccttcttcgtcgcctacatcgaccccaggacccagctgctcgtccgcgacaggaagaagattgccctcaggtaccagtaccacgcccttgctctagcttgcctcgcgcatcgcagcttcgcatgcagcagctattgagcttttgtcgatcgggcgcatgccaattgtgagaggaaaaaaaaacaaaaagtttacgagccgtctacgatgacgagaggcgtctcggactctaggatggacgatcatgcagcttcgacctcttgcatcggcatcgtcggccccgcctttctcttacttttaggtgcaccgagccatcgacccgtcggaaaatggcaagggtggtcggttgtttctgggtgctgttggagattcattagatgagccgtccaatttccattctgatc

SEQ ID NO: 41046 - protein, 167 aa, Panicum virgatum
  misc_feature: Ceres CLONE 2006182
  misc_feature: The sequence is a functional homolog of SEQ ID NO 1838 in the 10/374,780 US patent application
MKVSSGFESASASSAGGSAGSGSGSSSGWGSGSFNLRNLSKVILPPLGGPSGHSQLHAGSDKWVISPLDSRYRCWETFMVVLVAYSAWVYPFEVAFMNASPKGGLEVADIVVDLFFAVDIVLTFFVAYIDPRTQLLVRDRKKIALRYQYHALALACLAHRSFACSSY

SEQ ID NO: 41047 - DNA, 614 bp, Panicum virgatum
  misc_feature: Ceres CLONE 2006200
  misc_feature: Encodes the peptide sequence at SEQ ID NO. 41048
actcgaccgcaatcacagctcaacaacaaccacagcacgctacagctagaggtaaacagagcggagcagagtacgcaaccacgggcgacagtgcgcgatggctcgccggctgctcggtgcttgcggcgtgctcctcgccgccgtcctgctcgcggccgtggcgcccgcgcgtgctgacgagcggagcggcatacggcagcggggcggcgagtaccgcgggaggaaggttggggcgaggacggaggtgcgggacgtggagcgcgacggggaggtgcaggagctcggccggttctccgtcgccgagtacaaccggcggcgcgtcggcggcgaaaggctcgagttcggaagggtggtcgcggcgcagcggcaggtggtgtcggggctcaagtactacctccgcgtcgccgccgcggcggagaacgccggcggcgagcgcgtgttcgacgccgtcgtcgtcgtcaagccctggctcgagtcgcgcaccctgctcaggttcgcgccggccgccccgaaataagtgtagcggcaccctttgagtgctatgtccgtccgtgacttttggccggtctgctttctcgcagactttggtgagcgaataaaagttctgtttttgt

SEQ ID NO: 41048 - protein, 139 aa, Panicum virgatum
  misc_feature: Ceres CLONE 2006200
  misc_feature (45)..(137): Pfam Name: Cystatin Pfam Description: Cystatin domain
MARRLLGACGVLLAAVLLAAVAPARADERSGIRQRGGEYRGRKVGARTEVRDVERDGEVQELGRFSVAEYNRRRVGGERLEFGRVVAAQRQVVSGLKYYLRVAAAAENAGGERVFDAVVVVKPWLESRTLLRFAPAAPK

SEQ ID NO: 41049 - DNA, 655 bp, Panicum virgatum
  misc_feature: Ceres CLONE 2006244
  misc_feature: Encodes the peptide sequence at SEQ ID NO. 41050
cttctaacctcgcagtcatccccgagaaggagccgccgccgccgcgcagcgcaaaccctagcagtcttcgccgccgtcactcctcctcggggcgcaaccatggtggccacaaagaagacgaagaagtccacggacaatatcaacaacaagcttcagcttgtgatgaagagcggcaagtacacgctcggctacaagaccgtcctcaggactcttaggaactccaagtcgaagcttgtgatcattgctaacaactgccctccccttcggaagtctgaaattgagtactatgcaatgctggctaaggtcactgttcaccatttccatggaaacaatgttgacctgggtacagcctgtggaaaatacttccgtgtctgctgtcttagcattattgatccaggtgattcggatatcatcaagactacatcgggtgaccagtaaggaagagatgccagtaccccttggcattggtgttctgagcttttctagtgtagtagtggatctttcaggacttgtcctttcaccttatattgtgttaagcactatttgcctgcccgtaatctgagtttttgggaacagtcttgcattgaaaattttgttcctggaattgacactatcaatggagctgtggcctatggttgtcctcacttcagagttc

SEQ ID NO: 41050 - protein, 112 aa, Panicum virgatum
  misc_feature: Ceres CLONE 2006244
  misc_feature (12)..(106): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTSGDQ

SEQ ID NO: 41051 - DNA, 622 bp, Panicum virgatum
  misc_feature: Ceres CLONE 2006249
  misc_feature: Encodes the peptide sequence at SEQ ID NO. 41052
atcgtcggcaccttcgtcctcgtctacaccgtcttctccgccaccgacgccaagcgcagcgcgcgcgactcgcacgtgcccatcctggcgccgcttcccatcggcttcgccgtcttcctcgtgcacctcgccaccatcccaatcaccggcaccggcatcaaccccgcgcgcagcctcggcgcggccatcatctacaacaggtcacacgcatggaacgaccattggatcttctgggtgggccccttcatcggcgctgctcttgcggccatctaccacgtggtcatcatcagggccatccccttcaagagccgcgactgatgatatatgctgctgcggcctgcggctagctgctgctgctgtggccagtgtgtttcttgattgttgcattgcgccctcagctatatatatatatatatatatatatatatatatatatatatatatatatatatatatatatatatatatgcgcgcgtgatatgtgtgtattatatatatatactctctccatatatatataaaaaaacacgtgtgtgtgtgtgtgcacactagcacgtgtactacactatacatctccctcgtgacacagtgaaacatcttattttatactcctctctactct

SEQ ID NO: 41052 - protein, 105 aa, Panicum virgatum
  misc_feature: Ceres CLONE 2006249
  misc_feature (1)..(92): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
IVGTFVLVYTVFSATDAKRSARDSHVPILAPLPIGFAVFLVHLATIPITGTGINPARSLGAAIIYNRSHAWNDHWIFWVGPFIGAALAAIYHVVIIRAIPFKSRD

SEQ ID NO: 41053 - DNA, 619 bp, Panicum virgatum
  misc_feature: Ceres CLONE 2006254
  misc_feature: Encodes the peptide sequence at SEQ ID NO. 41054
gatactaaccgaccagtttcacgacagtcaagatgcagatcttcgtcaagaccctgacgggcaagaccatcacccttgaggtcgagtcctccgacaccatcgacaatgtcaagtccaagatccaggacaaggagggcattcccccggaccagcagcgcttgatcttcgccggcaagcagcttgaggacggccgcactctttccgactacaacatccagaaggagtcgactctccacttggtcctccgcctccgtggtggtatcatcgagccctccctcaaggcccttgcctccaagtacaactgcgacaagatgatctgccgcaagtgctacgcccgcctgcccccgagggctgtcaactgccgcaagaagaagtgcggtcacaccaaccagctccgccccaagaagaagctcaagtaaatcattcgcacaacggcgtctggcgagaacggggtcggtcgaggtggaacgaatgcgacgaatgcatgcgatggacagtcggctgaaaacactgttccttttgcacatggagttacatctgtgcttatcactcggctaaggaacttgatgatgggattggggcttgtagagtgaatacgattctacctttccttcttgcg

SEQ ID NO: 41054 - protein, 128 aa, Panicum virgatum
  misc_feature: Ceres CLONE 2006254
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRAVNCRKKKCGHTNQLRPKKKLK

SEQ ID NO: 41055 - DNA, 640 bp, Panicum virgatum
  misc_feature: Ceres CLONE 2006260
  misc_feature: Encodes the peptide sequence at SEQ ID NO. 41056
atcctcctcttcctctccctggctggttaattattcctcctttgcatgagagcaaaaatggatggcctcatccccttcgtcctcaaggctctgaagaagaagaagaagaaggccatgaagcactatcgctccctcttctccgaccacctggcgcacttcgacgtcacagaggccctgccccagggttccctcttcatgacgcctcagcaccccagggcgtcgagatggcttgatgatgaaggcgatggcaatggtgagccgtctgctgctgctgcagttccggcggccttggcgccatcagtggcgtgcgccaatagcagcagcacgccggcggctgctcagcatggagccgccgccgccgctcaccgctggccatgagcgggggctcaggtacggtgggagctgccaggagtttgggcttgcttgttcatggagatggttggttgcacagttggctggcaatccaatagacaagaaaggaagcaaagtgcgctgttttgttgcactaaatgtagatcaattgcgtgtctctagtttctggccttatctttaaccaatggtcgctgacctggactaatgttcatctggttgtatcttgaataagcatccttgaagcttaattcgaaagtatcatgttttg

SEQ ID NO: 41056 - protein, 106 aa, Panicum virgatum
  misc_feature: Ceres CLONE 2006260
  misc_feature: Functional homolog of the protein sequence given in SEQ ID NO 50452
  misc_feature: Useful for making plants with altered carbohydrate content
MDGLIPFVLKALKKKKKKAMKHYRSLFSDHLAHFDVTEALPQGSLFMTPQHPRASRWLDDEGDGNGEPSAAAAVPAALAPSVACANSSSTPAAAQHGAAAAAHRWP

SEQ ID NO: 41057 - DNA, 384 bp, Panicum virgatum
  misc_feature: Ceres CLONE 2006272
  misc_feature: Encodes the peptide sequence at SEQ ID NO. 41058
ggcggcggtggcattggtggaggaggcggcggcggcctcggtggagggggaggcgccgggggcggccttggtggcggtgccggaggaggcctcgggcacggcggcggcctgggacgcggcgttggtatgggcggaggcggaggcggcggcggcggcctcggcatcggaattggcgtcggcgtgggcgtcgggatgggcgcgggtgctggcggcggcgccggtgctggcgcgggcggcggcgggcgttgatgagccgtcgactgggaagaaggttgtgcatggctgcatgcctgcatgcaatgcggcctgcgtaacggacgccctctgcttcctttccttccaaacgctcgttacgacgtggttaaattaaattacagttgatct

SEQ ID NO: 41058 - protein, 82 aa, Panicum virgatum
  misc_feature: Ceres CLONE 2006272
  misc_feature: Functional homolog of the protein sequence given in SEQ ID NO 50702
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50198
  misc_feature: Useful for making plants with altered terpenoid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: Functional homolog of the protein sequence given in SEQ ID NO 51624
  misc_feature: Useful for making plants with modulated biomass
  misc_feature: The sequence is a functional homolog of SEQ ID NO 644 in the 10/666,642 US patent application
  misc_feature: The sequence is a functional homolog of SEQ ID NO 1232 in the 10/666,642 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
GGGGIGGGGGGGLGGGGGAGGGLGGGAGGGLGHGGGLGRGVGMGGGGGGGGGLGIGIGVGVGVGMGAGAGGGAGAGAGGGGR

SEQ ID NO: 41059 - DNA, 732 bp, Panicum virgatum
  misc_feature: Ceres CLONE 2006276
  misc_feature: Encodes the peptide sequence at SEQ ID NO. 41060
aagaagattggtccttaattaacccgtgatctcatccacctctagctagtagccccctccctggctccccaatccccatataaaaaaagtcccaccctccaaagcggctccaagccgccgtgatagcaatagagcccttttctcctcttctttccatcccaagtctcaacatcttcagttcatcaccaaacatcaacgcggccaccatatatatgggtcctcagcaagatcggcggcgttccatggcgaacggcacggcggcgaggaaggagacgaaggtggtgcacgtgcactaccgggagtgccagcgcaaccacgcggcggccatcggcgggtacgccgtggacgggtgccgggagttcatggcgtcgggcgcggagggcacggccgcggcgctcttgtgcgccgcctgcgggtgccaccgcagcttccacaggcgcgaggtggaggccgacatggactgctcctccaccacctccggctgaataatctcgatcgatctggtttgcagtacatgtgcgtgatcgagctagctgcagatggcctggtgaggtccgatcgatcatgggtggcaaaggcattgaaatgattggtaggtaggtgcatgcattatattcaaccgtatttggaatggacatgtatatttattttcttctctttttttttcttggtcttggatttgcagtgaaacttgtgtatgtgttgatcgttggtgtatggtgcttgtaactg

SEQ ID NO: 41060 - protein, 80 aa, Panicum virgatum
  misc_feature: Ceres CLONE 2006276
  misc_feature (13)..(72): Pfam Name: ZF-HD_dimer Pfam Description: ZF-HD protein dimerisation region
  misc_feature: Functional homolog of the protein sequence given in SEQ ID NO 50409
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 50410
  misc_feature: Useful for making plants with modulated low light sensitivity
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
MANGTAARKETKVVHVHYRECQRNHAAAIGGYAVDGCREFMASGAEGTAAALLCAACGCHRSFHRREVEADMDCSSTTSG

SEQ ID NO: 41061 - DNA, 521 bp, Panicum virgatum
  misc_feature: Ceres CLONE 2006280
  misc_feature: Encodes the peptide sequence at SEQ ID NO. 41062
aaagcgagcgaccgaggaagccatagttagacgcctgtcgtcgccaatcttgagccacagaagcagaggttggggatcgaagaaggagaataagatgcaggactgggcgcccgtgttcgtctcgttagtgctcttcatcctgctctcgccggggctgatcttccagatgcccgccaagtcgcgcctcatcgccctgggcaacttccagaccagcgtcgcctccatcatcgtccacaccatcctcttcttcgccctggacgccatcttcctcgtcgccatcggcgtccagatccagctcggcaactaggcaggggcaaagctacctctgatgatccatggtcgaccaacaaccagatgatcatatcggtcgatcgttcgaggtgcacgcatggcttcgcctctagcgtcgttcctctgattaccggttcggtgtagtacgtgtaaatatggagcgtgcatagatttatgctgcctttggatcaactcaatttgctgctttaatttcaaggtcttatttgtgt

SEQ ID NO: 41062 - protein, 70 aa, Panicum virgatum
  misc_feature: Ceres CLONE 2006280
  misc_feature: Functional homolog of the protein sequence given in SEQ ID NO 50117
  misc_feature: Useful for making plants with altered cell wall content and/or composition
MQDWAPVFVSLVLFILLSPGLIFQMPAKSRLIALGNFQTSVASIIVHTILFFALDAIFLVAIGVQIQLGN

SEQ ID NO: 41063 - DNA, 588 bp, Panicum virgatum
  misc_feature: Ceres CLONE 2006282
  misc_feature: Encodes the peptide sequence at SEQ ID NO. 41064
aaccatcttcgtagcaactaacatttgcacagactcactgacagtctgacacgatggtcgccggcagcatcaccgagcaggtggcggtggccataccggccgagaagatgtggaaggcggcctttgcgaccagcgatgagtccgccttgtgcaaggtgttgggtggcttgatcgacgcagcgaaggtggagggtgacggcgggcctgggagccgcatcaccatgaagttcaacccagccgtgggctcaaatatggtgctcaagggccgcttggcgtcgcgcgacaacgcgacgcgcgtgattacttgggaccaggtggcagtagagggcggcgaggtggcaccagcgcagttcaagtctcaggcggtccagatgaaggtggagccggccggcgccggccgctgcgtgaccaaggtcgccgtggattacgagcgcctcgacggcacgccgctgtcgccggcggaccaggccaagctcatcaagggctatgtaggcatggtcaagaaggccgaggagaacatcgtcgcgcgccccggcgtgttcgcctgagctgatctcaagcacatattatccgcccacgccgttatat

SEQ ID NO: 41064 - protein, 164 aa, Panicum virgatum
  misc_feature: Ceres CLONE 2006282
  misc_feature (1)..(159): Pfam Name: Bet_v_I Pfam Description: Pathogenesis-related protein Bet v I family
MVAGSITEQVAVAIPAEKMWKAAFATSDESALCKVLGGLIDAAKVEGDGGPGSRITMKFNPAVGSNMVLKGRLASRDNATRVITWDQVAVEGGEVAPAQFKSQAVQMKVEPAGAGRCVTKVAVDYERLDGTPLSPADQAKLIKGYVGMVKKAEENIVARPGVFA

SEQ ID NO: 41065 - DNA, 703 bp, Panicum virgatum
  misc_feature: Ceres CLONE 2006287
  misc_feature: Encodes the peptide sequence at SEQ ID NO. 41066
actcgacccagcccactcaacacgtagcatatcaatggctgcctactcctcggtcgtcttcctcctcctcgccgccttcgtggccggtgctagcgcggccacgttcaccatcaccaacaggtgcagcttcacggtgtggccggcggcgacccccgtgggcgggggcgcgcagctcaacccgggtggggcctggaccatcaccgtgcccgccggcacccagtccggcagggtgtggggccgcacggggtgctccttcagcggcgggagggggcggtgcgcgaccggcgactgcggcggcgccttctcctgcaccctctccgggcagcctccgatgacgctggccgagttcaccatcggcggcgccatggactcgtacgacatctcggtgatcgacggcttcaacgtcggcatggccttctcctgcagcaccggcgtgggcctggtgtgccgggacgccggctgccccgacgcgtaccaccagcccccggacaggaagacccacacctgcgccgccaacagcaactaccaggtcaccttctgcccgtgatagatgaggcacaggcagcaacacctcctatagtcgaacaataaaccatgctcgctagctttgccatgcatgcacgatcgaagctaggcatgaacaaccccaaccatccaataatccaagggcgcacgcttgtgtacttatcttattataaacaat

SEQ ID NO: 41066 - protein, 170 aa, Panicum virgatum
  misc_feature: Ceres CLONE 2006287
  misc_feature (28)..(170): Pfam Name: Thaumatin Pfam Description: Thaumatin family
MAAYSSVVFLLLAAFVAGASAATFTITNRCSFTVWPAATPVGGGAQLNPGGAWTITVPAGTQSGRVWGRTGCSFSGGRGRCATGDCGGAFSCTLSGQPPMTLAEFTIGGAMDSYDISVIDGFNVGMAFSCSTGVGLVCRDAGCPDAYHQPPDRKTHTCAANSNYQVTFCP

SEQ ID NO: 41067 - DNA, 559 bp, Panicum virgatum
  misc_feature: Ceres CLONE 2006317
  misc_feature: Encodes the peptide sequence at SEQ ID NO. 41068
agcagcggaagaagaaggccgccgccgcctccaagagggagagggaaaaggaggcggaggcggaggcggatgaggtcaccgtggagctccgcacggtggggttcggcaaggaggtggtgctcaagcagcggcggcggatgcgccggaggaggcgcctcggcgaggaggagcgcgcggccatcctgctcatggccctctcctccggcgtcgtgtacgcctgacaccccgccgccgccacctcctagcagccaaggcaccaaaggcgatgagaggaagagagcggctgcagctgcagctgcagctgcagatttgcttaacatgcagcatgatcttagcccaagagagatgcgtctctctctaccccttttcccccttgatctatgctaagttttcccggctaagtagttgttggaaccaaagcgagttaataatcgtgtcgcgctctagactagtagctgttcttccttgttactgttgctgttcttgcctagttgcaatgttactggtagtagtgtggtagtatcttgtaaccttgcaatgtaaggagagcttattgatc

SEQ ID NO: 41068 - protein, 72 aa, Panicum virgatum
  misc_feature: Ceres CLONE 2006317
  misc_feature: The sequence is a functional homolog of SEQ ID NO 1054 in the 10/666,642 US patent application
  misc_feature: Functional homolog of the protein sequence given in SEQ ID NO 51296
  misc_feature: Useful for making plants with altered terpenoid content
QRKKKAAAASKREREKEAEAEADEVTVELRTVGFGKEVVLKQRRRMRRRRRLGEEERAAILLMALSSGVVYA

SEQ ID NO: 41069 - DNA, 841 bp, Panicum virgatum
  misc_feature: Ceres CLONE 2006333
  misc_feature: Encodes the peptide sequence at SEQ ID NO. 41070
gctgccattgccgggtcgagacctccgagacgaggttggccgccgcctgctcccggccgctccctctgcgtatctccatgggccaaggacagagtcagcccgcccctccggctgaggagcctactccgcccgccgcggagccgtcctcgccgtctcctgccccggcgtcctcctccctcgaggcgctcgccgcagaggctatgtcgtttgatgagggtgatactgaggagtcaattgatgagaaggtacaaaaagctctggagtgtccatgtgttgctgatttgaaaaatggtccttgtggaggcccatttgtcgatgcattttcctgcttccttaggagcaaagaagaagagaagggatcagattgtgtgaacccctttatcgcactacaggactgcatcaaagcaaatccagaggcattttctaaggagattttggaggaagaggagaatgatgaggaagcagagaattccagcctgaaagttagagccccagcatggtctagagaacccaaacccaaggcttgagattccatggcattaactgatgatacgaagattcatccagttcacagacttcacattatttctctgatatgttcttcagtagacagcagtagattgatttcagagctcaaagagccaaagaggcatccgaaatccatcccttgaaatacgcatactttgtgtggtaaaaatgccctgcagtatctttttttttatagaatatacacgttatttcgactgggaccaacaaacttgtaatctaaataactgggagttgggctttgaagtgccatgggaggagccatactagtactagcaagtaaaatttcgtgacg

SEQ ID NO: 41070 - protein, 149 aa, Panicum virgatum
  misc_feature: Ceres CLONE 2006333
  misc_feature (67)..(110): Pfam Name: CHCH Pfam Description: CHCH domain
MGQGQSQPAPPAEEPTPPAAEPSSPSPAPASSSLEALAAEAMSFDEGDTEESIDEKVQKALECPCVADLKNGPCGGPFVDAFSCFLRSKEEEKGSDCVNPFIALQDCIKANPEAFSKEILEEEENDEEAENSSLKVRAPAWSREPKPKA

SEQ ID NO: 41071 - DNA, 670 bp, Panicum virgatum
  misc_feature: Ceres CLONE 2006341
  misc_feature: Encodes the peptide sequence at SEQ ID NO. 41072
ggtggaggcagttgggacagagataaagtccaaagggctcttcgtgctgcttacaacaacccggaacgtgctgttgaatacctgtactctggtattccagtaacagctgaagttgctgttccagttggtgctctaggaggaaacacaactgatcaacctcttacaggggaagccaatctcgctggaattccaaacagtgctccattaaatctttttccacaggggggttccaatgctggaggtgggccacttgagtttcttagaaacaaccaacagtttcaagcacttagggaaatggtccaaacaaatccacaaatcttgcagcctatgctccaggaattgagcaagcagaatcctcaaattctaaggttgattcaggagaatcatgctgagttccttcagttaataaatgagccctttgaagatggcgagggggacttcttagaacaacctgagcaggatgaaatgcctcttgctatcaatgttacaccagaggagcaggaggccattggacggcttgaatccatggggtttgagagagcacgtgtcattgaggcattctttgcctgcgacaggaatgaggagctagctgcaaactatcttcttgagcatgctggtgaggaagattgagcgggaatagtttgcactcggtgagaactcggccatcctc

SEQ ID NO: 41072 - protein, 209 aa, Panicum virgatum
  misc_feature: Ceres CLONE 2006341
  misc_feature (84)..(142): Pfam Name: XPC-binding Pfam Description: XPC-binding domain
  misc_feature (165)..(201): Pfam Name: UBA Pfam Description: UBA/TS-N domain
GGGSWDRDKVQRALRAAYNNPERAVEYLYSGIPVTAEVAVPVGALGGNTTDQPLTGEANLAGIPNSAPLNLFPQGGSNAGGGPLEFLRNNQQFQALREMVQTNPQILQPMLQELSKQNPQILRLIQENHAEFLQLINEPFEDGEGDFLEQPEQDEMPLAINVTPEEQEAIGRLESMGFERARVIEAFFACDRNEELAANYLLEHAGEED

SEQ ID NO: 41073 - DNA, 764 bp, Panicum virgatum
  misc_feature: Ceres CLONE 2006371
  misc_feature: Encodes the peptide sequence at SEQ ID NO. 41074
atacaagcaattgattccgtcttttctgtttcttgatacccccaaaccgctcacaatggctcccaagatcgctatcgtctactactccatgtacggccatgtcaagacattggcagaggctgagctcaagggtatccgcgaggctggtggtgatgccaccctcttccaggtccccgagaccctgtcccaggacgtcctcgacaagatgtacgctcctcccaagcccaccgacatccccaccctgaacgaccccgccgagcttgaggctttcgacggtgtcctcttcggtatccccacccgttacggcaacttccccgcccagttcaagaccttctgggacaagaccggcaagcagtggcagcagggctccttctggggcaagtacgctggcatgttcatcagcaccggtaccctcggtggtggccaggagtccaccgctatcgccgccatgtcgactctcgtccaccacggcttcatctacgttcccctgggttacaagactgcctttgcccagctcgccaaccttgaggagatccacggtggctccccctggggtgccggaactttctctgccggcgatggcagccgccagcccaccgctcttgagctgagcattgccgttgagcagggcaaggctttctacgccgctgttgccaaggctcaccaatgactagatggcacctcatcgacgggggtcaagcaggaccaagcggttcctgcagcggcagcgtatagcacaacgcccaacacaactacaacaccag

SEQ ID NO: 41074 - protein, 204 aa, Panicum virgatum
  misc_feature: Ceres CLONE 2006371
  misc_feature (7)..(139): Pfam Name: Flavodoxin_1 Pfam Description: Flavodoxin
MAPKIAIVYYSMYGHVKTLAEAELKGIREAGGDATLFQVPETLSQDVLDKMYAPPKPTDIPTLNDPAELEAFDGVLFGIPTRYGNFPAQFKTFWDKTGKQWQQGSFWGKYAGMFISTGTLGGGQESTAIAAMSTLVHHGFIYVPLGYKTAFAQLANLEEIHGGSPWGAGTFSAGDGSRQPTALELSIAVEQGKAFYAAVAKAHQ

SEQ ID NO: 41075 - DNA, 653 bp, Panicum virgatum
  misc_feature: Ceres CLONE 2006377
  misc_feature: Encodes the peptide sequence at SEQ ID NO. 41076
gtcaccagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccacctccgaggccgccgtgacctgcgggcaggtgagctcggccatcggcccctgcatcgcctacgcccgcggcaccggctccggcccttcggcagcctgctgcagcggcgtgaggagcctcaactcggcggccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaattggttggagcctgcatgctgccaagcacatccaccgatatatctagctatcgtctatatatgatcgatcgagttcttgctagctcgctgatgaataaaatctctccgccgtcgctcatcatgtgagagacacggccggatcggatgtgtcagtccctgctacgttttgtacgtgtctgctgcatgtacacctccatttccgttccagagtctgtaccttgtccactacctttt

SEQ ID NO: 41076 - protein, 138 aa, Panicum virgatum
  misc_feature: Ceres CLONE 2006377
  misc_feature (31)..(116): Pfam Name: Tryp_alpha_amyl Pfam Description: Protease inhibitor/seed storage/LTP family
MARAQQVVAIAVVAAVVLLAAAATSEAAVTCGQVSSAIGPCIAYARGTGSGPSAACCSGVRSLNSAARSTADRRAACNCLKSAAGRVSGLNAGNAASIPSKCGVSIPYTISPSVDCSNWLEPACCQAHPPIYLAIVYI

SEQ ID NO: 41077 - DNA, 523 bp, Panicum virgatum
  misc_feature: Ceres CLONE 2006395
  misc_feature: Encodes the peptide sequence at SEQ ID NO. 41078
atccgcaaacgcaagcttcacggcttcacgcacagcctctctccccgcagcttctccgccgggcttcacctgcgaacccgcctcgatcgatcagcgttccacgcggagcaggcagatggccgccacgatgaagctccggatcctcgccatcgccgtcgccgccgcgtcgtgcctggtcgcgaccgccgccgcggccgagggcccggcgcccgccccgacgtccggcgcgccttccatggccgcgccggccgttgccgccgcgtccctgaccgcgctcgtcttcggctacctcttctaagaagtgccgtggacggcgttgcctgtagtgccaaatcgttttcctgctcagagatttcttcttctcgttgctgtctttgctcttgttggtgtggatgatgggtatgtaattaagtgttcttttttttatatgaatcttgtaatctcagtacaagggcatagtaaatagagagagctgcagtttggttcttttttttacacaatggtgacaaaagccgaccggacc

SEQ ID NO: 41078 - protein, 60 aa, Panicum virgatum; identical to SEQ ID NO: 34461
  misc_feature: Ceres CLONE 2006395
  misc_feature: Functional homolog of the protein sequence given in SEQ ID NO 50452
  misc_feature: Useful for making plants with altered carbohydrate content
  misc_feature: Functional homolog of the protein sequence given in SEQ ID NO 50546
  misc_feature: Useful for making plants with altered cell wall content and/or composition

SEQ ID NO: 41079 - DNA, 510 bp, Panicum virgatum
  misc_feature: Ceres CLONE 2006404
  misc_feature: Encodes the peptide sequence at SEQ ID NO. 41080
acggcggctacccctttctgtctcaggctctcagcaagcaaggttagggtttctgctcaaaaaaaaaaagcaaggttagggtttggtggttggacggagaagcctgtagtagatccttcgttagggagtcgccatgagccggtcggggcagcctccggatcttaagaagtacatggacaagaagctccaaatcaagctgaacgcaaaccgtgttgtcattggcactctgcgtggatttgatcagttcatgaatctggtcgtggacaacacagtggaggtcaatggaaacgacaagaatgacattgggatggtggttatcagggggaatagtgttgtcatgatcgaaacccttgaaccggttgccaaagctcagtgaactgtcagcctgttttagtagttaataagctggtagtgttaaattgaaactgatgtatgccatggggcaccgatgtatcctgagttcctgaatcctgacccttattcatgtgcaagctttaagcacctttgtat

SEQ ID NO: 41080 - protein, 80 aa, Panicum virgatum; identical to SEQ ID NO: 10301
  misc_feature: Ceres CLONE 2006404
  misc_feature (8)..(72): Pfam Name: LSM Pfam Description: LSM domain

SEQ ID NO: 41081 - DNA, 573 bp, Panicum virgatum
  misc_feature: Ceres CLONE 2006425
  misc_feature: Encodes the peptide sequence at SEQ ID NO. 41082
taacagttttgctccttctctcaacctaaagtaccgaaaatggaagctgtacagacattcggccgtaagaaaaccgccactgctgttgctcactgcaagcgtggtcatggtctcatccgtatcaacggttcccccatcgaactcctcgaacccgagatcttgaagttcaaggtctacgaagttatccttctcttgggtgaggagcgtttcgccaacactgatatcagaattcgtgttaacggtggtggtcacacttctcaagtttatgctatccgtcaagctcttgctaaggctatcgtcgctttctaccaaaagttcgtcgatgaggctgccaagaaggaaatcaaggagatcctcgttcaatatgaccgtaccctcctcgttgctgatccccgtcgttgtgaacccaagaagttcggtggtcccggtgctcgtgcccgtttccaaaagtcttaccgttaaagaaattgtgtattctcttttttcaaagagtatattgttggcctcaagctacatttttttgacataatttggtagatttcttttattgttccaaataaaattaaagcatat

SEQ ID NO: 41082 - protein, 140 aa, Panicum virgatum
  misc_feature: Ceres CLONE 2006425
  misc_feature (8)..(140): Pfam Name: Ribosomal_S9 Pfam Description: Ribosomal protein S9/S16
MEAVQTFGRKKTATAVAHCKRGHGLIRINGSPIELLEPEILKFKVYEVILLLGEERFANTDIRIRVNGGGHTSQVYAIRQALAKAIVAFYQKFVDEAAKKEIKEILVQYDRTLLVADPRRCEPKKFGGPGARARFQKSYR

SEQ ID NO: 41083 - DNA, 738 bp, Panicum virgatum
  misc_feature: Ceres CLONE 2006428
  misc_feature: Encodes the peptide sequence at SEQ ID NO. 41084
gatcctccctccgacttcttttcttcaattgttcttaaattttattcctctctctctctcgtcttcctccaacatacacaaaaccaacaaaacccccccaaccacagaaatcatgtcgcagtatcctccccaaggtggctaccctccccagggttacccgcccccccagggctatgcgcctcagccctacccgccccagggctatcctccccaaggttatccgccgccccagcccatgcaatatcatgaggcgcccccggccaaggaggagaagagccacggctgcctctacacttgtatcgccgccatgtgctgctgctggctctgcggcgagacctgcgagtgctgcctggagtgtttggactgctgctgctaaaagagcaaatcaacccatgcagcctaacgacacatgaatcctgctttaatgcgcccgtccgagccgacaaaccgacaatggtctgtgagcaggggatctgagcttggcggtttcggaagggtaggcggactgacaactatcggggaggacggcggacatctggagcgggagggaaaggacggggcggtgttacgggattacaccggggaatgaggattgacttttttttttttttttttttgctactgcctaccaccgactcacgtctgccgaccgcgacgggttttcttttgggtttctcgatgctcgatttagttgtccgtttttttattaatacccgacagcccggcggtcttccttgc

SEQ ID NO: 41084 - protein, 87 aa, Panicum virgatum
  misc_feature: Ceres CLONE 2006428
  misc_feature: Functional homolog of the protein sequence given in SEQ ID NO 50362
  misc_feature: Useful for making plants with altered cell wall content and/or composition
  misc_feature: Functional homolog of the protein sequence given in SEQ ID NO 50152
  misc_feature: Useful for making plants with altered carbohydrate content
MSQYPPQGGYPPQGYPPPQGYAPQPYPPQGYPPQGYPPPQPMQYHEAPPAKEEKSHGCLYTCIAAMCCCWLCGETCECCLECLDCCC

SEQ ID NO: 41085 - DNA, 671 bp, Panicum virgatum
  misc_feature: Ceres CLONE 2006431
  misc_feature: Encodes the peptide sequence at SEQ ID NO. 41086
atctcctccctctgtttctttctttctccaacctttcccttctctcggactctctcctcccttgctcttccttccctgacagcgacgactgggcgagcggcggcgccatttatcacggtcttcgcccagccctttgccggcgacgagcatccaccagatattactctgaatgatggcaactctgaaagatgctgctgcaaggaagcctgtactggcaacaatccgtcttattgttccagctggtgctgcccgtcctgcacctccagttggtccagcgctgggtttctaccggctcaatttgatggctttctgcaaggatttcaatgccaggacccagaagtacaaggcagacactccaatgcaagtcaccttaactgcttacaaggatagcaccttcgagttcgtggtcaagtcacccccagtatcatggttcctcaagaaggctgcaggaatagaaacagccagcagtcgcccaggccacagcaatgtgtcatccctcactctccgccatgtgtatgagattgcaaaattgaagcaggctgaccccttctgcaagcacatgtcgcttgaggcgctgtgcaagtccatcattgacagctaactccatgggcattgagattgttaaagatctatgagaagcttagtcaggaagaattccgtgattaatcttc

SEQ ID NO: 41086 - protein, 142 aa, Panicum virgatum
  misc_feature: Ceres CLONE 2006431
  misc_feature (16)..(75): Pfam Name: Ribosomal_L11_N Pfam Description: Ribosomal protein L11, N-terminal domain
  misc_feature (80)..(142): Pfam Name: Ribosomal_L11 Pfam Description: Ribosomal protein L11, RNA binding domain
MATLKDAAARKPVLATIRLIVPAGAARPAPPVGPALGFYRLNLMAFCKDFNARTQKYKADTPMQVTLTAYKDSTFEFVVKSPPVSWFLKKAAGIETASSRPGHSNVSSLTLRHVYEIAKLKQADPFCKHMSLEALCKSIIDS

SEQ ID NO: 41087 - DNA, 722 bp, Panicum virgatum
  misc_feature: Ceres CLONE 2006437
  misc_feature: Encodes the peptide sequence at SEQ ID NO. 41088
acgctgctagctacgcatagcacagcagggacgacgagcgacctgcccggcggccgttcgccgccgccgtagcggaataaagagagcgcacgcacaccaaccgcctccgccgccgtctcctcccgtcgcccacgtagacgtccttatctgcgccgccgtgctccgctccgcctccgcggccgctgcgacgtacgcccgatcgacgacgacacagctagtagcaatggcggcggcgtccaagggcttcctcctgctcgctctcctcgcggcggccgccgtgctcgccaccgccgcggcggagcaacgaacccatgacagaaaggagaagatggcgaacggcgccgccggcgtggagcactggcacggcggtggcggcggccacggcggcgggtcaggtgatgagcacagccacggctgcgagtacggctgctgccgccgcgtataccacggcggctgcaagaagtgctgcccgcctcccggcggccggccggaggtggggaactagcaagacctcgtcctacgctgagcaggatcggagatcgatgcccggcgaggtgttcttcaagttcatactcgttacgtacccaacacgggtgtagcttagtattagcttggttgtgcgtggtagcatccttacgagtgaataacgtgcgacgtgcacgtacggataggcccgtacgtgtatggacgtacgcacacatgtacgtcttcctctcctttct

SEQ ID NO: 41088 - protein, 93 aa, Panicum virgatum
  misc_feature: Ceres CLONE 2006437
  misc_feature (1)..(78): Pfam Name: GRP Pfam Description: Glycine rich protein family
MAAASKGFLLLALLAAAAVLATAAAEQRTHDRKEKMANGAAGVEHWHGGGGGHGGGSGDEHSHGCEYGCCRRVYHGGCKKCCPPPGGRPEVGN

SEQ ID NO: 41089 - DNA, 724 bp, Panicum virgatum
  misc_feature: Ceres CLONE 2006440
  misc_feature: Encodes the peptide sequence at SEQ ID NO. 41090
tggaacacttaacaagtggcacttggatgacaaaattggtgcttatttcgactatggtaaccatactgaaaaggtccgactgagatggtatgatgtccaagacaaggatactctgagacgagagctcttgcgagaaacattacaaccccctcagctgcaattagtaccccatattggttatgtcagcctcttcccattcatgatgggagctattccacctgaatcatgggttcttgagaaacagcttgatctaatatccaatacctctatattgtggacagattatggtcttcggtcactttctagaacaagttcaatatatatgaagcgcaatacggagcatgatcccccatattggagaggtgccatttggataaacatgaactacatgattctttcagcactacatcattattcacatgaggatggcccatacaagggcagggcaggagaattatatgacaagctaagatcaaatcttatccggaatatcgtgaaaaattaccatgaaactggtttcttctgggaaaactttgaccaaaagaacaaaggaaagggaaagggtgcacggtcatttactggatggacttcacttcttgttttgatcatggcagagtcctacccgacgttgcataggtgagatatacatggctaacaaccacagaagaagataaccgtggcaattcgaatggaggggctggcaactggccattgttttagctcg

SEQ ID NO: 41090 - protein, 212 aa, Panicum virgatum
  misc_feature: Ceres CLONE 2006440
  misc_feature (1)..(207): Pfam Name: Glyco_hydro_63 Pfam Description: Mannosyl oligosaccharide glucosidase
  misc_feature: SWISSPROT Homolog: EC 3.2.1.106 Mannosyl-oligosaccharide glucosidase
GTLNKWHLDDKIGAYFDYGNHTEKVRLRWYDVQDKDTLRRELLRETLQPPQLQLVPHIGYVSLFPFMMGAIPPESWVLEKQLDLISNTSILWTDYGLRSLSRTSSIYMKRNTEHDPPYWRGAIWINMNYMILSALHHYSHEDGPYKGRAGELYDKLRSNLIRNIVKNYHETGFFWENFDQKNKGKGKGARSFTGWTSLLVLIMAESYPTLHR

SEQ ID NO: 41091 - DNA, 709 bp, Panicum virgatum
  misc_feature: Ceres CLONE 2006441
  misc_feature: Encodes the peptide sequence at SEQ ID NO. 41092
gataatgttgtaggaagtgccaagtccttcttaaaggctagaggcctgaaaggtgctgatgttttatatgatcctgttggggggaagcttactcaagatagcctgaaacttctcaattggggtgcgcacattctggtcattggatttgccagtggtgatgtaccagttattcgagcgaatattgctcttgttaagaactggacaattcatggtctgtactggggaagctacttaactcatgagccacgagtgcttattgactccctcaatgaactcttgttatggctctcaaagggtctgataacagttcaaatttcacaccgctacaggcttgctgaggcccatctcgcttttgctgccctaagagataggaaggcagttggcaaggtcatgattgtaatgggctcgtcagcaaaatcaaggctctgatatccttccgaaatgcttctgtacaacatgagacatctattgtgcatctcttatatgaattgtaagacacaggattatctgagactgtagtagtttccctgtccaaaatgtttgtgaacaaaatcgacaaaagcaatcctagaaataaacagtttatctgcagatacatctgatgggaaatacctatatgatgccagtgttgtgagtagtggcaggtaaaatgaatacaatctgaataatcagcatctaggttacagctggagaggaaagtacacatttt

SEQ ID NO: 41092 - protein, 142 aa, Panicum virgatum
  misc_feature: Ceres CLONE 2006441
  misc_feature: SWISSPROT Homolog: EC 1.6.5.5 NADPH:quinone reductase
DNVVGSAKSFLKARGLKGADVLYDPVGGKLTQDSLKLLNWGAHILVIGFASGDVPVIRANIALVKNWTIHGLYWGSYLTHEPRVLIDSLNELLLWLSKGLITVQISHRYRLAEAHLAFAALRDRKAVGKVMIVMGSSAKSRL

SEQ ID NO: 41093 - DNA, 677 bp, Panicum virgatum
  misc_feature: Ceres CLONE 2006463
  misc_feature: Encodes the peptide sequence at SEQ ID NO. 41094
aacaacacatcaactcaagaaaagtcgatcgacccccgtgcgatacagagctaggctttgcgcacgtcgacgtagccaagctttttgagtccacgaggagaggcggcaggtcaagcgggcaagaagctttggatcggaggtcagcagcggggcgcatggccatggaggtccagggctccaggcggcaccaggacgccggcgtgaaggtcaagttcatcgaaacgcagttcatcagctccgacgccgccagcttcaaggccgtcgtgcagcgcctcaccggcaagtcccccgccgactcgtcgaggccggcccaggcgttactggcgccgcagccgcagaggccgcgcccgtgccggccggccttcgctggggcggggcagcaccatcaggccgccgggtggccggagcagcaccaagctggcgcctacctggtcgcgccggcaccgaagcaggcgccgctcgcggcggcgccgagcctggaggagatgcaagagctctgcgacttcgccgacctgttctacaccaccagcggcgccacgggcgcgcggcgcgacattgccggcatcgccttcccttactgaatttgtttttccgagcaccaatgcttgtagtttgcctttgcaaattcgcagtgtgttgagcacattaatggtcgtcgaggagctagatgcgacgag

SEQ ID NO: 41094 - protein, 141 aa, Panicum virgatum
  misc_feature: Ceres CLONE 2006463
  misc_feature (19)..(49): Pfam Name: VQ Pfam Description: VQ motif
MAMEVQGSRRHQDAGVKVKFIETQFISSDAASFKAVVQRLTGKSPADSSRPAQALLAPQPQRPRPCRPAFAGAGQHHQAAGWPEQHQAGAYLVAPAPKQAPLAAAPSLEEMQELCDFADLFYTTSGATGARRDIAGIAFPY

SEQ ID NO: 41095 - DNA, 640 bp, Panicum virgatum
  misc_feature: Ceres CLONE 2006467
  misc_feature: Encodes the peptide sequence at SEQ ID NO. 41096
aaatattaaatctttgattaatacaaacacacaagatgcctcactcttacggatacaaagccagaactagatccaagttctccaaggccttcagaagacacggttccgtcagaatctccaacgtcctcacctcctacagagttggtgactacgtcgatatcgtcgccgatggtgccatccacaagggtatgccccacaacctctatcacggaaagaccggtagagttttcaacgtcaatcaaagatcagtcggtgtcatcgtcaacaagcaacacagacaaagaatcatccccaagagaatccacgtcagatgtgaccacgtcagaatctccacctccagagaaggattcttgaagagatgcaaagaaaacgacaagttgaagactgaagccaacaaatctaacaagagaatctccaccaagagacaacccgtcgctcccagagaagctcactccgtcaagggtaacgtcagattccaacaccctcaagctttcagagaattctggtaagaattttgctcaagagttattggtgcggacatatggagatctataaagtacatagaagctttatgtttgtatagtgatcattgcattgcttatatatcatccccaaaccaaaaaacttaatacccctagtc

SEQ ID NO: 41096 - protein, 157 aa, Panicum virgatum
  misc_feature: Ceres CLONE 2006467
  misc_feature (2)..(100): Pfam Name: Ribosomal_L21e Pfam Description: Ribosomal protein L21e
  misc_feature: Functional homolog of the protein sequence given in SEQ ID NO 50444
  misc_feature: Useful for making plants with modulated flowering time
MPHSYGYKARTRSKFSKAFRRHGSVRISNVLTSYRVGDYVDIVADGAIHKGMPHNLYHGKTGRVFNVNQRSVGVIVNKQHRQRIIPKRIHVRCDHVRISTSREGFLKRCKENDKLKTEANKSNKRISTKRQPVAPREAHSVKGNVRFQHPQAFREFW

SEQ ID NO: 41097 - DNA, 568 bp, Panicum virgatum
  misc_feature: Ceres CLONE 2006482
  misc_feature: Encodes the peptide sequence at SEQ ID NO. 41098
ggtccatgaattccgtgttggagacaagtcgcatcccctctcagatcaaatttacatgaagcttgaggaattgggcatggaaatgaaggctatgggttataaacctactactgaggtggtgatgtttgacattgaagacgaagagaaggagcatacgctagtgcatcacagcgaaaagatagccattgcatttagccttcttactactaagccaggcgagaccataagggtcaccaaaaacctccgggtttgcagtgactgtcacactgccatcaaactcatctcgaggataaccaatcgtgaaattattgttcgagataataatcgatttcattgcttcagagatggtcattgctcttgtaatgactactggtagtatacagacaacttcctgatgcagttttgagcagcagggaaagttgaaagcatcattgtcattttgatgtaaaactgtagtcaggctagagttgtaattggagcataggagaggtagactataaggcaggctaacactgcaatgttatattttttcctccccgttctattgttttctcctgagaggaatcga

SEQ ID NO: 41098 - protein, 124 aa, Panicum virgatum
  misc_feature: Ceres CLONE 2006482
  misc_feature: Functional homolog of the protein sequence given in SEQ ID NO 51514
  misc_feature: Useful for making plants with altered cell wall content and/or composition
VHEFRVGDKSHPLSDQIYMKLEELGMEMKAMGYKPTTEVVMFDIEDEEKEHTLVHHSEKIAIAFSLLTTKPGETIRVTKNLRVCSDCHTAIKLISRITNREIIVRDNNRFHCFRDGHCSCNDYW

SEQ ID NO: 41099 - DNA, 593 bp, Panicum virgatum
  misc_feature: Ceres CLONE 2006484
  misc_feature: Encodes the peptide sequence at SEQ ID NO. 41100
atcgcacattatctagtatctgctcctgacaaagcctcgtcatagtttgtgagtttgtggtgtgtaccgtctccgatggcgactgagaggctgaagggtacggtgaagtcgttcgacgagccggatgggttcgggatagttaactccgttcacgatggcgccaaggactacgtggtgcgccgctcggacatcaagacggagggctttggcatagtctctgcgggccagcgcgtggagttcacgccggggaccggggacgacggcaagcacattgcccttgatgtcaccgtcctcgatggcgcaccggccggtaccggcggcagtgaagctccagagagtgcaagtaagcagtgatggactgatggtactggttgtctgtgatgtcatctacacgctatgctcttactattgtagtattactgtgtgatggtgtatgttcggtcttatgtcatgttacatatgtacgtatgtcacaggagatggtatgatcttgtgctgtttgaataagaatctcattacgagactttagtcatttaaggaacatgtctacgtactgtctacctaagtatatatagtatcgtccatttagacgg

SEQ ID NO: 41100 - protein, 92 aa, Panicum virgatum
  misc_feature: Ceres CLONE 2006484
  misc_feature (5)..(73): Pfam Name: CSD Pfam Description: 'Cold-shock' DNA-binding domain
MATERLKGTVKSFDEPDGFGIVNSVHDGAKDYVVRRSDIKTEGFGIVSAGQRVEFTPGTGDDGKHIALDVTVLDGAPAGTGGSEAPESASKQ

SEQ ID NO: 41101 - DNA, 672 bp, Panicum virgatum
  misc_feature: Ceres CLONE 2006500
  misc_feature: Encodes the peptide sequence at SEQ ID NO. 41102
agcactccccgccgccacctccgctcaggcttcctcgaggcgaaaccctagcgcccgacctcctctccgctccaccccactcagccatggcggcggtggacgtggcgtacgcgccgccgatgaagtccggcaaggcggggttcgaggggacgctggagccgcagcacaggatccgcatcaccctctcctccaggaacgtcaagaacctcgagaaagtctgcggcgatctggtgaagggtgccaagggtaagcagctgaggttgaagggacctgtccggatgcccaccaaggtgctccacatcaccaccaggaagtctccctgtggcgaaggcaccaacacctgggatcgttttgagatgaggattcacaagagggtgattgatctcgtcagcacaccagatgtggtcaagcagatcacctcaatcaccatcgagcctggtgtggaggtcgaggtgacaatcagcgacgtgtaatgtggtagcccagcatcgtatcatttcaaaatgattggaaatgcaactgaacaggatgttttgagagtttctagtgtgagaaaactcattgtagcagaggaattccctcctaatcgttagtttagtcacatcagaattgatgagcccatcgagcttttgtggcatgctagtctgtcagtgggtggtatggcatgagtgg

SEQ ID NO: 41102 - protein, 128 aa, Panicum virgatum
  misc_feature: Ceres CLONE 2006500
  misc_feature (28)..(123): Pfam Name: Ribosomal_S10 Pfam Description: Ribosomal protein S10p/S20e
  misc_feature: Functional homolog of the protein sequence given in SEQ ID NO 50533
  misc_feature: Useful for making plants with modulated phosphate use efficiency
  misc_feature: Functional homolog of the protein sequence given in SEQ ID NO 50532
  misc_feature: Useful for making plants with modulated biomass
  misc_feature: Useful for making plants with modulated flowering time
MAAVDVAYAPPMKSGKAGFEGTLEPQHRIRITLSSRNVKNLEKVCGDLVKGAKGKQLRLKGPVRMPTKVLHITTRKSPCGEGTNTWDRFEMRIHKRVIDLVSTPDVVKQITSITIEPGVEVEVTISDV

SEQ ID NO: 41103 - DNA, 454 bp, Panicum virgatum
  misc_feature: Ceres CLONE 2006522
  misc_feature: Encodes the peptide sequence at SEQ ID NO. 41104
gaaacggagaaagacatgaacgatcaactcccgttcttctaagtcttaaaaatgaaaaaattaaatattttgcaagtggtggagcaagtgttattgctttaactgaaggtggaagtttgtatagttggggattagggataagtggaagattgggaactggagatgaagaaaattctccacttcctcaaagaattgaattttttgatagattaaacctcaaagtcactaaaattagaggcaaaggaggacatgtccttgcccaaacagaggatggggggttgtttagttggggtttagggacacatggaaggttgggacattttgatgaacataatcaagtgattccaaaacagatcgaattttttagaaatagaaaagttatcagttttgcagcaggaatggatcacagtgttgttgttgttgaagaagaataaatttttttctgaatttttct

SEQ ID NO: 41104 - protein, 143 aa, Panicum virgatum
  misc_feature: Ceres CLONE 2006522
  misc_feature (90)..(139): Pfam Name: RCC1 Pfam Description: Regulator of chromosome condensation (RCC1)
  misc_feature: SWISSPROT Homolog: EC 2.7.11.1 Non-specific serine/threonine protein kinase
NGERHERSTPVLLSLKNEKIKYFASGGASVIALTEGGSLYSWGLGISGRLGTGDEENSPLPQRIEFFDRLNLKVTKIRGKGGHVLAQTEDGGLFSWGLGTHGRLGHFDEHNQVIPKQIEFFRNRKVISFAAGMDHSVVVVEEE

SEQ ID NO: 41105 - DNA, 601 bp, Panicum virgatum
  misc_feature: Ceres CLONE 2006533
  misc_feature: Encodes the peptide sequence at SEQ ID NO. 41106
gatccctgcccgcagttaacagtagctgtgagcatcgccaccgccccccacctcaccctcatcaatggcggcgagaagcctcctggcggcggcgttcctggcgctggcggtgccggcggtgctgtgccaggcgcccggcccggcggcgcccaagggcccgccgaacgtgacggcgatcctggagaagggtgggcagtacgcgaccttcatccggctgatgaaggcgacgcagcaggacacgcagctcaacagccagctcaacaactccttcggcagcggctacacggtgttcgcgcccaccgacaacgccttcaacagcctcaagcccggcacgctcaacaagctgtcgcagcaggagcaggtgtcgctggtgcagtaccacatcctcccgcagttctactcgctcgactccttcgagaccgccagcaaccccgtccgcacgcaggcgtccggctccgacgtgcatgtgcatgagtagcgttcttgttgcgatttcattttcttcttctcttgatcttggatttgttcgttgcttcacctggtttggagaaaccgggccatgtgatcccgatccctgaatgttaatgatgctcagttactg

SEQ ID NO: 41106 - protein, 137 aa, Panicum virgatum
  misc_feature: Ceres CLONE 2006533
  misc_feature (44)..(136): Pfam Name: Fasciclin Pfam Description: Fasciclin domain
  misc_feature: Functional homolog of the protein sequence given in SEQ ID NO 51625
  misc_feature: Useful for making plants with altered carbohydrate content
  misc_feature: Functional homolog of the protein sequence given in SEQ ID NO 51626
  misc_feature: Useful for making plants with altered cell wall content and/or composition
MAARSLLAAAFLALAVPAVLCQAPGPAAPKGPPNVTAILEKGGQYATFIRLMKATQQDTQLNSQLNNSFGSGYTVFAPTDNAFNSLKPGTLNKLSQQEQVSLVQYHILPQFYSLDSFETASNPVRTQASGSDVHVHE

SEQ ID NO: 41107 - DNA, 503 bp, Panicum virgatum
  misc_feature: Ceres CLONE 2006548
  misc_feature: Encodes the peptide sequence at SEQ ID NO. 41108
atccacgtccaacctccttcttctcaatgggtcgcgtcagaacaaagacagttaaaaaagcagcacgtttggttgttgaaagatattatccaaaattgactcttgattttcaagtcaacaagaaaatctgtggagaagtcgcagttattccttcaaagcgtcttcgtaatcaaatcgctgggtttgtaactcatctcatgaaacgaattgctcgaggtccagtcagaggaatctcattagtattgcaagaagaagaaagagaacgaagagataactacgttccagctgaaaccatcttggcttcaatggtccgcaagaccgaaattgatgacactaccaaagaaatgctcgaggctatgtgcgattttggaaaactcaccgctgctggaattcaaacagctggttcagcacctgttcaacaaggatttagagataatcgatttccacctcgaagaactgaccgaaaataaattggaaataaataaaggaggttgatcaacttt

SEQ ID NO: 41108 - protein, 147 aa, Panicum virgatum
  misc_feature: Ceres CLONE 2006548
  misc_feature (1)..(125): Pfam Name: Ribosomal_S17e Pfam Description: Ribosomal S17
MGRVRTKTVKKAARLVVERYYPKLTLDFQVNKKICGEVAVIPSKRLRNQIAGFVTHLMKRIARGPVRGISLVLQEEERERRDNYVPAETILASMVRKTEIDDTTKEMLEAMCDFGKLTAAGIQTAGSAPVQQGFRDNRFPPRRTDRK

SEQ ID NO: 41109 - DNA, 1148 bp, Panicum virgatum
  misc_feature: Ceres CLONE 2006554
  misc_feature: Encodes the peptide sequence at SEQ ID NO. 41110
atcactgacgaacgacctgcgaacaagccgtgactggcccccatcatccggcacctgcccccttcaattcagtttgccgtcttaatattcaagtttaattttacccttcaatttccgccaagatgtccatctgggatgccctcaccggacgcaagtcctccccctcgcagacctcgtcatcgagcgcacccgccgcgccgtccgccccagagcaccacactcctaccaataccttccagccgacgactaccttcgaccctactaccgcccaaggcgtagaatccttccttggcagctcctcctttgccgacccctcacaactacaccccctcgccggcctcaacaaagatacgctagactacctctccctcgaagactctgcgctctcggatttgcccggctcccaatcggcactgccgtcacgtggcttcacagatgacctctgctatggaacaggcacaacatacctcgccggcctctcgctaggaggcgcatggggcttgcaggaggggttgaggaagtcggccggcgagtcgccaaaactccggttgaactcggtgctcaactcgatcacacggagagggccgttcctgggcaactcggcgggcgtggtggcagtctgctacaactgcatcaactcatacattgggtacctgagggggaagaacgatgccgccaacacgattgtggctggcgcccttagtggcatgttgtttaagagtacaagggggcttcggccgatggcaatttctggtggtatcgtggcttcggtggccggcgcatgggcggtcgtgaggaggactatcttcgttaaccaggaagattcccatccccaggctcttgcaaccctctgaacaagcaactggatcttcaatgatctccgatgatcttgcatacgacacaatctgtggcttgattttgccaccacattccatcttttaatctacagacaacagcgtacttccacaaagctgttttgtgtgtaaatgtccctttaagggctgacgtgtacgaaactgggccagggggtgaagggctggtatgcatagcgcagggtatctctcctcccatggaaattgtatattagtggcttatggtcatagagcgctcggttgagcgcatagcatgcagtggacctcgatcattcg

SEQ ID NO: 41110 - protein, 243 aa, Panicum virgatum
  misc_feature: Ceres CLONE 2006554
  misc_feature (97)..(228): Pfam Name: Tim17 Pfam Description: Tim17/Tim22/Tim23 family
MSIWDALTGRKSSPSQTSSSSAPAAPSAPEHHTPTNTFQPTTTFDPTTAQGVESFLGSSSFADPSQLHPLAGLNKDTLDYLSLEDSALSDLPGSQSALPSRGFTDDLCYGTGTTYLAGLSLGGAWGLQEGLRKSAGESPKLRLNSVLNSITRRGPFLGNSAGVVAVCYNCINSYIGYLRGKNDAANTIVAGALSGMLFKSTRGLRPMAISGGIVASVAGAWAVVRRTIFVNQEDSHPQALATL

SEQ ID NO: 41111 - DNA, 549 bp, Panicum virgatum
  misc_feature: Ceres CLONE 2006560
  misc_feature: Encodes the peptide sequence at SEQ ID NO. 41112
agtcagcgctagctctcctcccgttccgccttcccgagctgcactgcgccgccgcgtcctctccacctcctccggcgagaatcgctcacctccggcgaggtccctccgttccgggtctgcgaggaagtgccggcgagctcccttccacccctccggcgagctcccgttccgaagcggaatgggcctgtggacattgctggagggttttctacttctcgcaaatgcattggcaatactgaacgaagatcgttttcttgctcccaggggatggagcatgtctgaagtgtcaggaaatgggcaaacaaagtcattgaagggccagatcgtgggccttatctacgccacacaatttctgagggtgcccttgatagcccttaatgttcttatcattgttgtgaagttggtgtcaggctgagtctcactgtctggttttgtctgttggttggatcgatatcagtagcattatgtaaaagttaaatatactcaaagttgctggagacatgttcatgtagcctccaatgtgcatttatgttattgttctggtaaagc

SEQ ID NO: 41112 - protein, 78 aa, Panicum virgatum; identical to SEQ ID NO: 33647
  misc_feature: Ceres CLONE 2006560
  misc_feature (3)..(78): Pfam Name: Yos1 Pfam Description: Yos1-like

SEQ ID NO: 41113 - DNA, 613 bp, Panicum virgatum
  misc_feature: Ceres CLONE 2006569
  misc_feature: Encodes the peptide sequence at SEQ ID NO. 41114
gacatcgttgaagtaagcttttatcccaatggtacgtgatggtaacttgttggttaatggagtagtccaggacgaagaatttgtgctggagccggccaactatgaaatggatccactgactgtccctgaaggctatgtatttgtactgggggacaacagaaacaacagctttgactcacataactggggaccgcttccagtgaatagcattctagggagatctgtgcttcgttactggccaccgtcaaaaataacagatacaatatatgagcatgatatggcgcaattcgcagtcgccacgtcctgagatatgcattggcagtaccacatgaaaatctagtcccatttttccttttatttttccggctgagctttactgacaagtgacaagctgagccgtttattggatgtcgccttgccgcagatgcccattggcagcttggctgacagataagttttggcagatgctctttcgaaggcaacaattcctgtactatgtagcctaagaagggaacccctgtatacatgttatgtttctaaaggcagatgaatgagcttcatggctgccagtaggcttagcatcagatggcaagttctgttatgtttttgagac

SEQ ID NO: 41114 - protein, 92 aa, Panicum virgatum
  misc_feature: Ceres CLONE 2006569
  misc_feature: SWISSPROT Homolog: EC 3.4.21.89 Signal peptidase I
MVRDGNLLVNGVVQDEEFVLEPANYEMDPLTVPEGYVFVLGDNRNNSFDSHNWGPLPVNSILGRSVLRYWPPSKITDTIYEHDMAQFAVATS

SEQ ID NO: 41115 - DNA, 712 bp, Panicum virgatum
  misc_feature: Ceres CLONE 2006573
  misc_feature: Encodes the peptide sequence at SEQ ID NO. 41116
gacagcgcccgcgccgcctccctctcgccagcggcggctgcctctccaagcccccaggcagaccaccatttgttgattcctccattcttcagcctgcactccggttcgcagtttcacttgtcaagtccgtattcaaggggggagatagtctcttccgctgaggggagccgagatgaagccagtggtggggatcgtagtgtcaaacaagatgcagaagtcggtggtggtggcggtggaccgcctcttccaccacaaggtgtacaaccggtacgtcaagcgcacctccaagttcatggcgcatgacgaggccgaggcctgcaacatcggcgaccgggttaggctggatccttccaggcccttgagcagacataagcactgggttgttgctgaaattcttcgcagagctaagatgtatgttccgccatctgcaacagcgtccagtgaaaatgataccaaggctcaacagtctggtcttgctaccaaatgatccgcctttagttcctttgaggcaaagacacagttgccaatttttttttctgtgtgtttgttaacttgtgcaatgtgcatgtaatgtttaattcatagaagaaataacatggcatccatcatttttgctggacttggtttgctctgtcgcgccctttgtttaacggcgcccatcatttgtgctctcttgctagctgccctccaagtttatatgagagcttgagag

SEQ ID NO: 41116 - protein, 104 aa, Panicum virgatum
  misc_feature: Ceres CLONE 2006573
  misc_feature (6)..(74): Pfam Name: Ribosomal_S17 Pfam Description: Ribosomal protein S17
MKPVVGIVVSNKMQKSVVVAVDRLFHHKVYNRYVKRTSKFMAHDEAEACNIGDRVRLDPSRPLSRHKHWVVAEILRRAKMYVPPSATASSENDTKAQQSGLATK

SEQ ID NO: 41117 - DNA, 467 bp, Panicum virgatum
  misc_feature: Ceres CLONE 2006582
  misc_feature: Encodes the peptide sequence at SEQ ID NO. 41118
accattacagtacgcactccggctgacgcgccccgcactctctcacaaagctcaagcctttcgctcgctcgctcgctcgcggctacatctacaatggcgcgattccagctcgcggccctggccatggccatgctcttcgccgcggcggcggcgcaggccccagccgccacaccgacgccggcgcccagggtgtcccccccgccggcgactcctccggggaggccggcaccggcgtctgcgcccgcgcacgcccccgccgttcctccgcccgggcccggcagggagcagactccggcacatcatgaccagcgcgacgcgcctagcggagcgtgtaacggcacgcccgcggaggctaggtcgcggccggcgaccacgcccggggcctccgccccgagcaccagcacggggctgtggacacgctgggggagagcggggacccgcgggacgtgatcagcggcgccgccgac

SEQ ID NO: 41118 - protein, 118 aa, Panicum virgatum
  misc_feature: Ceres CLONE 2006582
  misc_feature: Functional homolog of the protein sequence given in SEQ ID NO 50206
  misc_feature: Useful for making plants with altered carbohydrate content
MARFQLAALAMAMLFAAAAAQAPAATPTPAPRVSPPPATPPGRPAPASAPAHAPAVPPPGPGREQTPAHHDQRDAPSGACNGTPAEARSRPATTPGASAPSTSTGLWTRWGRAGTRGT

SEQ ID NO: 41119 - DNA, 599 bp, Panicum virgatum
  misc_feature: Ceres CLONE 2006593
  misc_feature: Encodes the peptide sequence at SEQ ID NO. 41120
cacgacccaccacactctccagcacccggcggagcaagcggccagcgagatcgagatccagaggcagcagccatggccaccgtcagcgccgccgcggcgaccaccgtcgttgcccgcgccgccctagggctgccgcagctgagggcgaggagcgagagggtgcggtgcagctactccagggacgccaagagcgcggcggccgccgtgagcgccaggggcgccggcgcgtcgctgctggccgcggcaggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagatcatgtccatcatccgctcctgttactactgctccggatgtaaacatggcggtggtcatcggtgtaatgtcagacttggctatttaatttgtatctaagcttcgcttttgcgttggatcaaagtgatgacccatggagattacgcgcg

SEQ ID NO: 41120 - protein, 125 aa, Panicum virgatum
  misc_feature: Ceres CLONE 2006593
  misc_feature (1)..(125): Pfam Name: PsbW Pfam Description: Photosystem II reaction centre W protein, PsbW
MATVSAAAATTVVARAALGLPQLRARSERVRCSYSRDAKSAAAAVSARGAGASLLAAAGAVTASAGPALALVDERMSTEGTGLSLGLSNNLLGWILLGVFGLIWSLYTVYTSDLDEDEESGGLSL

SEQ ID NO: 41121 - DNA, 658 bp, Panicum virgatum
  misc_feature: Ceres CLONE 2006597
  misc_feature: Encodes the peptide sequence at SEQ ID NO. 41122
aaaaccagtgcgctgttctttcttgttcccctaaactgatctccccgtctccgtacgctccgcatctcgacctcaccggcggcgggaacacgatggtcgcgttgctgggccggctgatcggggtggcggcggcggtcgccgcgttcatcgccctcgcggcgttcggatccgcctcgccctcgcccaagtccttcgtgaaatccaccgtcgccgcccacgacgtcgtcatcttctccaagtcatactgcccgtattgtaggaaagcaaaggccatatttaaggagtttcagttaaagaaagagccctatgttgtggagcttgatcatcgagaggatggttcggagattcaggatgccttatctgagatagttggcaggcgtactgttcctcaagtttttgtcaatggaaagcatttggggggctctgatgatactgttgaggcttacgaaagtggaaagttggcaaaactcttgaatatcggagtcaaggacgatctttaagaaacatgttagcatcacaagtttatctcttgttttgagttatgaggctgtattatgcgactctgaattggcattatacgaaatatgtaactgaatattgtggcataattcataacatctgaaccctacttttgatatttcctcccttatctcgtatt

SEQ ID NO: 41122 - protein, 135 aa, Panicum virgatum
  misc_feature: Ceres CLONE 2006597
  misc_feature (44)..(108): Pfam Name: Glutaredoxin Pfam Description: Glutaredoxin
  misc_feature: SWISSPROT Homolog: EC 1.11.1.15 Peroxiredoxin
MVALLGRLIGVAAAVAAFIALAAFGSASPSPKSFVKSTVAAHDVVIFSKSYCPYCRKAKAIFKEFQLKKEPYVVELDHREDGSEIQDALSEIVGRRTVPQVFVNGKHLGGSDDTVEAYESGKLAKLLNIGVKDDL

SEQ ID NO: 41123 - DNA, 787 bp, Panicum virgatum
  misc_feature: Ceres CLONE 2006604
  misc_feature: Encodes the peptide sequence at SEQ ID NO. 41124
aacacacgaaaaaggaacacacattactcttcgaggacgtaaccgacagtctatcaacaatcataaacgtcaagatgtcggacgtagaagagaacaacgccccggaggttcaggaggaggttgaggtttcggccgatgccggcaagggccagatgtcggttctggatgcgctcaagggcgtcctgaagctgtctctgatgcacgacggtctcgcccgcggtctccgcgaggcgtccaaggccctcgaccggaggcaggcgcacatgtgcgtgctcaacgagtcgtgcgaggaggaggcctacaagaagctcgtcatcgccctctgctccgagcacaagatcccgcttatcaaggtgcctgacggcaagcagctcggcgagtgggctggtctctgcgttctcgaccgtgagggtaacgcccgcaaggtcgtcaactgctcttgcgtcgtcgtcaaggactggggtgaggagtcgcaggagcgctccatcctcctcaactacttctcgtctgaggcttaagcgaaccaagcacgggcgagggtagtggcatttcgcgaggaaagaaggagaatggggatatcatagagggatttggagaagggttcacctctcgggccacggtccgatgacatcttcctcgggtgtgctctggttctcaccggctggctaaaaggatggcgggacatctgggagccccttcacgcggctacccttcgcatacggcatgggaaactgagcaagacaaaataaaaaagaagcctcacaactggccattccggttgtcaccc

SEQ ID NO: 41124 - protein, 147 aa, Panicum virgatum
  misc_feature: Ceres CLONE 2006604
  misc_feature (31)..(126): Pfam Name: Ribosomal_L7Ae Pfam Description: Ribosomal protein L7Ae/L30e/S12e/Gadd45 family
MSDVEENNAPEVQEEVEVSADAGKGQMSVLDALKGVLKLSLMHDGLARGLREASKALDRRQAHMCVLNESCEEEAYKKLVIALCSEHKIPLIKVPDGKQLGEWAGLCVLDREGNARKVVNCSCVVVKDWGEESQERSILLNYFSSEA

SEQ ID NO: 41125 - DNA, 716 bp, Panicum virgatum
  misc_feature: Ceres CLONE 2006614
  misc_feature: Encodes the peptide sequence at SEQ ID NO. 41126
ggttgcttgcaccaattagggatggaaaaccatgtcgacgaggtaataaggatcggatgatcctctctcactcacctctcgccggccgggtgggcctatatatcaggcacaccccaccacctcccccaggcgcagatcgatcgagcaccccaaacttgcacacaatcaccatcagttctagtagacaagacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgggggctgaatgataaacgtaccgcctgcatgctggatcaaagctgctagctagcgcctacacccttgatgttccttcctgattgcccttactggtttagcttttagctagtacactagaaaagggaagatctagagatcaaataattgaagctcatcaaatagtatggggaatggagctagctgctgtctag

SEQ ID NO: 41126 - protein, 72 aa, Panicum virgatum
  misc_feature: Ceres CLONE 2006614
  misc_feature (12)..(70): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVAQTPTGAE

SEQ ID NO: 41127 - DNA, 547 bp, Panicum virgatum
  misc_feature: Ceres CLONE 2006627
  misc_feature: Encodes the peptide sequence at SEQ ID NO. 41128
gaacaaacgctaaaaaagtaacagtttctgtactttattgagcgctcagcatgggtcgcatgtatggtcccggcaagggcatctccggatcgtcccttccttaccgccgcaccccgccggcgtggctgaagctgacgtcgcgcgacttggtgaagacgatcgtcgacctggcgaagaagggtatggcgccgtccatgatcggtctgacgctgcgtgactcgatgggtgttgctcaggtcaaggcggtgacgggccgcaagatcgtgcgcatcctgaaggctcacggccgtggtgcggagctgccggaagacatgttctgcctgatcactcgcgccgtcgcgatgcgcaagcaccttgatcgccaccgcaccgacatcgacacgaagttccgtctgattctggtcgagtcgcgcatccaccgcctggcgcgctactacaagagcgtgcgcaagctgccgcccacgttcaagtacgaggccgccaacgccgcttctctggttgcccagtaagctgacagctctgccgttgccctctctttactgttcag

SEQ ID NO: 41128 - protein, 152 aa, Panicum virgatum
  misc_feature: Ceres CLONE 2006627
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Functional homolog of the protein sequence given in SEQ ID NO 50384
  misc_feature: Useful for making plants with modulated nitrogen use efficiency
MGRMYGPGKGISGSSLPYRRTPPAWLKLTSRDLVKTIVDLAKKGMAPSMIGLTLRDSMGVAQVKAVTGRKIVRILKAHGRGAELPEDMFCLITRAVAMRKHLDRHRTDIDTKFRLILVESRIHRLARYYKSVRKLPPTFKYEAANAASLVAQ

SEQ ID NO: 41129 - DNA, 593 bp, Panicum virgatum
  misc_feature: Ceres CLONE 2006648
  misc_feature: Encodes the peptide sequence at SEQ ID NO. 41130
ctttctttaccttctgtggtgtctgggaagcaggcgtcaccatgggtcgtttgcacagtaagggcaagggcatcagctcctctgccctcccctacaagcgtagcgcccccagctggtgcaagaccacctcaaccgaggtcactgactccatctgcaagctggctcgtaagggtatgaccccttcccagattggcgttgttctgagggactcgaatggcattccacaggtcacctcagtcactggctccaagatcttgcgcatcctgaagaccaacggcctggcccctgagatcccagaggacctgtatcatcttatcaagaaggcagtgtccatccgtaagcacttggagcgcagccgcaaggacgttgacggcaagttcaggttgattctggtggagtcccgtatccaccgcctggcacgctactacaagcgcgtcaagaagctgcccccaaactggaagtacgagtccgcgacagcttctaccctggtgtcgtaatcgcttaaatgacagcagtcagcgcattggttttgtcttgaggtgccaacctgtgaatgctgggtcagcaaccatgatgtaaatcaatgagtattc

SEQ ID NO: 41130 - protein, 151 aa, Panicum virgatum
  misc_feature: Ceres CLONE 2006648
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Functional homolog of the protein sequence given in SEQ ID NO 50384
  misc_feature: Useful for making plants with modulated nitrogen use efficiency
MGRLHSKGKGISSSALPYKRSAPSWCKTTSTEVTDSICKLARKGMTPSQIGVVLRDSNGIPQVTSVTGSKILRILKTNGLAPEIPEDLYHLIKKAVSIRKHLERSRKDVDGKFRLILVESRIHRLARYYKRVKKLPPNWKYESATASTLVS

SEQ ID NO: 41131 - DNA, 664 bp, Panicum virgatum
  misc_feature: Ceres CLONE 2006649
  misc_feature: Encodes the peptide sequence at SEQ ID NO. 41132
tatgcactaagaacaggcaagcctttttgggttgtatccgaagacatggaaagggatgtttttatgtcagcagacgaagccaaagcttatggacttgtcgatattgtaggggatgaaatgattgacgagcactgcgatactgatccagtgtggtttccagaaatgtttaaggattggtagtggctggatttcttgtaaatttatttcaaacctaaattcgggttttatgctattttatagaaaatagaaatacttcatgatgatgaatcatcaggttaagatcaatctaaaccaatccattttttctatatacatacgacatgccaacggttaaacaacttattaaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttct

SEQ ID NO: 41132 - protein, 59 aa, Panicum virgatum
  misc_feature: Ceres CLONE 2006649
  misc_feature: SWISSPROT Homolog: EC 3.4.21.92 Endopeptidase Clp
YALRTGKPFWVVSEDMERDVFMSADEAKAYGLVDIVGDEMIDEHCDTDPVWFPEMFKDW

SEQ ID NO: 41133 - DNA, 696 bp, Panicum virgatum
  misc_feature: Ceres CLONE 2006673
  misc_feature: Encodes the peptide sequence at SEQ ID NO. 41134
gcgccatcctcctcttcgttacgtttgatctctagcttcaccgcgaaccagctgcgacgtacgcccgatcgacgacgacacagctagtagcaatggcggcggcgtccaagggcttcctcctgctcgctctcctcgcggcggccgccgtgctcgccaccgccgcggcggagcaacgaacccatgacagaaaggagaagatggcgaacggcgccgccggcgtggagcactggcacggcggtggcggcggccacggcggcgggtcaggtgatgagcacagccacggctgcgagtacggctgctgccgccgcgtataccacggcggctgcaagaagtgctgcccgcctcccggcggccggccggaggtggggaactagcaagacctcgtcctacgctgagcaggatcggagatcgatgcccggcgaggtgttcttcaagttcatactcgttacgtacccaacacgggtgtagcttagtattagcttggttgtgcgtggtagcatccttacgagtgaataacgtgcgacgtgcacgtacggataggcccgtacgtgtatggacgtacgcacacatgtacgtcttcctctccttcctgcctcctgctgctgcggaataactgtgtgtgtgttgtgctgtacctgtactggtactgcggtagcaagagctcatgttggtgcgcttgaaatctcaatgaaactg

SEQ ID NO: 41134 - protein, 93 aa, Panicum virgatum; identical to SEQ ID NO: 41088
  misc_feature: Ceres CLONE 2006673
  misc_feature (1)..(78): Pfam Name: GRP Pfam Description: Glycine rich protein family

SEQ ID NO: 41135 - DNA, 695 bp, Panicum virgatum
  misc_feature: Ceres CLONE 2006705
  misc_feature: Encodes the peptide sequence at SEQ ID NO. 41136
acgctccccacacccacccaatcccgcgacgcacgagagcaaaaaagctagcgctgagctcaggatccatggccgccaccgccgtcgcggcgtctctgtccgtggcccgtggcctcgggaagcctctggtctgcgccggcggcagcagcgcgtcgtcgctccgcctctcgccacgcaggtcggcggccgtcgtcagggcgtccgcgcagcagcagcagcagcagccggccaaggagtgggcggcggcagcggccgtggcagcggcgctggtgctgcccgaggtcgcggaggccgcgtcgccggggatctcgccgtcgctcaagaacttcctcctcagcatcgtctccggcggggtcgtgctcttcgccatcgtcggcgctgtcgtcgccgtctccaacttcgaccccgtcaagcggggctgagcagagctccactgccatggaccatgatcgggcgctttgtcgcttgggctgggtctgggtgtacctacgttctgagtgagactgagggcgagtcgatcgatctcttctcagtgtgattccgaatgaacagtgcttaatgctaaaacctcttgccgtgtaaatctatctcatttcatgctcgcgtaatcccgtatgatctgacagcagcttcagccgcctatactattgatggtctagtatatgacgaatcaacagcgtgtttgcgttgctcgg

SEQ ID NO: 41136 - protein, 117 aa, Panicum virgatum
  misc_feature: Ceres CLONE 2006705
  misc_feature: Functional homolog of the protein sequence given in SEQ ID NO 50416
  misc_feature: Useful for making plants with modulated nitrogen use efficiency
MAATAVAASLSVARGLGKPLVCAGGSSASSLRLSPRRSAAVVRASAQQQQQQPAKEWAAAAAVAAALVLPEVAEAASPGISPSLKNFLLSIVSGGVVLFAIVGAVVAVSNFDPVKRG

SEQ ID NO: 41137 - DNA, 501 bp, Panicum virgatum
  misc_feature: Ceres CLONE 2006706
  misc_feature: Encodes the peptide sequence at SEQ ID NO. 41138
atcataaaaaatgggtcgcgttagaactaagactgtcaagaaggcttctcgtgttgtcattgaaaagtactatcctcgtcttactcttgacttccaagttaacaagaagatcctcgatgaagtctccatcatccaatccaagcgtctccgtaacaagattgctggtttcactactcacttgatgaagcgtatttctcgtggtcccgttcgtggtatttctttcaagttgcaagaagaagaacgtgaacgtcgtgataactacgtccccgaattctctgctttggatacctccaacattgaggtcgatcctgagactgaggctttgctcaaggctatcaactttgagaacctccccggtgttaaggttactgctcccgttgctgctttcgctcctcgcaacaacaaccgtggtcctcgtggtccccgtaaggctgctgaggcccaggcttaaattcctgtctagttgcttatttaaataaaaattgcagttaataaaacatc

SEQ ID NO: 41138 - protein, 146 aa, Panicum virgatum
  misc_feature: Ceres CLONE 2006706
  misc_feature (1)..(122): Pfam Name: Ribosomal_S17e Pfam Description: Ribosomal S17
MGRVRTKTVKKASRVVIEKYYPRLTLDFQVNKKILDEVSIIQSKRLRNKIAGFTTHLMKRISRGPVRGISFKLQEEERERRDNYVPEFSALDTSNIEVDPETEALLKAINFENLPGVKVTAPVAAFAPRNNNRGPRGPRKAAEAQA

SEQ ID NO: 41139 - DNA, 696 bp, Panicum virgatum
  misc_feature: Ceres CLONE 2006741
  misc_feature: Encodes the peptide sequence at SEQ ID NO. 41140
acaggcacttagcactaatcgatttatttctgctttaatttgtgcgtgtggtccgcagagcaaaatggcagggaaggcctcggtcgcgctgttcctggccgtcaacctggtcgtgttcgccatggccagcgccggctgcggtggcgactgccccacgccgtcgaccccgtcgaccccgtcgactcctaccccgacgtcggcctccaaaggcaagtgcccccgcgacgcgctgaagctgggcgtgtgcgccaacgtgctgggcctcatcaaggccaaggtcggcgtgccgcccgcggagccctgctgcccgctgttggaggggctcgtcgacctagaggccgccgtgtgcctctgcaccgccatcaagggcaacatcctcggcatcaacctgaacctgcccatcgatctcagcctcatcctcaactactgcggcaagaccgtgcccactggcttcaagtgcctctaagctaccagacgcataggcatatatgcatccatcgtggtttggtttgctatgtgtgtgctatatataaatgctggctatcggaagcttgaatgcattgtggagaggcaaaggacgtgcgcacacatgcgttcgatttgcttctgttgttccgttgtcttatttattctcgcatgtccctctccgagctatgtgggttattgttcatttgcatttgcaactggattgtatgg

SEQ ID NO: 41140 - protein, 133 aa, Panicum virgatum
  misc_feature: Ceres CLONE 2006741
  misc_feature (51)..(132): Pfam Name: Tryp_alpha_amyl Pfam Description: Protease inhibitor/seed storage/LTP family
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 51501
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MAGKASVALFLAVNLVVFAMASAGCGGDCPTPSTPSTPSTPTPTSASKGKCPRDALKLGVCANVLGLIKAKVGVPPAEPCCPLLEGLVDLEAAVCLCTAIKGNILGINLNLPIDLSLILNYCGKTVPTGFKCL

SEQ ID NO: 41141 - DNA, 201 bp, Panicum virgatum
  misc_feature: Ceres CLONE 2006743
  misc_feature: Encodes the peptide sequence at SEQ ID NO. 41142
gagaagcaaaaccatggcgtcgtccaaagcgctcctagggcttgcgctcctgctcactgctgccttccttgtcgcctcagctaataacaagcacacccagccaaaggaggaggagaacaagcaggcccgcgtgcaggactaccacggcggcggccaccccggcggaggctggcgcgagggaggctaccctggccacagcgg

SEQ ID NO: 41142 - protein, 62 aa, Panicum virgatum
  misc_feature: Ceres CLONE 2006743
  misc_feature (1)..(61): Pfam Name: GRP Pfam Description: Glycine rich protein family
MASSKALLGLALLLTAAFLVASANNKHTQPKEEENKQARVQDYHGGGHPGGGWREGGYPGHS

SEQ ID NO: 41143 - DNA, 731 bp, Panicum virgatum
  misc_feature: Ceres CLONE 2006745
  misc_feature: Encodes the peptide sequence at SEQ ID NO. 41144
acaaatcccccgcaacctcccaacgcatcctctcattcaaaccctcgttcctccagcaccaagagaatccgagcggcctcgatggcgcccaaggcggagaagaagccggcggccaagaagcccgcagaggaggagcccgcggagaaggcggctccggcggagaaggcccccgctggcaagaagcccaaggcggagaagcggctcccggcgggcaagtctgccggcaaggagggcggcgacaagaaggggaagaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggaggccgccaagctcgcccgctacaacaagaagcccaccatcacctcccgcgagatccagacctcggtgcgcctcgtcctccccggggagctcgccaagcacgccgtgtcagagggcaccaaggctatggcagcggcgacggtggtggcggcggccaaggtggtggctctggctatggctccggatccggctctgggtatggctctggtggtggacacaactaagctcagattcagaggcaactacagagtatatagctacaaatgtatcatcagtggtgcgtttgtctcatgttatacagaaaactgctttatttgagtgtgtaacactaaaag

SEQ ID NO: 41144 - protein, 210 aa, Panicum virgatum
  misc_feature: Ceres CLONE 2006745
  misc_feature (61)..(131): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAAKKPAEEEPAEKAAPAEKAPAGKKPKAEKRLPAGKSAGKEGGDKKGKKKAKKSVETYKIYIFKVLKQVHPDIGISSKAMSIMNSFINDIFEKLAAEAAKLARYNKKPTITSREIQTSVRLVLPGELAKHAVSEGTKAMAAATVVAAAKVVALAMAPDPALGMALVVDTTKLRFRGNYRVYSYKCIISGAFVSCYTENCFI

SEQ ID NO: 41145 - DNA, 533 bp, Panicum virgatum
  misc_feature: Ceres CLONE 2006753
  misc_feature: Encodes the peptide sequence at SEQ ID NO. 41146
gatcccgtccgctccgcctcctccgccgccgctgctcgccgtccgtccgtccgtcgatccgagaggaggcaggctgaggccaaccgcatcagggagaagtaccctgacagaatccccgtcattgttgagaaggccgagagaagcgatatccccgacattgacaagaaaaagtaccttgttcctgccgacctcacagttggacagtttgtctatgtggtacggaagcggatcaagctcagtgccgagaaagcaatcttcatcttcgtaaagaacaccctcccgccaacagccgctctgatgtctgccatctacgaggagaacaaggacgaggacgggtttctctacatgacctacagcggcgagaacaccttcgggctgttctaagcccagggcatcgtgaatggccctctggcctcgtcgcaaatgtctcctgtaaatacatatctgaagaacctgtgtacataatccggtccgcctttgtcgccagcagctcttaagctgtgctctgctgttaaaaaagtcctttgaagcgt

SEQ ID NO: 41146 - protein, 127 aa, Panicum virgatum
  misc_feature: Ceres CLONE 2006753
  misc_feature (22)..(125): Pfam Name: MAP1_LC3 Pfam Description: Microtubule associated protein 1A/1B, light chain 3
  misc_feature: Functional homolog of the protein sequence given in SEQ ID NO 50573
  misc_feature: Useful for making plants with modulated nitrogen use efficiency
DPVRSASSAAAARRPSVRRSERRQAEANRIREKYPDRIPVIVEKAERSDIPDIDKKKYLVPADLTVGQFVYVVRKRIKLSAEKAIFIFVKNTLPPTAALMSAIYEENKDEDGFLYMTYSGENTFGLF

SEQ ID NO: 41147 - DNA, 616 bp, Panicum virgatum
  misc_feature: Ceres CLONE 2006782
  misc_feature: Encodes the peptide sequence at SEQ ID NO. 41148
acgccgcagttccccgggaggaccgtcacgctcgagcaccagcccggagcgacttgctggggaattgcctacaaaataaaggaggaggataagcagacagctttggagtatctagaagtcagagagaagcagtatgatgagaagattcaccttgatttgtatacggattcatcacctaaagtaccagcggtagaacatgtgacagtatacttagccacaacgaataaggagagcaacaaaaactatcttggtcctgcacctctggaagaaatggccaggcaaatttaccttgcggaaggcccttctggacctaacaaagagtatgtattcaaacttgaggatgccttaaacaaactaggatttgtagacccacatgtccaagaactggcgaatgctgtgcgtgagtattcagatgccaagtccaagtaaaaaaatcacatttcccctttcttttgagggtagaagatttcggaagaaagtcaaaatttattcatgctcaaacatcgctatattcttgtaagctgctagttatatggctatcttgtgactatattcctgtgacatcccgcccgtccatgaatggcgtttgaaagcttactttagagattacagaagc

SEQ ID NO: 41148 - protein, 142 aa, Panicum virgatum
  misc_feature: Ceres CLONE 2006782
  misc_feature (1)..(136): Pfam Name: ChaC Pfam Description: ChaC-like protein
  misc_feature: Functional homolog of the protein sequence given in SEQ ID NO 51627
  misc_feature: Useful for making plants with modulated nitrogen use efficiency
TPQFPGRTVTLEHQPGATCWGIAYKIKEEDKQTALEYLEVREKQYDEKIHLDLYTDSSPKVPAVEHVTVYLATTNKESNKNYLGPAPLEEMARQIYLAEGPSGPNKEYVFKLEDALNKLGFVDPHVQELANAVREYSDAKSK

SEQ ID NO: 41149 - DNA, 633 bp, Panicum virgatum
  misc_feature: Ceres CLONE 2006792
  misc_feature: Encodes the peptide sequence at SEQ ID NO. 41150
tccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacaggatttccgatcctagcgggaaaaggagggaaacggatactcaatttaaagtgagtaaacagaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggtt

SEQ ID NO: 41150 - protein, 60 aa, Panicum virgatum
  misc_feature: Ceres CLONE 2006792
  misc_feature (1)..(60): Pfam Name: Ribosomal_S7 Pfam Description: Ribosomal protein S7p/S5e
MSRRGTAEKRTAKSDPIFRNRLVNMVVNRIMKDGKKSLAYQILYRAVKKIQQKTETNPLL

SEQ ID NO: 41151 - DNA, 660 bp, Panicum virgatum
  misc_feature: Ceres CLONE 2006795
  misc_feature: Encodes the peptide sequence at SEQ ID NO. 41152
gcaaccaacagcaacccatcgttctcgctactagctcactctctactcgcccatcatcgatctagctgcttccttcttcttccctagcagaagagcaagaccatgtcgacggtgagccgtgcatccctcgaccagaagcttgccctcgccaagcgatgctcgcgagaggccaccctcgcaggggctaaggctgcagctgtagccaccatcgcctctgcaattcccacgattgcgagcgtgcggatgctgccatgggcgaaggccaacatcaaccccaccggccaggcactcatcatctccacagtcgccgggatggcctacttcatcgcggccgacaagaagatcctgtcgctggcgaggcgccactcgtacgaggacgcgcccgagcacctcaagaacacctccttccagggcgccggcaggccgcaccctgctttcttcaggccatgatccagctgcaccgctactgttggagttgatgaataaactactttgtcagcaacggcaaatcgttcgacgatgtgcgcagagacttggaccatttagtttgtatcagctgtgctccaaacactgtataatcaagcagtatatcgtcgtaaaaagtattgtacttttgtgtttctcgatcctgaactacgtttttttatccgtataatagat

SEQ ID NO: 41152 - protein, 115 aa, Panicum virgatum
  misc_feature: Ceres CLONE 2006795
  misc_feature (11)..(89): Pfam Name: ENOD93 Pfam Description: Early nodulin 93 ENOD93 protein
MSTVSRASLDQKLALAKRCSREATLAGAKAAAVATIASAIPTIASVRMLPWAKANINPTGQALIISTVAGMAYFIAADKKILSLARRHSYEDAPEHLKNTSFQGAGRPHPAFFRP

SEQ ID NO: 41153 - DNA, 523 bp, Panicum virgatum
  misc_feature: Ceres CLONE 2006797
  misc_feature: Encodes the peptide sequence at SEQ ID NO. 41154
gatctcgctcgggcaccagactctgaaaactgaaaggaaggacgcgaagaagcgggcagcagcggattcgtcaccgtcagtgagtgctaagacaagatggtggccaacggtgacgcacccgccagagggagtgcagcagctgctgcaagcctgcgcaggcgcagaaccacaagcggtgctggtggtggtggaggcggtgccagctcgatgctccagttctacaccgatgaggctgctggtgctaagatgtccccgaacactgttctgatcatgagcattgggttcattgccgttgttgctatgctgcatgtgtttgggaagctgtaccgcaccactaattagtttttgttaccatacccaagaaagcatagtctaccaagagaggaaccttgtagagcagtttaaatgggtagcaaatgaatatcagattctgaaaagattatgctgttatagaagttcatgcaacttgcaatgctaagctgttatggttaaatcatcgccagtcttgtttcgtcattgtcat

SEQ ID NO: 41154 - protein, 81 aa, Panicum virgatum
  misc_feature: Ceres CLONE 2006797
  misc_feature (32)..(77): Pfam Name: Sec61_beta Pfam Description: Sec61beta family
MVANGDAPARGSAAAAASLRRRRTTSGAGGGGGGASSMLQFYTDEAAGAKMSPNTVLIMSIGFIAVVAMLHVFGKLYRTTN

SEQ ID NO: 41155 - DNA, 622 bp, Panicum virgatum
  misc_feature: Ceres CLONE 2006810
  misc_feature: Encodes the peptide sequence at SEQ ID NO. 41156
atctctcctctccggtttgctttgtagaggcagaagcgaacccgagtgagagggaggcggcggaggtaaggcaccagccagcaccaccatgtcgtcggccgcggcaggagagggggagacggtgcgggcgtcgcacatcctcgtcaagcacgagggctcccgccgcaaggcctcctggaaggaccccgaaggccgcgtcatctccgcgaccacccgcgccgacgccgccgcgcgcctcctcgacctccgcaaccagatcctcgccggccaggccaacttcgccgacctcgccgcgcgccactccgactgctcctccgcgcgccgcggcggagacctcggtacctttgggaggagtcagatgcagaaaccctttgaggacgccacctttgcactcaaggttggtgagctcagcgaccttgtggacacagacagtggggttcacatcatcttgcggactgcctgaggagaggcagactctgtcggctttcagttagtgcaaatggctatcaattagggcttgtatttttccccccgttctggcagcctaagtgcgtgacattctggatttctggacaaaagataaagcatgtatcttaacacgtttgccacagcattggagttt

SEQ ID NO: 41156 - protein, 124 aa, Panicum virgatum
  misc_feature: Ceres CLONE 2006810
  misc_feature (16)..(124): Pfam Name: Rotamase Pfam Description: PPIC-type PPIASE domain
  misc_feature: SWISSPROT Homolog: EC 5.2.1.8 Peptidylprolyl isomerase
MSSAAAGEGETVRASHILVKHEGSRRKASWKDPEGRVISATTRADAAARLLDLRNQILAGQANFADLAARHSDCSSARRGGDLGTFGRSQMQKPFEDATFALKVGELSDLVDTDSGVHIILRTA

SEQ ID NO: 41157 - DNA, 670 bp, Panicum virgatum
  misc_feature: Ceres CLONE 2006813
  misc_feature: Encodes the peptide sequence at SEQ ID NO. 41158
atcgtcctagctcccagaactcctcctcagtcctcactaccagcgctgccctctgctcactcgccgtccattcctcttccctctcgagcaagctcgtcagcatgtcgacggtgtcccttgaccagaagcttgccctcgccaagcgctgctcgagagaagccaccctcgctggagccaaggcagcagctgtagccaccgtcgcctccgcgatccccaccctggcgagcgtgcggatgctgccgtggaccaaggccaacatcaaccccaccggccaggccctcatcatctccacagtcgccggcatggcctacttcatcgcggcggacaagaagatactctcgctggcgaggcggcactcgttcgagaacgcccccgagcacctcaggaacacctcctaccagggcaccggccgtccccacccggccttctccaggccctgatcggctcgcaagcacattaaagacccgtgctgccctgcgctctagcctcatctagatatgtataccgtgtgtgtatgcttgctgcaataataagcaggccggcaggtagctgcctgctctaagcttattagcatgggaagcttctgcagtgtggcgtagtctttgaatatatgcgtccatgccgtgtactattactctgtcgcggtaatgaaatactactagttcttgtc

SEQ ID NO: 41158 - protein, 112 aa, Panicum virgatum
  misc_feature: Ceres CLONE 2006813
  misc_feature (8)..(86): Pfam Name: ENOD93 Pfam Description: Early nodulin 93 ENOD93 protein
MSTVSLDQKLALAKRCSREATLAGAKAAAVATVASAIPTLASVRMLPWTKANINPTGQALIISTVAGMAYFIAADKKILSLARRHSFENAPEHLRNTSYQGTGRPHPAFSRP

SEQ ID NO: 41159 - DNA, 697 bp, Panicum virgatum
  misc_feature: Ceres CLONE 2006818
  misc_feature: Encodes the peptide sequence at SEQ ID NO. 41160
ggtgagtcgtcgtgtcgccggcatccatggcggcggtggtgcgcggcgtcctgaggggcatcaaggagaagggcctcgccaacttcctccgcgacgcccgcgaggaaggatacctgaattgcattctggatgggaaccttttgcaaacaaaaattcacaatattggcgcaacacttgtaggggttgacaagtttggaaacaagtactatgagaaactgcaagacactcagcatggaaggcataggtgggtggaatatgcagagaaagatcgttacaatgcatcccaagtgcctcctgaatggcatggatggctgcatcacatcacagataacactggcgatcagctgctggcccggaagactgctcggtaccttgtggagcacaagcagaactactccggtgagggcgaggagctgatctaccactccaaggggcatgcccttaacccggggcagagggactggacgaggtaccagccctgggagccaaagaaagagcaagcctagtaaaatgtcgtgtctgatcggggaggaccaccctgtgttgtgttttcctgctttcttgccttgggccaggtgttgctgagctgaataatcaatcaatcagcgagtgactcgttcggcctcgggtccttggagcgatcctgaataatgttgtactggacgacaatactgtataattcgatcatctttgtttg

SEQ ID NO: 41160 - protein, 159 aa, Panicum virgatum; identical to SEQ ID NO: 14481
  misc_feature: Ceres CLONE 2006818
  misc_feature (48)..(154): Pfam Name: NDUFA12 Pfam Description: NADH ubiquinone oxidoreductase subunit NDUFA12

SEQ ID NO: 41161 - DNA, 546 bp, Panicum virgatum
  misc_feature: Ceres CLONE 2006825
  misc_feature: Encodes the peptide sequence at SEQ ID NO. 41162
ctctgcggctctgcctgctcggatccacctccacctctctccagcgacctctccctctcgcgcccgccgccgccgccgccgtcgccgcgatgggcctcttcgacgcgctctaccgcgtggtgatgcgccgcaacgccgtatacgtcaccttcgtcgtcgccggcgccttcgccggcgagagggcggtggattacggagtccacaagctctgggagatgaacaacgtcgggaaaaggtatgaagatataccagttctggggcaaaggccagctgaagaatgagagcattggagctcagactacccaggatgtcgctttccatgaaattagattccatttaagcaatggtttatcattcctttttgacataataacaaccaatgtaaaatccaaactctttccgggagttgctacccgttcaattactcagcaggctgttggagtttcctgatgcatggttagaacctgttatctagccaggcatcggcatgtttggcatgtttggtcgaaaacttgaaatgccatgaatgagaaatgttttgttggc

SEQ ID NO: 41162 - protein, 63 aa, Panicum virgatum; identical to SEQ ID NO: 13073
  misc_feature: Ceres CLONE 2006825
  misc_feature (4)..(58): Pfam Name: UCR_UQCRX_QCR9 Pfam Description: Ubiquinol-cytochrome C reductase, UQCRX/QCR9 like

SEQ ID NO: 41163 - DNA, 679 bp, Panicum virgatum
  misc_feature: Ceres CLONE 2006845
  misc_feature: Encodes the peptide sequence at SEQ ID NO. 41164
aacccatcatccatcgccctcacctctcttctctcagtttgcagtgccactcgtcaccggcagcagagctgcttcgtttcctagcgatttaccagccaatctcgcgcttctttgcttaccacacagcatcaacgatgtcgactgtgagccgtgcgtcccttgaccagaagctcgccctcgccaagcgctgctcgcgagaagcgacccttgcaggagctaaggcggcagccgtggccaccatcgcctccgccatcccaacgctggcgagcgtgcggatgctgccgtgggctaaggccaacatcaaccccaccggccaggccctcatcatctccacagttgctgggatggcatacttcatcgccgctgacaagaagattctgtcactggcgagaaggcactcgttcgaggaagctcccgaccacctcaagaacacctcctaccagggtgccggccgcccacacccggctttcttcaggccatgatgaggaatctggcgagatggccctcttggaagttgctgtactctgtgccgtcgatgtccgaataaattaaactactactattagctcgccaatatcatcgatgtaatggtatagtacttcaatgggccactgtaattagtttgtactactgctgctccaattgaaaaggaatgcaacttggtcttacggtactgacc

SEQ ID NO: 41164 - protein, 115 aa, Panicum virgatum
  misc_feature: Ceres CLONE 2006845
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIISTVAGMAYFIAADKKILSLARRHSFEEAPDHLKNTSYQGAGRPHPAFFRP

SEQ ID NO: 41165 - DNA, 742 bp, Panicum virgatum
  misc_feature: Ceres CLONE 2006853
  misc_feature: Encodes the peptide sequence at SEQ ID NO. 41166
gcgcgcgtctcctctttacattcatcttctgatcagttctcgatcactggctgctgctagcagcctgctgccatagctgcaagacaggcagttccgatccctgtgtctcaagcaaattaattaaacaaaagcaagatcatcatcagttgttaagagactagaaaagcaaccgccaacagagaaagacagatgatggaggggggcatggacgctgcaaggatcatagggtacttgaaggggaagagcatcctcataaccggctctactggctttcttggaaagattcttgtggagaagatcctgcgggtgcagcctcatgtccacaagatgtacctcctggtacgagccatcgacgcgcaggccgccaaacaccgcgtccagcaagaggtgatcggtgcggagctgttcggtctcctgagagaaaagtacggcggcgaggggttcgactcgttgatcgaggacaagattgttcctttggccggagacatcacccgcgaggacctgggcctcgacgcacccacactgcgccacctggccaagaacatggacgtcatcgtcaacatcgctgcaaccaccaacttctacgaaaggtatgacgtgtccttggacgtgaacgtgatgggggtgaagcacctctgccagttcgccaagcagtgcgccaacctcaagatgctcatgcatgtctccacggcttttgtgcgtgcagcttttgtgtccggcgacagcgcggaggcgatcccgg

SEQ ID NO: 41166 - protein, 184 aa, Panicum virgatum
  misc_feature: Ceres CLONE 2006853
  misc_feature (22)..(183): Pfam Name: NAD_binding_4 Pfam Description: Male sterility protein
  misc_feature: SWISSPROT Homolog: EC 1.2.1.31 L-aminoadipate-semialdehyde dehydrogenase
MMEGGMDAARIIGYLKGKSILITGSTGFLGKILVEKILRVQPHVHKMYLLVRAIDAQAAKHRVQQEVIGAELFGLLREKYGGEGFDSLIEDKIVPLAGDITREDLGLDAPTLRHLAKNMDVIVNIAATTNFYERYDVSLDVNVMGVKHLCQFAKQCANLKMLMHVSTAFVRAAFVSGDSAEAIP

SEQ ID NO: 41167 - DNA, 475 bp, Panicum virgatum
  misc_feature: Ceres CLONE 2006854
  misc_feature: Encodes the peptide sequence at SEQ ID NO. 41168
gactctgtcactttgatctaatcatatagaacgatgtcctcctcgtccagcaagatccgagcgttcgagcttcagtccaagaacaagcaggacttgctcactctcttgaacgagctcaagactgagctcgcttctttgcgagtccagaagatcgccggtggatccgccagcaagttgaccaagatcaacactgtccgaaagtccatcgctcgagtcctcaccgtcatcaaccaaaagcagaggcaaaacctccgagagttctacaagaactccaagtacatccccctcgacctccgatacaagaagacccgagctatccgacgacgactcaccttcaaggagaagaccgccatcaccgagaagcaacacaagaaggacatccacttccccgcccgaaagttcgctcttaaggcataagatggttggcttgtctgggtagaggagtctggtgcaggatgcatcggtgtatcatgac

SEQ ID NO: 41168 - protein, 127 aa, Panicum virgatum
  misc_feature: Ceres CLONE 2006854
  misc_feature (10)..(68): Pfam Name: Ribosomal_L29 Pfam Description: Ribosomal L29 protein
MSSSSSKIRAFELQSKNKQDLLTLLNELKTELASLRVQKIAGGSASKLTKINTVRKSIARVLTVINQKQRQNLREFYKNSKYIPLDLRYKKTRAIRRRLTFKEKTAITEKQHKKDIHFPARKFALKA

SEQ ID NO: 41169 - DNA, 489 bp, Panicum virgatum
  misc_feature: Ceres CLONE 2006861
  misc_feature: Encodes the peptide sequence at SEQ ID NO. 41170
gacaaagaccgacaaaatgcctcaggaaatcggcgatatcaagaagttcatcgagatctgccggcggggagacgcctcctctgcccggatcaagaagaacaacaagagccagcagatcaagttcaaggtccgctgccagaggttcctctacaccttggtcctgaaggactcggagaaggccgagaagctcaagcagagcctgccgcccaacctccagatcaaggacgtccccaagaggaacaagcagaaggcgacatgagttaatggatcctgaagggggaatgctggtccggcactgagcgcgggcactggcacgatggaggcacatgcatttgccggttcggcttggactgaactcacaaacggcgtctcggaatggggaatctaggaggaactggtgctttgcttgctatgattagcctcgaaggggcgatgtagttggcgaggttgccagaaatgaatcgcattcatcggctaaggcccaaactc

SEQ ID NO: 41170 - protein, 80 aa, Panicum virgatum
  misc_feature: Ceres CLONE 2006861
  misc_feature (2)..(71): Pfam Name: Ribosomal_L38e Pfam Description: Ribosomal L38e protein family
MPQEIGDIKKFIEICRRGDASSARIKKNNKSQQIKFKVRCQRFLYTLVLKDSEKAEKLKQSLPPNLQIKDVPKRNKQKAT

SEQ ID NO: 41171 - DNA, 575 bp, Panicum virgatum
  misc_feature: Ceres CLONE 2006863
  misc_feature: Encodes the peptide sequence at SEQ ID NO. 41172
ctctttttttgcttctcgaattcagtgcatttaaatatcatggctggtatcactgtcaaggacgttaactctcacgccttcatcaaggcttatgctgcctacctcaagcgtactggtaagctcgaggtccccaagtgggtcgatcttgtcaagaccggtaccttcaaggaactcgctccctatgatcccgattggtactttgtccgtgctgcttccgttgctcgtcacatctacatccgcaagtctgtcggtgttggtgctttgaacaaggttcacggtggtactgtcaaccgtggttctcgtccctctcaccacgtcaacgcttccggttccgtcaaccgtaaggtcctccaatctttggagaagatcggtgtcttggagaaggataagaagggtggccgtaagatcactcaagatggtcaaagagatttggatcgtatcgccatgacccttgccgaagagtctgacgaggagtaaactctttaatttgttttctcgtataaaattttcttcttttttatctcagtttaactttttacaaaaagatgaagaaataaatcaaagacatttacatt

SEQ ID NO: 41172 - protein, 145 aa, Panicum virgatum
  misc_feature: Ceres CLONE 2006863
  misc_feature (4)..(143): Pfam Name: Ribosomal_S19e Pfam Description: Ribosomal protein S19e
MAGITVKDVNSHAFIKAYAAYLKRTGKLEVPKWVDLVKTGTFKELAPYDPDWYFVRAASVARHIYIRKSVGVGALNKVHGGTVNRGSRPSHHVNASGSVNRKVLQSLEKIGVLEKDKKGGRKITQDGQRDLDRIAMTLAEESDEE

SEQ ID NO: 41173 - DNA, 558 bp, Panicum virgatum
  misc_feature: Ceres CLONE 2006866
  misc_feature: Encodes the peptide sequence at SEQ ID NO. 41174
tactggactctgattaattaacccggtttctgttctgatcgagcagggaggagcagctacgcggatcgaaggcgtgccggacggcggctacgcggcctggatggcgcaggagcagctcttcggcgacagcgcggccggcggcggcggcggcggcgcgcgggccagccgggagcggtgggtgccgcagatgatgtacggcggcccggagctggccgtggccggcagcaagcgctccagaaccgccgcggccccggcggcgtactcttactggtgatcccatcgaaccggcggaggacccgcggcggccgactcgccgtcgccgtcgccgtgccgcccgtattaagcaccggctggtgcactagcgtactctactcccagttttaactgtaactgaagttgtttccgggctcatttaccgccacaacttttttttacgctcttccgggcgtcctcgatcggatgaggatgcctgtgagcgttcgtgcctttttgacggggtgctggagggagggaagcctcctcctgcacctctgtatctctcctgttttttgctcggtg

SEQ ID NO: 41174 - protein, 57 aa, Panicum virgatum
  misc_feature: Ceres CLONE 2006866
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
MAQEQLFGDSAAGGGGGGARASRERWVPQMMYGGPELAVAGSKRSRTAAAPAAYSYW

SEQ ID NO: 41175 - DNA, 662 bp, Panicum virgatum
  misc_feature: Ceres CLONE 2006871
  misc_feature: Encodes the peptide sequence at SEQ ID NO. 41176
attcttttttttttttggggacgacgccggcgctattcttgcgagccacgaaagaacgaaacagatccgctgtttttgttttgttcttcctccctccgccgatcggatcgatggcgtccgccgccgccgggtcgtggtcgaagcgttggatccggcccgaggtgtggccgctcttcttcgcgacgggcacggccgtcggcatctgcgggatgcagctcatccgcaacatcaccggcaaccccgaagtcagggttctcaaggagaagagggctgccggcgtgctggagaaccacgaggagggggagaggtactcgcagcacggcttcaggaagttgatcgacggcaggaagcccgagatcatggagtccatcaactcgtggatggcggacccaaagtagatcgatccatctccgtctccatatacaccggcctgcaggtctgctaccggccgacggctgattatttggtcggccgcaaccatttaattcttgattgctattgttaccgtaatggtcttctcgatcggtactttttttttatcaacataaacatgtatctttaacaagaacaaacatgacagcatcatgttgacagcctggctggctgttaacaggcatatccttacaagttttgaattcgaataacttacgtcggtgccgggt

SEQ ID NO: 41176 - protein, 95 aa, Panicum virgatum
  misc_feature: Ceres CLONE 2006871
  misc_feature (10)..(95): Pfam Name: B12D Pfam Description: B12D protein
MASAAAGSWSKRWIRPEVWPLFFATGTAVGICGMQLIRNITGNPEVRVLKEKRAAGVLENHEEGERYSQHGFRKLIDGRKPEIMESINSWMADPK

SEQ ID NO: 41177 - DNA, 691 bp, Panicum virgatum
  misc_feature: Ceres CLONE 2006888
  misc_feature: Encodes the peptide sequence at SEQ ID NO. 41178
gcacagcaccaaccgactaaactgccaccgcccgccactgcacctacaaagacacagaggccgccggccagcctgagcctgttgtcgttccccatggcgcggctcgtgtcgacgccggcggcggtcgcggtggtggtggcggtgctcctcgcggcgtcgccggcggcgctggccgtgcacgactacggcgacgcgctccacaagagcatcctcttcttcgagggccagcggtccgggcggctgccgcccgaccagcgcctccggtggcgccaggactcgggcatccacgacggcgccgaggccggcgtggacctgacgggcgggtactacgacgccggcgacaacgtcaagttcgggttcccgatggcgttcacggcgacgctcatgtcgtgggggctgatcgacttcgggcgcagcttcggcgcgcgcgaggaggcggcggcgcgggaggccgtccggtgggcgacggactacctgatgaaggcgacggcgacgcccggcacggtgtacgtgcaggtgggcgacgcgtcccgcgaccacgcgtgctgggagcggcccgaggacatggacaccccgcgcaccgtgtacaaggtggacgccgcgcacccggggtcggacgtggccgccgagaccgcggcggcgctcgccgcgggctccctggtgttccgcggcgccgacccggcgtacgcgg

SEQ ID NO: 41178 - protein, 199 aa, Panicum virgatum
  misc_feature: Ceres CLONE 2006888
  misc_feature (30)..(199): Pfam Name: Glyco_hydro_9 Pfam Description: Glycosyl hydrolase family 9
  misc_feature: SWISSPROT Homolog: EC 3.2.1.4 Cellulase
  misc_feature: Functional homolog of the protein sequence given in SEQ ID NO 51275
  misc_feature: Useful for making plants with altered carbohydrate content
  misc_feature: Functional homolog of the protein sequence given in SEQ ID NO 51276
  misc_feature: Useful for making plants with altered cell wall content and/or composition
  misc_feature: Functional homolog of the protein sequence given in SEQ ID NO 51323
  misc_feature: Useful for biocontainment applications
  misc_feature: Useful for making plants with modulated nitrogen use efficiency
  misc_feature: Functional homolog of the protein sequence given in SEQ ID NO 51345
  misc_feature: Useful for making plants with altered lignin content
MARLVSTPAAVAVVVAVLLAASPAALAVHDYGDALHKSILFFEGQRSGRLPPDQRLRWRQDSGIHDGAEAGVDLTGGYYDAGDNVKFGFPMAFTATLMSWGLIDFGRSFGAREEAAAREAVRWATDYLMKATATPGTVYVQVGDASRDHACWERPEDMDTPRTVYKVDAAHPGSDVAAETAAALAAGSLVFRGADPAYA

SEQ ID NO: 41179 - DNA, 1430 bp, Panicum virgatum
  misc_feature: Ceres CLONE 2006904
  misc_feature: Encodes the peptide sequence at SEQ ID NO. 41180
ggtaacacgacaagtcatcagcccggccggtcgcttgtgacgctaccgtccagtcgaccaggcgcgcgcggcgaggcacgcaagttcaccggcgggcggcggcggctggtcgccgtcagcccgtgaacgcacgccgggccgtgcttcccgatttctatggcggctaaaactggtagcgaaccggtgcaggtggagtcggagggcgagctcgaggcggcggccgtgctgacgccgccgctggcgctggagggcggcctcgcggcggagctccgcccggcgaacctcgcccagcggatgctcagcctcttccgcaacgtcagcccgggatccgacctctcgcacttccagctgccggcgacgttcaacctgcccaagtcgcagctccagatgtacggcgagggcgtgtactgcgccggcgaggacctcctcgggcggtgcgcccggggcaaggacagcctggagcgcctcacggcggtggtggcctggagcatctccacgacgcggccccccatcttcgggttcgcgccctacaacccggtgctcggggagacgcaccacgtgtcccgcggccccctcaacgtcctcctcgagcaggtctcccaccgcccgcccgtctcggcgctgcacgccaccgacgccgccggggacgtgcgcctcgtctggtgccagagccccgtccccaggttccacggcgccagcatcgaggccgcggtgcgcggccgccgggagctgcgcctcgcccgccacgccgagcgctacgagctcgactgccccaacctgctcatccggctcctcccggcgccgtccgtcgagtgggccggcgacgtccgcgtcgtctgcgccgattccgggctcgaggcccagctcagctactgccggacccgctccttcctcggcttcggcggcgacgccaggtgcgtcaggggcaggatcttccgctcggcgtcgcgggacgagacgatctacgaggtcgacgggtcctgggacaggaccgtctcgctcaaggacgtcgccaccggcgaggtctccgtgctgtacgacgcccagcgagccattggtaacctcaccacgccggtcgttcaagaccacaagggcgtggcgccgtcggaatccgccgtggtgtggggcgaggtcagcgacgccctcctgaaggaggactgggagaaagcccggcaggcgaagcggcgggtggaggacgaggcgaggaagctcgccaaggagaggaacgacaaaggggaggtctggacgcccaagcacttctccctgtcgcagaacaagaacggcgagtgggagtgctggcccttggaggagtcggtgccgccggctcccattgtcgtcccttcatgacagtagagagagtacctgacatgtaacaagagttatgcgatcaacctgaatttcatggaaatttgtcactagttcattgtctt

SEQ ID NO: 41180 - protein, 396 aa, Panicum virgatum
  misc_feature: Ceres CLONE 2006904
  misc_feature (9)..(394): Pfam Name: Oxysterol_BP Pfam Description: Oxysterol-binding protein
MAAKTGSEPVQVESEGELEAAAVLTPPLALEGGLAAELRPANLAQRMLSLFRNVSPGSDLSHFQLPATFNLPKSQLQMYGEGVYCAGEDLLGRCARGKDSLERLTAVVAWSISTTRPPIFGFAPYNPVLGETHHVSRGPLNVLLEQVSHRPPVSALHATDAAGDVRLVWCQSPVPRFHGASIEAAVRGRRELRLARHAERYELDCPNLLIRLLPAPSVEWAGDVRVVCADSGLEAQLSYCRTRSFLGFGGDARCVRGRIFRSASRDETIYEVDGSWDRTVSLKDVATGEVSVLYDAQRAIGNLTTPVVQDHKGVAPSESAVVWGEVSDALLKEDWEKARQAKRRVEDEARKLAKERNDKGEVWTPKHFSLSQNKNGEWECWPLEESVPPAPIVVPS

SEQ ID NO: 41181 - DNA, 797 bp, Panicum virgatum
  misc_feature: Ceres CLONE 2006910
  misc_feature: Encodes the peptide sequence at SEQ ID NO. 41182
actttcttcctctccaccctccggccggccggccatgtcctaactcctagccagccacaagcctcacacaggcacccacattgctcaccaccgcagcaacagagcagcaaagaggcgagccatgatcacggcggtggacctgtaccacgtcctcacggccgtggtgccgctgtacgtggccatgacgctcgcctacggctccgtccgctggtggcgcatcttcaccccggaccagtgctccggcatcaaccgcttcgtcgcgctcttcgccgtcccgctcctctccttccacttcatctccaccaacaacccctacgccatgaacctccgcttcctcgccgccgacacgctccagaagctcgtcgtcctcgcgctcctcgccctcgcctcccgctgctggtccctcctcaccctcgactgggccatcacgctcttctccctctccacgctccccaacacgctcgtcatgggcatcccgctgctccggggcatgtacggccccgacgccgccggcacgctcatggtccaggtcgtcgtcctccagtgcatcatctggtacacgctcatgctgttcctcttcgagtaccgcgccgcgcgcgccctcgtcgtcgaccacttccccgacggcgccgccgcctctatcgtctccttccgcgtcgactctgacgtcatctcgctcgcgaagggcgacctggaggccgacgcccaggtcggcggcgacggccgcctgctggtcaccgtgcgcgagtccaccagctcgcgctccgaggccgccggctcccactcccactcgcatt

SEQ ID NO: 41182 - protein, 225 aa, Panicum virgatum
  misc_feature: Ceres CLONE 2006910
  misc_feature (9)..(224): Pfam Name: Mem_trans Pfam Description: Membrane transport protein
MITAVDLYHVLTAVVPLYVAMTLAYGSVRWWRIFTPDQCSGINRFVALFAVPLLSFHFISTNNPYAMNLRFLAADTLQKLVVLALLALASRCWSLLTLDWAITLFSLSTLPNTLVMGIPLLRGMYGPDAAGTLMVQVVVLQCIIWYTLMLFLFEYRAARALVVDHFPDGAAASIVSFRVDSDVISLAKGDLEADAQVGGDGRLLVTVRESTSSRSEAAGSHSHSH

SEQ ID NO: 41183 - DNA, 478 bp, Panicum virgatum
  misc_feature: Ceres CLONE 2006916
  misc_feature: Encodes the peptide sequence at SEQ ID NO. 41184
ttttcactttctgtcaagggtatgacccactctgcaacgatgaccccggctctgaggctgtggctagcatttctggctattggatcctgcatcgctgctgaccacatcgacttgtggccgatgccccacatggtgtcccatggaactcagaacctctgcctcaagaaagatatcacaacgtcaatggtgggaagcccctactctgaccatcactcagccctgaaggaccccttccagaggatggttgatttgatcacactaaaccacgtccgccatggaatgaaccccagttctttggttctcacctgtattaatatagttgtccataccactgaagatgagctccacttcggggccgacgagtcctataacttaacagttccaactgcaggagatccactgcatgcacaaattgaggctcaaaccgtttttggagcacttcatggcttacatacatttgggcagctgtgttactttg

SEQ ID NO: 41184 - protein, 146 aa, Panicum virgatum
  misc_feature: Ceres CLONE 2006916
  misc_feature (37)..(145): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
  misc_feature: Functional homolog of the protein sequence given in SEQ ID NO 51628
  misc_feature: Useful for making plants with altered carbohydrate content
MTPALRLWLAFLAIGSCIAADHIDLWPMPHMVSHGTQNLCLKKDITTSMVGSPYSDHHSALKDPFQRMVDLITLNHVRHGMNPSSLVLTCINIVVHTTEDELHFGADESYNLTVPTAGDPLHAQIEAQTVFGALHGLHTFGQLCYF

SEQ ID NO: 41185 - DNA, 1112 bp, Panicum virgatum
  misc_feature: Ceres CLONE 2006928
  misc_feature: Encodes the peptide sequence at SEQ ID NO. 41186
gacccagttccccacttttttctggcgaaccctgcacgcttccgccaccgcgtcggcgaccgcgatcccactagacccgacccccgacctcctcggcgtcgtgtatgcgcgtacgccggccgtgatcggatcggcgaaaggcaaagcccatggcggagccgacccttctcgcgccggccgcgccggactccttcggggacttctctttcgccgaatttcaggcgcctgttgatggcgccaatttcgccttcgaggacttcgatctggaggatctcgacctcgacgtggacttcgacctcgacctcttcgcctcggatgggccgctctcgcagccgccgccgctcgcgacctcatcttcctcggccgggtctccggaggggggatcgtcctcttccggcgccggcggggacggcgggttgaggaacgaggagccctcggaatcgtcttcgaggagcgcgatcggtacagatggcagcggtaaggggaaggcggaggacgacgaggcgaagcggcgcgcgcggctggtgcgcaaccgcgagagcgcgcacctgtcgcggcagaggaagaaacagtatgtggaagagctggagggtaaggtgaaggccatgcaggccaccatcgccgacctctccgccaggatttcctgcgtcaccgccgagaacgccgttctcaagcagcagttgggtggtgccgccggaaccgccccgccgccgccgccgctgccgatgtaccccgcggtgtaccctttgccgatgccgtggatgcatccagcgtacgccatgcgtggatcgcaggtaccactcgtgccaattcctcgcctgaaaccccagcagcctgcgcctgctacagcagagccaccggccaagaaggctaggaagaccaagaaggttgcaagtgttagcctcctggggttgctgtgcctcgtgatgctttgtgggtgtctgattcctgcagtaaatcggatgtatggcccatttgatggcggagaaggtgctgcatttggtccatctcatcatgggaaggtgctggctgttgaggggcctcgtgatactgtctcggatagtattgatcagaagccaccgcagagaacaagcgaggcacttccagcactg

SEQ ID NO: 41186 - protein, 320 aa, Panicum virgatum
  misc_feature: Ceres CLONE 2006928
  misc_feature (116)..(179): Pfam Name: bZIP_1 Pfam Description: bZIP transcription factor
MAEPTLLAPAAPDSFGDFSFAEFQAPVDGANFAFEDFDLEDLDLDVDFDLDLFASDGPLSQPPPLATSSSSAGSPEGGSSSSGAGGDGGLRNEEPSESSSRSAIGTDGSGKGKAEDDEAKRRARLVRNRESAHLSRQRKKQYVEELEGKVKAMQATIADLSARISCVTAENAVLKQQLGGAAGTAPPPPPLPMYPAVYPLPMPWMHPAYAMRGSQVPLVPIPRLKPQQPAPATAEPPAKKARKTKKVASVSLLGLLCLVMLCGCLIPAVNRMYGPFDGGEGAAFGPSHHGKVLAVEGPRDTVSDSIDQKPPQRTSEALPA

SEQ ID NO: 41187 - DNA, 1373 bp, Panicum virgatum
  misc_feature: Ceres CLONE 2006936
  misc_feature: Encodes the peptide sequence at SEQ ID NO. 41188
gccaggaaccggatcggaatggtcgtccctcccgccgccgcgccgcgccgcggatgcgatgccgccgccgccgcgcctgccgtcgctagcagccctagtcacccgccaccctcaccaactacccgcctccgcctccgcctccgcctcctatccctcagcctccacgctccctgcctaccgcgcgctcatccgcgacctcttctccgccggccgtctcgacgacgtcgacgccgccctcgactccgcgcgctcccgcctcgccccaggctccctccaaccgctctacgtgacctgcatccaagcctacgcccgcgccggccgcctccgtgccgccgtcgacaccttcgagcgcatggacctcttcggcagtccgcccgccaccccagcctacaacgccatcatggacgccctcgtcaacgccgcctaccacgaccaagctcacaaggtctacgtcaggatgctagccgccggcgttcctcccgacgcccgcacccacaccgtccgcctcaaatccttctgcctcaccggccgcccgcacgtcgcgctgcgcctgctgcgcaccttgccggagcgtgggtgtgactcccaacccgtcgcctactgcacggtcgtgcgggggttctatgccagcggccacggtcacgatgcacgtcgcctgttcgatgaaatgctcggcagggatgtcttccctgacgttgcctctttcaacaatgttttgcacgctctttgcctcaatggggatatcttcgagtctggggcacttctcgccaaggtcctcaagcgggggatgccggtaaacaagttcacctacaacatatggatccgcgggctctctgaaggcggcaggttgggagaggctgttgcgctcgtggaaaggatggactcccacattttgccagatgttgtcacctacaacacattgatacgtggcctttgtaagtactccaaggtctgggaagctgcacaatatcttcgtaggatgatcaaccggggctgcatcccagatgatttcacctacaacaccatcatcgatggctactgcaagaagggcatgctgcaggaagctactgagcttctgaaagacgctgtctttaaaggttttgtgccggaccgggtcacatactgctcgctgatcaatggactgtgtgctgagggtgatgttgagagggccctggagctctttagtgaggcacaagcaaaagatctgaagcctgaccttgtcgtctacaacacccttgtcaaggggctctgtcgtcagggtctgatcttgcatgccttgcagatcatgaatgagatggtcgaggatggctgccatcctgacatttggacatacaatattatcatcaacggactatgcaaaatggggaaatatt

SEQ ID NO: 41188 - protein, 438 aa, Panicum virgatum
  misc_feature: Ceres CLONE 2006936
  misc_feature (318)..(352): Pfam Name: PPR Pfam Description: PPR repeat
  misc_feature (388)..(422): Pfam Name: PPR Pfam Description: PPR repeat
  misc_feature (283)..(317): Pfam Name: PPR Pfam Description: PPR repeat
  misc_feature (353)..(387): Pfam Name: PPR Pfam Description: PPR repeat
  misc_feature (179)..(213): Pfam Name: PPR Pfam Description: PPR repeat
  misc_feature (109)..(143): Pfam Name: PPR Pfam Description: PPR repeat
  misc_feature (249)..(282): Pfam Name: PPR Pfam Description: PPR repeat
MPPPPRLPSLAALVTRHPHQLPASASASASYPSASTLPAYRALIRDLFSAGRLDDVDAALDSARSRLAPGSLQPLYVTCIQAYARAGRLRAAVDTFERMDLFGSPPATPAYNAIMDALVNAAYHDQAHKVYVRMLAAGVPPDARTHTVRLKSFCLTGRPHVALRLLRTLPERGCDSQPVAYCTVVRGFYASGHGHDARRLFDEMLGRDVFPDVASFNNVLHALCLNGDIFESGALLAKVLKRGMPVNKFTYNIWIRGLSEGGRLGEAVALVERMDSHILPDVVTYNTLIRGLCKYSKVWEAAQYLRRMINRGCIPDDFTYNTIIDGYCKKGMLQEATELLKDAVFKGFVPDRVTYCSLINGLCAEGDVERALELFSEAQAKDLKPDLVVYNTLVKGLCRQGLILHALQIMNEMVEDGCHPDIWTYNIIINGLCKMGKY

SEQ ID NO: 41189 - DNA, 257 bp, Panicum virgatum
  misc_feature: Ceres CLONE 2006936-R
cttatgtcatgccagcagaaaaaagaaagaatgctcaaaggaagagagcaccacatactgtcaaccatcacaactcacctaccaaacgtatgccttcaccaataaaatattggggtagacaaatgcaacatgctatgcaattgtttttgtgcattagtggtattcactgcatgatgcaactgatttagactactcagcttcctcaaccaatattgatgatactgatgatggaattgcctccaacaccccccccctcc

SEQ ID NO: 41190 - DNA, 733 bp, Panicum virgatum
  misc_feature: Ceres CLONE 2006957
  misc_feature: Encodes the peptide sequence at SEQ ID NO. 41191
gcttccgaggagagcgtagactacacaaaccacaccacctacttctaccatgggtaaggagaagactcacatcaacctcgtcgtgatcggccacgtcgatgccggcaagtcgaccaccaccggccacttgatctacaagtgcggcggtattgacaagcgtaccatcgagaagttcgaggctgaggccaaggagatgggcaagggctccttcaagtacgcctgggtgctcgacaagctgaaggccgagcgcgagcgtggtatcaccatcgacattgccctctggaagttcgagactgccaagtactacttcaccatcatcgatgcccccggtcaccgtgacttcatcaagaacatgatcactggtacctctcaggctgatgtggccatcctcgtgattgcctccggtgagggtgagttcgaggccggtatctcgaagaacggtcagacccgtgagcacgcccttcttgccttcaccctcggtgtgaagcagatgatcgtggtctgcaacaagatggacaacgtcaactggtccgaggatcgttacaacgagatccagcgtgaggtgtctggctacctgaagaaggtcggctacaacccccagaacattcccttcgtccccatctcgggcttccacggtgacaacatggtggacaagaccgacaagatgccctggtacaagggacccacgctccttgaggccctcgacgccatcaagccccccagcgccccatcg

SEQ ID NO: 41191 - protein, 227 aa, Panicum virgatum
  misc_feature: Ceres CLONE 2006957
  misc_feature (5)..(223): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINLVVIGHVDAGKSTTTGHLIYKCGGIDKRTIEKFEAEAKEMGKGSFKYAWVLDKLKAERERGITIDIALWKFETAKYYFTIIDAPGHRDFIKNMITGTSQADVAILVIASGEGEFEAGISKNGQTREHALLAFTLGVKQMIVVCNKMDNVNWSEDRYNEIQREVSGYLKKVGYNPQNIPFVPISGFHGDNMVDKTDKMPWYKGPTLLEALDAIKPPSAP

SEQ ID NO: 41192 - DNA, 684 bp, Panicum virgatum
  misc_feature: Ceres CLONE 2006959
  misc_feature: Encodes the peptide sequence at SEQ ID NO. 41193
gagcgaattcaattctcatgggggaagcgtagagcaaagggtggtgttaagatggatacacggttttacgagtccttcacattggataatgtgaaatattcactgtatgactgtgtctacttgtttaagcatggtgatcctgaaccatacattggaaaaatagtgaagatttgggagcaaaatcaggctaagaaagtaaaaattctttggtttttctttcctgatgagattcagaaatatttaagaggctctgtgatggaaaatgagatttttcttgcttctggtgatggtattgggcttgcagatgtcaacccactggaagctgttgctggaaaatgcactgttatatgcatttcaaaggatgagagaaatcgccaaccttcccctcgggaacaagcaatggctgattatatcttctatagggtcttcaatgttgaaaactgcaccctttctgatcagttgcctgataaaattgctgggttgggagtcgaggttctgctgaatccaaaagatgagttagtcatatccagtcctaacgcactgaatccaaatgctgatgatggtctggctgctacagcccctcctccccattcagcagttaaagaggagaatgaaagtccagatgctgcagttccactttcccagccagcagctaaggaggtggatgcaaagtcgcctgccgca

SEQ ID NO: 41193 - protein, 227 aa, Panicum virgatum
  misc_feature: Ceres CLONE 2006959
  misc_feature (31)..(155): Pfam Name: BAH Pfam Description: BAH domain
ERIQFSWGKRRAKGGVKMDTRFYESFTLDNVKYSLYDCVYLFKHGDPEPYIGKIVKIWEQNQAKKVKILWFFFPDEIQKYLRGSVMENEIFLASGDGIGLADVNPLEAVAGKCTVICISKDERNRQPSPREQAMADYIFYRVFNVENCTLSDQLPDKIAGLGVEVLLNPKDELVISSPNALNPNADDGLAATAPPPHSAVKEENESPDAAVPLSQPAAKEVDAKSPA

SEQ ID NO: 41194 - DNA, 278 bp, Panicum virgatum
  misc_feature: Ceres CLONE 2006964
  misc_feature: Encodes the peptide sequence at SEQ ID NO. 41195
cacagtggtcctaggtgggaagctaaggatgcatgtctccgcgggtctccagtactctcacgccacggccgagatgtggcagagcgtgattgtgaattgcaaggagggcggcgcggatgtgatcatgacatatatcttttcgaatgggcatgatctttccaaaggacattatcacgttgagggaatgtttgattttgtcaagtttgcgaatctgggtgctgctgatggtctatttctttttctgcgtatcggcccataagcttgagctgagtggaatt

SEQ ID NO: 41195 - protein, 85 aa, Panicum virgatum
  misc_feature: Ceres CLONE 2006964
  misc_feature: SWISSPROT Homolog: EC 3.2.1.23 Beta-galactosidase
  misc_feature: Functional homolog of the protein sequence given in SEQ ID NO 51319
  misc_feature: Useful for making plants with altered carbohydrate content
  misc_feature: Functional homolog of the protein sequence given in SEQ ID NO 51516
  misc_feature: Useful for making plants with altered cell wall content and/or composition
TVVLGGKLRMHVSAGLQYSHATAEMWQSVIVNCKEGGADVIMTYIFSNGHDLSKGHYHVEGMFDFVKFANLGAADGLFLFLRIGP

SEQ ID NO: 41196 - DNA, 663 bp, Panicum virgatum
  misc_feature: Ceres CLONE 2006982
  misc_feature: Encodes the peptide sequence at SEQ ID NO. 41197
gcacggcttccacccctccggcacagcacgcaagtacagcacaccaccagtcgaccagcgatagcgatcgcgtcgcactcgcacgcccctccgcggcatccgcagatcagatccccgcggcgtccatggccgggaacttcgagctccagggtcggcacggcaagtcccgcgtccgcgtctcccgcgtctggcgccgccccgccgcggcggggggccacgtcatcgtcgagtggagcgtcgccgtcagcgtcgtctccgactgcctcccctcctacacctccagcgacaactccgccatcgtcgccaccgattccatcaagaacaccgtttatgtcaaggcgaaggagtgcacggaagtggtgtccatggaggaattcgccgtgattcttgggaggcatttcacctccttgtaccctcaggtctcagaggctacggtgaccatcgtggagcgcccatgggagcgtgtggttgtcgacggaaagcctcattcgcacggtgagcaagattatcggttatccacttatccttgctgtcgtgattcgagatgaggaagagccttgaacgtctggataatgaatgtggtgtttctaaaaaaaactcgacctgcggggggcaagctgcccccgcggcattaaattaagaagaagacctcacacacacaga

SEQ ID NO: 41197 - protein, 140 aa, Panicum virgatum
  misc_feature: Ceres CLONE 2006982
  misc_feature (8)..(135): Pfam Name: Uricase Pfam Description: Uricase
  misc_feature: SWISSPROT Homolog: EC 1.7.3.3 Urate oxidase
MAGNFELQGRHGKSRVRVSRVWRRPAAAGGHVIVEWSVAVSVVSDCLPSYTSSDNSAIVATDSIKNTVYVKAKECTEVVSMEEFAVILGRHFTSLYPQVSEATVTIVERPWERVVVDGKPHSHGEQDYRLSTYPCCRDSR

SEQ ID NO: 41198 - DNA, 1832 bp, Panicum virgatum
  misc_feature: Ceres CLONE 2006985
  misc_feature: Encodes the peptide sequence at SEQ ID NO. 41199
cgaagttctccgcgccgcgcccaggctgctcttcctcacctcctgccgtcctgcgcgctccgccggcgctggaaagcgcggatccaccccgactccgactggtttctctctagctttggtttcaggatctcttgtagtcttctagatgactcgagcttctactattgattttggaaggaagaagcagagcgaactccttgggtcaggaccactgcgtccagtaaacatcatcagaaataaattccctaccttcaagaatggttcaaatgggatcattattaaattggtggatagcccagaaataccaactcttaaggaggctgttgccaaggagacaacggatctgcttgataagcatcagcgcctttcagtccgtgagctcaccatgaaatttgagaagggttttaatacagcaaccttgttatctaatgaggtgaaatggagacatgcggctttattggagcgagacatccttttgaagaatctaaaaagtgtactggagtcgctaagaagtcgagtagcaggcaaaaatagggatgaaattgaggaatctctatctatggtggatattttagcagttcagctgtccaaaagagaagatgagttacttcagcagaaagccgaggtcacaaaaatagcagcctcattgaaactggcttctgaagatgcaaagagaattattgatgaagaaagagctaatgctcggttggagatagaaaatgctaaaggtgctgcacagagagttcgattagcgcttaaagagcaagaaaatgtatctcaaggaattgggaagcagggtgtggatgaactgaaggaggaagtccaagaagcaaggagagtgaaaatgctgcattgtccaagcaaggcaatggacattggaaacgagattcaagttctccgtgatcaacttgctgaaaaatcctcagattctgttcaccttttaaaagagttggagctgcaccgacgatttgaggaaaatgatacgtccttgtatgagttagagggtcttgaaaccttaggttcaatgttgcacatagttgttcgggacaatccatcagtagatttttcaaatgcttcagtccagtggtttcgcatacagcctgaaggaagcaataaagaaatcatttcaggtgccacaaagccagtgtatgctccagaacctcatgatgttggacggtacatccaagctgaaatcaaatttggtggtcaaatctcaatcacaaagactgctggtccagtagaccctgctgcaggattggccgattatgtggaggctcttatgaggaatcctgaaactgagtataatgttgttgttcttcaattgaatggagttgctcagccggcagattctcttcatgttctttgcattgggagactgcggatgagacttgctaaaggaacatcggtcgttgccagggaattctattcctcgtcgatgcagctgtgtggtgttagaggcggtggagatgccgccccgcaagcaatcttttggcaaccgacaaaggagctcagctttgtgctggccttcgagacaaccagggaacgcaactctgcactcatgctcgcccggagattcgccacggattgcaatatcatccttgctgggccaggagacaaaactcagtggtaacgagcagcccgctctaacagcttcccggaatgtacatccctgcacatgcagtagttagatttctgatctgatctctgagtagttgattctttgagtctttagccactagttgcattgtacttgctggctccagctaccagcgctgtgtattatttctgcaactgaactcgtagtaccataaatctgaacgtgttttcactgc

SEQ ID NO: 41199 - protein, 494 aa, Panicum virgatum
  misc_feature: Ceres CLONE 2006985
  misc_feature: Functional homolog of the protein sequence given in SEQ ID NO 50332
  misc_feature: Useful for making plants with altered alkaloid content
  misc_feature: Useful for making plants with altered terpenoid content
MTRASTIDFGRKKQSELLGSGPLRPVNIIRNKFPTFKNGSNGIIIKLVDSPEIPTLKEAVAKETTDLLDKHQRLSVRELTMKFEKGFNTATLLSNEVKWRHAALLERDILLKNLKSVLESLRSRVAGKNRDEIEESLSMVDILAVQLSKREDELLQQKAEVTKIAASLKLASEDAKRIIDEERANARLEIENAKGAAQRVRLALKEQENVSQGIGKQGVDELKEEVQEARRVKMLHCPSKAMDIGNEIQVLRDQLAEKSSDSVHLLKELELHRRFEENDTSLYELEGLETLGSMLHIVVRDNPSVDFSNASVQWFRIQPEGSNKEIISGATKPVYAPEPHDVGRYIQAEIKFGGQISITKTAGPVDPAAGLADYVEALMRNPETEYNVVVLQLNGVAQPADSLHVLCIGRLRMRLAKGTSVVAREFYSSSMQLCGVRGGGDAAPQAIFWQPTKELSFVLAFETTRERNSALMLARRFATDCNIILAGPGDKTQW

SEQ ID NO: 41200 - DNA, 473 bp, Panicum virgatum
  misc_feature: Ceres CLONE 2006996
  misc_feature: Encodes the peptide sequence at SEQ ID NO. 41201
attaattttccgcgctgcgcttgtacacatctatccagctgagctcatctggatggtgtacgtctcttttgctggtctcgttgatggccgtcaccgccgcggcggtgctcctccagtacctcccgctgatgcgcggcggcctccccaagggcagcttcggctggcccctcatcagcgagaccatcgaattcctccacacaaacccgtccaacacctccggcagcttccacaaggagcacatcgccaggaacgggactgtgttcaagatcgcacctcttcggatcgccagcgatggtctcctgcgactaggagatcatccacttcatgctgctcaacgaggagcgcctgtacgagtgtaactaccccggcgccatccgcaacatcctcgggcagtcctccacgatggtggtcaccggcgagcgccaccggctgatccagagcgtgttcctcgccctcgtcgcctccactgggct

SEQ ID NO: 41201 - protein, 91 aa, Panicum virgatum
  misc_feature: Ceres CLONE 2006996
  misc_feature: SWISSPROT Homolog: EC 1.14.13.77 Taxane 13-alpha-hydroxylase
MAVTAAAVLLQYLPLMRGGLPKGSFGWPLISETIEFLHTNPSNTSGSFHKEHIARNGTVFKIAPLRIASDGLLRLGDHPLHAAQRGAPVRV

SEQ ID NO: 41202 - DNA, 542 bp, Panicum virgatum
  misc_feature: Ceres CLONE 2006999
  misc_feature: Encodes the peptide sequence at SEQ ID NO. 41203
acattcttcagcctccgcagccaaccggcccccacgatgctccaccgcgcgctttccggctccggccacgaccgccggccggtcgtcctcgacgtgctcgtcgatacctacaagaagaccgggagggtccgggacggcgccgaggttgtcctgctgatgaaggatctcggcttggcgcccagccttcgctgctgcaacgcgctgcttaaggacctgctgcgcgcggacgccatggatctgctctggaaggtgcgcggcttcatggagggcgccggtcttcgccggatgtgtacacgtactccacattgatcgaggcgtattgcaaagtccgggacttagatgctgcgaagaaggtgcttgaggaaatgcgtgagacgggatgcagcctgaacacagtaacctacaacatattgattgatggtctgtgcagagccggagctgttgaagaggcgtttgggttcaagaaggagatggagatttatgggctggttccagatggatttacttatggtgcaatcattaatggtctgtgcaagcgtgtc

SEQ ID NO: 41203 - protein, 58 aa, Panicum virgatum
  misc_feature: Ceres CLONE 2006999
  misc_feature (11)..(45): Pfam Name: PPR Pfam Description: PPR repeat
MRETGCSLNTVTYNILIDGLCRAGAVEEAFGFKKEMEIYGLVPDGFTYGAIINGLCKR

SEQ ID NO: 41204 - DNA, 321 bp, Panicum virgatum
  misc_feature: Ceres CLONE 2007000
  misc_feature: Encodes the peptide sequence at SEQ ID NO. 41205
accgccgcatcgaggggcggcggcggtggccagaccaatctacagggagcacaggcctggcgcgcgctgggatgggcgcgcaagtgcgcggcgcccttctcctctgtctcctgctcctggcgggggcggtggctcgccccggcgacgcagcgccgcatgaacccaattgcccgttcgcaggcgccggcgcggagggaagagcggcggtgggggtcaactccaactcggggctggtagcgctgctggactcgcactacatcggaactagcagatctggaggataaggcgctgctcctgcaaacgctccaagacgcacgtggg

SEQ ID NO: 41205 - protein, 70 aa, Panicum virgatum
  misc_feature: Ceres CLONE 2007000
  misc_feature: Functional homolog of the protein sequence given in SEQ ID NO 50622
  misc_feature: Useful for making plants with altered carbohydrate content
MGAQVRGALLLCLLLLAGAVARPGDAAPHEPNCPFAGAGAEGRAAVGVNSNSGLVALLDSHYIGTSRSGG

SEQ ID NO: 41206 - DNA, 708 bp, Panicum virgatum
  misc_feature: Ceres CLONE 2007005
  misc_feature: Encodes the peptide sequence at SEQ ID NO. 41207
caggatcaaatagttgtgaagaaaaacgtgaagagcaagaaaaatgaacagcccaaagaagataaggactgctttgcaacaaaggctcaaaagggccatgtagtgccaaaaccacttcctagcttcaagggttttgtcatagaagaggaggaagggtctggaggttacgggactgtttacagggctcggaggaaaagagatatatttgctataaaatgtcctcacccaaatgctcatccacaccatgttaacaatgaactaaagatgttggagcgttttggaggcaaaaactgtgtgattaaatatgaatgctctttgaaaagtggtgacctagagtgctttgttctagaacatgttcagcatgaccgaccagagattttaaaaaaggacataggtttgcttgagttgcagtggtatgggtactgtctgttcagagctctcgcaagcttacatagagagtgggtagtgcatagagatgtcaaacctgggaacttcctcttctgtcgcaaagtgatgagggggtatcttattgacttcaacctggcaaatgatctccaccagaagttcttgaaaaactgtaaatctgagacaatttcatgtgggaaggataccacatctcaaactgtatcaaaattcaccccagtagttcatgccacggaagcagctgctgattcaaagcaacctcttcctttgaaagaggaaaagatc

SEQ ID NO: 41207 - protein, 235 aa, Panicum virgatum
  misc_feature: Ceres CLONE 2007005
  misc_feature (45)..(229): Pfam Name: Pkinase Pfam Description: Protein kinase domain
  misc_feature: SWISSPROT Homolog: EC 2.7.11.1 Non-specific serine/threonine protein kinase
QDQIVVKKNVKSKKNEQPKEDKDCFATKAQKGHVVPKPLPSFKGFVIEEEEGSGGYGTVYRARRKRDIFAIKCPHPNAHPHHVNNELKMLERFGGKNCVIKYECSLKSGDLECFVLEHVQHDRPEILKKDIGLLELQWYGYCLFRALASLHREWVVHRDVKPGNFLFCRKVMRGYLIDFNLANDLHQKFLKNCKSETISCGKDTTSQTVSKFTPVVHATEAAADSKQPLPLKEEK

SEQ ID NO: 41208 - DNA, 712 bp, Panicum virgatum
  misc_feature: Ceres CLONE 2007009
  misc_feature: Encodes the peptide sequence at SEQ ID NO. 41209
ttcttgctcatcaccccctcccccaagccaacagcggcgaaggccccagtcagagcagagagagagagagagagagagagagagagagagaggagccttcttcctcctccccggctgccggtggcgagagatcgacgagcgagcgagcgagcgagatggtgctgtcccacggcgtcggcggcggctccgatgagtcggtgcactcgacgttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggaacccgagtgcgacaagctcatccaggcctccgtcaacaagaactacgtcgacatggacgagtaccccgtcaccaccgagctccagaaccggtgcgtgaacatgatcgctcatctgttcaacgcccctctcggggactccgaaactgccgtcggagtcggcaccgtcggctcctccgaagccatcatgctcgccggactggcgttcaagaggcgttggcagaacaagatgaaggccgccggcaagccctgcgacaagcctaacatcgtcaccggcgccaacgtccaagtttgctgggagaagttcgcgcgctacttcgaggtggagctcaaagaggtgaagctgagcga

SEQ ID NO: 41209 - protein, 185 aa, Panicum virgatum
  misc_feature: Ceres CLONE 2007009
  misc_feature (34)..(185): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Functional homolog of the protein sequence given in SEQ ID NO 50492
  misc_feature: Useful for making plants with modulated nitrogen use efficiency
MVLSHGVGGGSDESVHSTFASRYVRASLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLS

SEQ ID NO: 41210 - DNA, 693 bp, Panicum virgatum
  misc_feature: Ceres CLONE 2007010
  misc_feature: Encodes the peptide sequence at SEQ ID NO. 41211
actctccggggttcccagccaatggcggcctcctccccttcctccctcgccccgccggcggtgcccatggagctgcacgccggcaaccgcgtccgcctcgtcgccgcgctccgcggccacctctccgcctccgctcgcccgccacgcggcctcgtcctcctccagggcggggaggagcagacgcggtactgcaccgatcacctcgagctcttcaggcaggagagctactttgcctatctctttggagtgcgggagccagggttctacggcgcaatcgacattgcctctggacagtcaattttatttgctccaaggttgccagctgactacgctgtttggatgggtgaaataaaacccctgtcttacttcagggatacatacaaggtcgatatggtcttctatgttgatgagatcacacaggttgtgcaagatcgtttcggggatcatgggaagcctcttctattcctattatatggaaagaatactgactctgggaatttctcaaagcctactagttttgaggggatggagaagtttgatactgatttaagtacacttcatcctattttaactgaatgtcgtgtgatcaaatctgacctggagcttgccgtcatccaatatgctaatgatattagctctgaagctcacattgaggttatgagacaagcaagaccaggcatgaaggaatatcag

SEQ ID NO: 41211 - protein, 223 aa, Panicum virgatum
  misc_feature: Ceres CLONE 2007010
  misc_feature (14)..(158): Pfam Name: AMP_N Pfam Description: Aminopeptidase P, N-terminal domain
MAASSPSSLAPPAVPMELHAGNRVRLVAALRGHLSASARPPRGLVLLQGGEEQTRYCTDHLELFRQESYFAYLFGVREPGFYGAIDIASGQSILFAPRLPADYAVWMGEIKPLSYFRDTYKVDMVFYVDEITQVVQDRFGDHGKPLLFLLYGKNTDSGNFSKPTSFEGMEKFDTDLSTLHPILTECRVIKSDLELAVIQYANDISSEAHIEVMRQARPGMKEY

SEQ ID NO: 41212 - DNA, 1267 bp, Panicum virgatum
  misc_feature: Ceres CLONE 2007017
  misc_feature: Encodes the peptide sequence at SEQ ID NO. 41213
acgacccacttcctcgacccgaccggaccaaccaaaccctcccccgtcccctcacatcccaactcgttcgccggcggcggcaggagcaggagcaggagcagcagccatggcgccggtcgatccccactcctacaccgacggcgcgcacccggtggtgtcgcacgccgcgctcgccttctacctcgacttcgccgcctccaccatccacgcctctgcgctgctcaccctctccgcgccgcactccggcgacctcgtcctcgacacacgcgccctcgccgtccactccgccaccactgccgccgaaccgccggagcccatccccttctccctcgccgcggcccccgaccccgtcctcggctcggcgctgaccctcaccctgccccccgacaccacctccttccggctcaccttctccacctcccccgccgcctccgcgctgcagtggctggccccgccgcagaccgcctccgggcatcccttcgtcttctcgcagtgccagtccatccacgcccgctccatcttcccctgccacgacacccccgccgcgcgcatcaccttctcgcttctcctcaacgtcccctcgcagctctccgccgtcgccgccgcgcgccacgtcgcccgccgggacccgctgccatccgaccaccgcggtgcgtgcgacgacgagctgtggtgcgcacccggacgcatcgtcgaggagttccagatggagcagtccgtgccgccctacctcttcgcgttcgccgccggtgggatcgggttcagggacctcggcccgaggacgcgggtgtacgcggagggaggggacaaggtgctggacgaggcggcgagggagttcgccggggtggaggagatggtcaaggtaggggagtcgctgtttgggccgtatgaatgggagaggttcgatctgctcgtgctgcctccgagcttcccttatggaggcatggagaaccccaggatggtgttccttactccgactgtgatcaagggagacgctgcaggggctcaggttgtggcgcatgagcttgcgcatagctggactggcaatcttattactaacaagaccaatgaagatttctggctaaatgagggattcacaacatatgctgagaggaggattgttgaggtggtgcaaggggaggagcggggcacattaaacatgggaattggatggagggggttgaacagaatgatggagaggtttaaggataacatggagttccccaaattgaagccgaagatggcagggattgaccctgatggatgt

SEQ ID NO: 41213 - protein, 386 aa, Panicum virgatum
  misc_feature: Ceres CLONE 2007017
  misc_feature (16)..(381): Pfam Name: Peptidase_M1 Pfam Description: Peptidase family M1
  misc_feature: SWISSPROT Homolog: EC 3.3.2.6 Leukotriene-A(4) hydrolase
MAPVDPHSYTDGAHPVVSHAALAFYLDFAASTIHASALLTLSAPHSGDLVLDTRALAVHSATTAAEPPEPIPFSLAAAPDPVLGSALTLTLPPDTTSFRLTFSTSPAASALQWLAPPQTASGHPFVFSQCQSIHARSIFPCHDTPAARITFSLLLNVPSQLSAVAAARHVARRDPLPSDHRGACDDELWCAPGRIVEEFQMEQSVPPYLFAFAAGGIGFRDLGPRTRVYAEGGDKVLDEAAREFAGVEEMVKVGESLFGPYEWERFDLLVLPPSFPYGGMENPRMVFLTPTVIKGDAAGAQVVAHELAHSWTGNLITNKTNEDFWLNEGFTTYAERRIVEVVQGEERGTLNMGIGWRGLNRMMERFKDNMEFPKLKPKMAGIDPDG

SEQ ID NO: 41214 - DNA, 1805 bp, Panicum virgatum
  misc_feature: Ceres CLONE 2007022
  misc_feature: Encodes the peptide sequence at SEQ ID NO. 41215
aactaacgctaaaaaagtaacagtttctgtactttattgctaacccaccagtaccgccgtgtcagcggtctctgcctgaggttagtccgaccccgtgtttgtaaagccaaagcatattgcccccaccgggtgactccctccttgtttacacacaggcgccaaccagccattcacagcgaattccatcgtatgcgcgtgcgaagcccccagaacaccatgcgctcaccttccggatacgacgccgacaagaagaagttcttcaaccccattgcacgcaacacgaccaagatcgtgcttggtatcgtggtcgtcgggatcctgttattcctcatgcgatccgacatgaactggaacctgcccgtcggcgcccgcaaggccaactgtgcgctcttcgggaagcgctacggcttgatgctggatgcggggagcaccggcagccgcgtccacgccttcgagttcaactaccacgagaacggcgccgtcgagctcatcgacgagctgttcgagcaggtgaagccgggcctgtccgccttcgcgaacgacccgaagggcgccgcgcagtcgctgaagcctctgctcgacgcggcgatgaagaaggtgcccgcggccgccgcgccgtgcacgccgatcgagctcaaggcgacggccggcctgcgcctcgtcggtcaggagaagagcgaggcgattctcgcggcggtgctcgaactgttcaagcagtacccgttcagcgtcgcggggcccgacgcggccatcgtgatggacggcaaggacgagggcccgtacgcgtggatgactgtgaacttcctgctcgacacgatgaacacgcgcacgacggccaagaccgcggccatcttcgacatgggcggcgccagcacgcagatcgtattccgccccgacgacgatgccgtgatggccgccgtgaccgcggacaagacgtaccaggtgatcacggagggctacagcacgaaactctacacgcactcgcacctcggctacggcctgaagcaggcgaacaagctgatgatgaaggagtcgctcgctgagttcgacaaggtcttcccgtgcttcccgaagggcgtgtcggagaccgccgacggcgtcacggcggagaacgtcgcgggcgagcaaagcttcgagaagtgccagcgcctagccacgcgagtcctcttcaaggacaaggcgtgcagcagcctttcctgcagcttcaacggcgtcgatcagcccgtgctgtcgaagaccttcacgggcccgtactacgtcttctcgtatttctacgaccgcatggcggcgttcctcaacgcggacggcgtcagctccgtcggcgacctccgaaagatggccgagggcgtctgcgccggcgctgccgcgccgtacgcggagcacaacaagggaacgatgtgcatggacttgacgtatttgtacacactgctgcgcaccggctacgacctgcccgacgagacaacgctctacgtgaagaagaagatcaagggcatcgagacggcgtggtcgctgggcgctatgatggtggcgatgaaaccgaagcagtaaccttgctgcactgcgcagaatcggcagcggatggggcgcgtcgcttctcccttctcgccggccgatctgccgcacccctcacccaatacaatcaaagacatgcttcgagtcatcgtgaaaccttgtgcgatggaatgatgttcgtgtaaagctggcatggctataaacccccgctagaccttccgccaccacccttgctcccagcctcaacgccaagcgggcggtgacggttgatgctcgtgtgtaaatcacatctg

SEQ ID NO: 41215 - protein, 443 aa, Panicum virgatum
  misc_feature: Ceres CLONE 2007022
  misc_feature (61)..(443): Pfam Name: GDA1_CD39 Pfam Description: GDA1/CD39 (nucleoside phosphatase) family
  misc_feature: SWISSPROT Homolog: EC 3.6.1.42 Guanosine-diphosphatase
MRSPSGYDADKKKFFNPIARNTTKIVLGIVVVGILLFLMRSDMNWNLPVGARKANCALFGKRYGLMLDAGSTGSRVHAFEFNYHENGAVELIDELFEQVKPGLSAFANDPKGAAQSLKPLLDAAMKKVPAAAAPCTPIELKATAGLRLVGQEKSEAILAAVLELFKQYPFSVAGPDAAIVMDGKDEGPYAWMTVNFLLDTMNTRTTAKTAAIFDMGGASTQIVFRPDDDAVMAAVTADKTYQVITEGYSTKLYTHSHLGYGLKQANKLMMKESLAEFDKVFPCFPKGVSETADGVTAENVAGEQSFEKCQRLATRVLFKDKACSSLSCSFNGVDQPVLSKTFTGPYYVFSYFYDRMAAFLNADGVSSVGDLRKMAEGVCAGAAAPYAEHNKGTMCMDLTYLYTLLRTGYDLPDETTLYVKKKIKGIETAWSLGAMMVAMKPKQ

SEQ ID NO: 41216 - DNA, 1651 bp, Panicum virgatum
  misc_feature: Ceres CLONE 2007031
  misc_feature: Encodes the peptide sequence at SEQ ID NO. 41217
atcacagtgtccttcaacttgcattgatcttccttgacgctagccatcagctcgctctgctagcagctgccatgttttctcttcgtagttgtggtcggcaagtgtgccttgcctcctctactgcccctctgaatatagaccttcaccggtcggtgattgttggctcgtcgtggcagctgaacaaagacaaaggagaggaaccggggaggaggaggaggagccatccaccccacaagcgtcgtcgtgtcttccaccacccatgcggtagaggcgaggcggcggcgcagccgtgcgccgtggtgggtgaccgggtgacggtcctgaccatcgacggtggcggcatccggggcctcatcccgggcacggtgctcgccttcctcgaggcccggctgcaggaccgggacgggccggcggcgaggttggcggactacttcgactacatcgccgggacgagcaccggcgggctcatcacggcgatgctggccacgccggggaaggacgggcgcccgcgcttctccgccgacggtatcaaccccttctacctcaagcacggcccgcgcatcttccctcagaggtggagcagcctcgctgcttgcatcgccgcggcgaggggccccaagtacgacggcgagtacctccgggccttgatccgggagaagcttggcgagaagagggtgctcgacacgctcaccaatgtcgtcatccccaccttcgacgtcaagctgcagcagcctatcatcttctccacatacgacgccaaggtcacgccttcgaagaatgcgctgctatctgatgtctgcatcggcacgtcggcggctccaacctatctcccagcacactacttctgcaccaaagatgccaacagagaacagcgcgaatacaacctcatcgacggtggtgttgcggccaacaatccgacgatggttgccatgacgatgatcacggaagagatcatggccaggaaagaggacgcgcaccagtacctgaccaggacgatggaggagaactgcggccggttcctggtgctgtccatcggcaccggcctgaggtccgaggaggagcagtacaccgcggaggcctgctccaggtggggcatcctcgggtggctgcacaaggggggcatgaagcccatcattgacttcttcatggccgccagctccgacctcgtcgacatccacgtcgccgccaagttcaagctgttccgcagcgagagcaactacctccgcgtccaggacaacacgctcggcggcaccgccgcggcggtggacgtggcgacgccggagaacatggggaacctcgtcgggaccggcgagaacctgctgaggcagcaggtgtcgagggtcaacgtggacaccggcaagtacgaggtggtgccgggtgagaggaccaacgcgcaagctctcgacgacctggcgaagcagctctccgaggagaggaaggcgaggctccggcaagggaaggctgtgccaggccgtggcgtcggtgcggcgcggtagggaatgccgatggctcataaattagttattagtccatcttcttagcttaataatttatttctaaaatattttgatagggtgtgcgtttagatatcgcagaagatgacataggttttgtttgtataccagggttagagttaaatttgaatttttgg

SEQ ID NO: 41217 - protein, 474 aa, Panicum virgatum
  misc_feature: Ceres CLONE 2007031
  misc_feature (84)..(287): Pfam Name: Patatin Pfam Description: Patatin-like phospholipase
  misc_feature: SWISSPROT Homolog: EC 3.1.1.5 Lysophospholipase
  misc_feature: Functional homolog of the protein sequence given in SEQ ID NO 51529
  misc_feature: Useful for making plants with modulated heat sensitivity
MFSLRSCGRQVCLASSTAPLNIDLHRSVIVGSSWQLNKDKGEEPGRRRRSHPPHKRRRVFHHPCGRGEAAAQPCAVVGDRVTVLTIDGGGIRGLIPGTVLAFLEARLQDRDGPAARLADYFDYIAGTSTGGLITAMLATPGKDGRPRFSADGINPFYLKHGPRIFPQRWSSLAACIAAARGPKYDGEYLRALIREKLGEKRVLDTLTNVVIPTFDVKLQQPIIFSTYDAKVTPSKNALLSDVCIGTSAAPTYLPAHYFCTKDANREQREYNLIDGGVAANNPTMVAMTMITEEIMARKEDAHQYLTRTMEENCGRFLVLSIGTGLRSEEEQYTAEACSRWGILGWLHKGGMKPIIDFFMAASSDLVDIHVAAKFKLFRSESNYLRVQDNTLGGTAAAVDVATPENMGNLVGTGENLLRQQVSRVNVDTGKYEVVPGERTNAQALDDLAKQLSEERKARLRQGKAVPGRGVGAAR

SEQ ID NO: 41218 - DNA, 1395 bp, Panicum virgatum
  misc_feature: Ceres CLONE 2007035
  misc_feature: Encodes the peptide sequence at SEQ ID NO. 41219
gccagtcgcgagccgcagctccgcgtcgcgtcgcatcccccctccctcgtcgtcttcctcgcccccgccccgcgcccccagctagacacaccgtaccgccaggtgaacccgcgcgcctcccctctcccctcccgcgcccagatcccgaggccccgccccctcgatcgctcgcccccgccggcggatccggctcccgattcgcggggggcccgcggcaggtttttgctttatgctggttcatgtgtccacagacaatggactaattgctgacctgtctctgtgattcaccatgggaagcagtggagctgatacaccgtctaagacaagcaaggcgtctgcctcacaggaacaacagccacctgctacctcaggtgctgcaacaccggctgtttacccagattggtccagcttccaggcatatcctccaatcccaccacatgggttcttcccttcacctgtggcatcaagtccacagggtcatccttacatgtggggagctcaacctatgatcccaccatatggaacaccgccgccgccatatgtcatgtaccctcctggagtatatgctcacccgtctatgcccccgggtgcacatccattcactacttatgctatgacttctccaaatggctatgctgatgctactggaactactgcagcagctggtgatactgacaggaagccctctgaaggcaaagacaaaagtccaacaaaaagatccaaaggtagtttaggtagcttgaacatgcttactgggaagaatcctaccgaacatggtaagacctcaggagcatcagctaatggagccacttctcaaagtggggaaagcggtagtgaaagttcaagtgaagggagcgaaggaaattctcagaatgattcacatcacaaggaaagtggacaggaacaggatggagatgttcgaagttcccagaatggtgcatcacgctcaccatctgagggaaaattgaaccagactatggcaatcatgccaatgccatcaagtggctcagtacctggtccaactacaaacctcaatatagggatggattattgggccaacacagcaagctccgctcctgcaattcatggcaaagtgaccccgacaacagttacaggtgctgtggtcccagccgagcagtggatacaggatgaacgcgaactcaaaaggcaaagaaggaagcagtccaacagggagtcggcacgcagatctaggttgcgtaaacaggctgagtgtgaagagttagctcaacatgctgatgttttaaagcaggaaaatgcttcacttagagatgaagttaaccgtatcagaaaagagtacgaagagcttctatcaaagaataactcactaaaggaaaaaactcgaggcaaacagcacaaaactgatgaggcaggact

SEQ ID NO: 41219 - protein, 368 aa, Panicum virgatum
  misc_feature: Ceres CLONE 2007035
  misc_feature (1)..(197): Pfam Name: MFMR Pfam Description: G-box binding protein MFMR
  misc_feature (288)..(351): Pfam Name: bZIP_1 Pfam Description: bZIP transcription factor
  misc_feature: Functional homolog of the protein sequence given in SEQ ID NO 51160
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MGSSGADTPSKTSKASASQEQQPPATSGAATPAVYPDWSSFQAYPPIPPHGFFPSPVASSPQGHPYMWGAQPMIPPYGTPPPPYVMYPPGVYAHPSMPPGAHPFTTYAMTSPNGYADATGTTAAAGDTDRKPSEGKDKSPTKRSKGSLGSLNMLTGKNPTEHGKTSGASANGATSQSGESGSESSSEGSEGNSQNDSHHKESGQEQDGDVRSSQNGASRSPSEGKLNQTMAIMPMPSSGSVPGPTTNLNIGMDYWANTASSAPAIHGKVTPTTVTGAVVPAEQWIQDERELKRQRRKQSNRESARRSRLRKQAECEELAQHADVLKQENASLRDEVNRIRKEYEELLSKNNSLKEKTRGKQHKTDEAG

SEQ ID NO: 41220 - DNA, 686 bp, Panicum virgatum
  misc_feature: Ceres CLONE 2007035-R
ggagatcgtagagaagatgtgctcaaggattggttttcagccaaaggtagctctggtgctacagaagttggagcagcatagcgagtgcaagtcgctgcttttactttccgtgctgctgttggccttatgactccgtttattccatggcacctgaatgattcccctgagtggcagagatcaggactagtgagctcgatgccgttgaaatagagcttctgatgcctgctgctggtcactgtgattgtgtctcctgagtggcgggtgggaactaccgttccatcgggaagccttatgagatcattgaacttcagaggcgccgcgatggaatgcctggacaagaactctagcacctggttttgggagattgatgccgtggacatcagcctgtcgctgggcatcaggaaggtggtgttgcgcggtatcttctcctgcaccatcctgacgagcatgacaaaggtgaagtagcgcgcctgctgcatctcctgcaccgtgttggcgatgtcactgctgactgtctgcggggaaggtatggctgcagtggtggtgctggaagcggacaccatttgagcgatgagcaggctcattgttgcaaggaaggtggatgccgtggtgtaaatgggtaagcaagtcatgactgttgagataactatttgctccctgattctcaagcgggttgctttattacc

SEQ ID NO: 41221 - DNA, 706 bp, Panicum virgatum
  misc_feature: Ceres CLONE 2007052-R
  misc_feature: Encodes the peptide sequence at SEQ ID NO. 41222
attaatcaatcacaggggcgcctccgttattgttggagcaatatctgcctgaatatgttcactttggactttttgaaccaagtggcaaacagccttgaaaaggacagtgtatatcatctagctgagaagaagattccttccatccatgggtatacaacgggcctgaagcttgaacagtttatattcgatgctttcacttactccccatccacagcactttttgaggtcttgcgggaagaggaatttgcaccagtaaagaatgccaacggcgcaacatatgacactcctgatagcgcgaaactcatgctgctccgtctccatagcagatgggttgttgctgcaggcggcttcttgacgcattctgtgcccttgtatatgacaggcgttgaagtttctccactttcctcctacgctggggagaacctggaagccatatgccgtgggcgaacattccatgcgccgagcgagatatcattttagatagggctgttcatgacagcaaaagccgaatgcaaaggattgatgtggatggccaggttgttgtacacttgtatgttttgtgtgttgtgtaacgtagcccttggatttcgaactcatcgcgagttttcccccgcatactttttgtagcgccagctcatggccagggacctgctgatcatagtccctgttcaaaacaggacgaccgtatacatttcacaggctgatc

SEQ ID NO: 41222 - protein, 159 aa, Panicum virgatum
  misc_feature: Ceres CLONE 2007052-R
  misc_feature: SWISSPROT Homolog: EC 2.7.7.23 UDP-N-acetylglucosamine diphosphorylase
INQSQGRLRYCWSNICLNMFTLDFLNQVANSLEKDSVYHLAEKKIPSIHGYTTGLKLEQFIFDAFTYSPSTALFEVLREEEFAPVKNANGATYDTPDSAKLMLLRLHSRWVVAAGGFLTHSVPLYMTGVEVSPLSSYAGENLEAICRGRTFHAPSEISF

SEQ ID NO: 41223 - DNA, 736 bp, Panicum virgatum
  misc_feature: Ceres CLONE 2007052
accggcgatccgagaacaatccgttgtccgagttggcatctttggccaaaccaccagtatcattgcccaatcacagatctccccccctctctctaatctctgtttgcctgtgtttagatccgcaaaaagatagtaaaaagagtcacatcggaacatcggatattgtagcatactatagcacttttcatttgtttgtggtaaatattgtactatcataggctaactaggctcaaaagattcgtctcgcaacgtacatcaaaactatacaattagttttttttatttacccacattcagtactctatgcatgaaacaataaatttgatgtaatagaagaacagtgaagtttggagaaaaagattttgtaactaaacacacagccctttctcgccttctccctctcatctcccactacctgctcccgctgctttgcttgtgcgctgcgaggggagagaggagacgagatgaaggaggagatggtggtgggcttgtcggcgccggggcccgtggggaggtggggcgccgcgccgccgcaggcgctgctggagaggatgaaggactacgaccaggaaggcgccttcgcgctctgggacgatctctcgcccgaggaccgggagctcctcgtccaggacatcgagagtatagatctttcaaggatcgatcggatcattcgacgctcacttggatcacaaggcatgccgcttccggccgtggagcccgtgccagaatctagtgt

SEQ ID NO: 41224 - DNA, 732 bp, Panicum virgatum
  misc_feature: Ceres CLONE 2007058
  misc_feature: Encodes the peptide sequence at SEQ ID NO. 41225
acacagctgccgccaccgccactcttcgctctcgcaaaagctagcgcgagtccatggcggcgtcggcggcgtctccgcgcaccgcagcgcctcctcctcggcgcctcctcgcgctctcgctgctgcttccgctgctcgtgctccccgccgccaccaatgcgcaccccgtgacgacgacgccggcgccggcggcgaaggcgaaggcacgggaggcgggcgtctcggcggggctggtctccacgctgcgcgagacgctggacgcgatcaggagcgtggcgggcatcatctcggcgttccccgtcggcggcatcctcggcggcggcgacatccgcctctcctccgccgttgccgactgcctcgacctcctcgacctctcctccgacgagctctcgtggtccatgtccgccacctcggcggcgaccgccggcgccgggggaggagcaggcggccgcctcggcaccggcgacgccagctccgacctccggtcctggctgagcggcgcgctcgggaaccaggacacctgcaaggagggcctggacgcgaccggctcggtcctcggctcgctcgtcgccacggggctccaggccgtcacgtcgctcctcgccgacggcctgggccaggtcgccgccgcgggcgaggacgccgccgccttgtacccgccgtcctcccgccgcggcctcctcggcggcgcccggcccccgcggggctgcgcgcgagggagcggcggctgct

SEQ ID NO: 41225 - protein, 226 aa, Panicum virgatum
  misc_feature: Ceres CLONE 2007058
  misc_feature (33)..(189): Pfam Name: PMEI Pfam Description: Plant invertase/pectin methylesterase inhibitor
  misc_feature: SWISSPROT Homolog: EC 3.1.1.11 Pectinesterase
  misc_feature: Functional homolog of the protein sequence given in SEQ ID NO 51150
  misc_feature: Useful for making plants with altered carbohydrate content
MAASAASPRTAAPPPRRLLALSLLLPLLVLPAATNAHPVTTTPAPAAKAKAREAGVSAGLVSTLRETLDAIRSVAGIISAFPVGGILGGGDIRLSSAVADCLDLLDLSSDELSWSMSATSAATAGAGGGAGGRLGTGDASSDLRSWLSGALGNQDTCKEGLDATGSVLGSLVATGLQAVTSLLADGLGQVAAAGEDAAALYPPSSRRGLLGGARPPRGCARGSGGC

SEQ ID NO: 41226 - DNA, 1216 bp, Panicum virgatum
  misc_feature: Ceres CLONE 2007068
  misc_feature: Encodes the peptide sequence at SEQ ID NO. 41227
ataggagatagagaggggtggacaagtttagctagctggaagagacgccatgggagaagaggagcgaagaaactgcaatggacggaaggaggggaggaagaagagcaagtatgctgtagcgtgctccattgttggctctatcatctccatcctaatgggctacgataccggtgtgatgagcggcgcgatgctgttcatcaaggacgacctcaagacgaacgacacgcaggttcaggtcctcggcggcatcctcaacatctgcgccatcgtcggctccctcaccgccggccgcgtctctgactgggccggacgccgccgcaccatctccttctcggcttgcatcttcttcgtgggttccgtcctcatgggcctggcccccaacttcgccacgctcctggtcggccgctgcgtcgcgggcgtcggcgtcggctacgcgctcatgatcgcacccgtctacgcggccgagatcgcctccgcggagtcccgcggcgcgctcagctcgctccccgacatctgcatcagcctccgcatcctcctcggttacgtggccaactacctgctcgccaagctgcctctggtctacggctggcgcgccatgctggggctcggcgcgctcccgagcgccgcgctcgcggtcggcgtgttcgcgatgcccgagtcgccgcggtggctcgtcatgcagggacgagccgaggaggcgctcgccgtgctccggcgcgagtgcgaaacggagaacgaggcgcaggtgcggctcgcggagatcaagagcgcggccgggctcgccgttgactccgccctgagcgtggccgcgccgaaaagcagcggggagggcgtgtggaaggagctgttcgtgcacccgacgccgcccgtgcggcgcatcctggtggcagccctgggcgtgcacttcttcaatcacctgacgggcatcgaggccgtgctgctgtacagcccgcgcatcttcaaggccgccggcatcgcgacccggaacgaggtcctcgcggcgaccgtcggcgtgggcgtgaccaagacggtgttcatcctggccgccatcctgctcgtggaccgcatcggccggcggcgcctctacctctccagcctggcgggcatcatcgcgtcgcttgcctgcctcgggctcgggctcaccgtcgtcgagcgctcggcgccgcaccacgcggcgcagtgggcggtggtgctggccatcgccacggtgttcacc

SEQ ID NO: 41227 - protein, 388 aa, Panicum virgatum
  misc_feature: Ceres CLONE 2007068
  misc_feature (25)..(388): Pfam Name: Sugar_tr Pfam Description: Sugar (and other) transporter
MGEEERRNCNGRKEGRKKSKYAVACSIVGSIISILMGYDTGVMSGAMLFIKDDLKTNDTQVQVLGGILNICAIVGSLTAGRVSDWAGRRRTISFSACIFFVGSVLMGLAPNFATLLVGRCVAGVGVGYALMIAPVYAAEIASAESRGALSSLPDICISLRILLGYVANYLLAKLPLVYGWRAMLGLGALPSAALAVGVFAMPESPRWLVMQGRAEEALAVLRRECETENEAQVRLAEIKSAAGLAVDSALSVAAPKSSGEGVWKELFVHPTPPVRRILVAALGVHFFNHLTGIEAVLLYSPRIFKAAGIATRNEVLAATVGVGVTKTVFILAAILLVDRIGRRRLYLSSLAGIIASLACLGLGLTVVERSAPHHAAQWAVVLAIATVF

SEQ ID NO: 41228 - DNA, 1420 bp, Panicum virgatum
  misc_feature: Ceres CLONE 2007071
  misc_feature: Encodes the peptide sequence at SEQ ID NO. 41229
acacaaacacacgcccacactccccagtgcttaagctaagcaccaaatcacacgcctcgtgtcgaccagcgaacaccagggcaggcacgaactgcgctagctagcaagcacacacgcacgcactacgcactgcagtgccatgccggaagcaccgacccccaagacaaccccgccggcctgcggcttcgcccccggtgcccaccgcgaggcgctcgagttcatcgagcatgtcacggcgaacgccgggcaggtgcagcgacgcgtcctcgccgagatactggcgcagaacgcgccggccgagtacctgcgccggcacggcgtctccgggaccgcgggcgacgccgtcgaagccttcctccgtctcgtcccgctcgtcacctacgagggcctccagccggacatactccgcattgccaacggcgatacctcgccgatcctctccggcaaacccatctccgagttcctcacaagctccggcacgtccggaggggagaggaagctgatgccgaccatcgccgacgagctggacaggaggtcgctgctgtatagcctgcagatggcggtgatgagccagtcggtgcccgggctcgacaagggcaagtccatgtacctgctgttcgtgaaggcggaggcgcgcacgccgggcgggctcgcggcccggccggtgctgacgagctactaccggagtcggcagttcctggagcggccgcatgacccctacaccgactacacgagccccaacgaggcgatcctgtgcgtggactcgtaccagagcatgtacgcgcagctgctgtgcggcctcgtccaccgcgccgacgtgctgcgcgtcggcgccgtgttcgcctcaggcttccttcgcgccatacgcttcctcgagaagcactggccgcgcctgtgccgcgacatccgcgcgggcgccctcgacccggagatcaccgaccgcgccgtgcgcgacgccgtcgggagggtgctgcgcgccgacccggcgctcgccgacgagatcgaggccgagtgcgggagggcgtcgtgggagggcatcatccggcggctgtggccccgcaccaagtacatcgacgtgatcgtgaccggcgccatgtcgcagtacatcccgacgctggagttctatggcggcggcctgccgctcgcgtgcaccatgtacgcctcctccgggtgctacttcggcctcaacctcaagcccatgtgcaagccgagcgacgtcgcctatacgctcatccccaccatgtgctacttcgagttccttcctctccgctgcagcaacgccaagcaggccgagccgagccaccgcgacctggtcggcctcgtcgatgtgaagcttgggcacgagtacgagctcgtggtcaccacttactccggtttgtgtcggtatcgcgtgggcgatgtgctgcgggtggcggggttc

SEQ ID NO: 41229 - protein, 426 aa, Panicum virgatum
  misc_feature: Ceres CLONE 2007071
  misc_feature (23)..(426): Pfam Name: GH3 Pfam Description: GH3 auxin-responsive promoter
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
MPEAPTPKTTPPACGFAPGAHREALEFIEHVTANAGQVQRRVLAEILAQNAPAEYLRRHGVSGTAGDAVEAFLRLVPLVTYEGLQPDILRIANGDTSPILSGKPISEFLTSSGTSGGERKLMPTIADELDRRSLLYSLQMAVMSQSVPGLDKGKSMYLLFVKAEARTPGGLAARPVLTSYYRSRQFLERPHDPYTDYTSPNEAILCVDSYQSMYAQLLCGLVHRADVLRVGAVFASGFLRAIRFLEKHWPRLCRDIRAGALDPEITDRAVRDAVGRVLRADPALADEIEAECGRASWEGIIRRLWPRTKYIDVIVTGAMSQYIPTLEFYGGGLPLACTMYASSGCYFGLNLKPMCKPSDVAYTLIPTMCYFEFLPLRCSNAKQAEPSHRDLVGLVDVKLGHEYELVVTTYSGLCRYRVGDVLRVAG

SEQ ID NO: 41230 - DNA, 623 bp, Panicum virgatum
  misc_feature: Ceres CLONE 2007071-R
  misc_feature: Encodes the peptide sequence at SEQ ID NO. 41231
ggcagcacggccgtgccggcgtccgtgttcgaggactgctgcctggcggtggaggaggccctgaacagcgtgtaccggcagtgccgggcctgcgacaggtccatcggccccctcgagatacgcgtcgtctccgagggcaccttcgacaagctcatggactacgccatcagccgcggcgcgtccatcaaccagtacaaggcgccgcggtgcgtgcgccccggcccggtggtggagctgctcgacgcgagggtgcagggcaagtacttcagccccaagtgccccaagtggagccccgggaacaagctatggagcaacgccagggaggcctgaatcctgatgatcgatcgtggtacgatctgaattttcagaggcagggagaggatagctatatggaatgatgatgacttagggtatctgctatgatcatttgatttttggttccttttctctccatctttgtaatatgtctcgtgttccttcagctcgtgtattttgctatgcacttagtgcatgtcaattacatatactaaattatgtttactctgttagtagtataggggtcggaatggatttttatgctgtgtcaaattgaactatgaggattaatgtccagtatttttccc

SEQ ID NO: 41231 - protein, 109 aa, Panicum virgatum
  misc_feature: Ceres CLONE 2007071-R
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
GSTAVPASVFEDCCLAVEEALNSVYRQCRACDRSIGPLEIRVVSEGTFDKLMDYAISRGASINQYKAPRCVRPGPVVELLDARVQGKYFSPKCPKWSPGNKLWSNAREA

SEQ ID NO: 41232 - DNA, 1408 bp, Panicum virgatum
  misc_feature: Ceres CLONE 2007084
  misc_feature: Encodes the peptide sequence at SEQ ID NO. 41233
tgacgccactcccctcccctcccctcccctgccccctcacttcaaattgattcggcgctagggaccagtaaggccaaggcagcatccagcaatagcagcagcagcgacatccccttgtcttcctcctccagtcctgggcctcatgaggacccaaagaagccaccttggcctcctcttcctcctgtcctctgcgctgctcgccgtctccttcgcgcaggagcgcaagaactatgtggttcatctcgagccgagagaggacggcagcaccgattcagtcgaggagtggcaccggtccttcctgccggagtccacgctggactcggcgagcgacgacggccccagaatcatacactcgtacagccacgtgctgaacgggttcgccgcccgcctcaccgacgcggaggcggagagtctcaggaacagggaggggtgcctgcgcctgtaccccgaggagttcttgccgcttgcaaccacccactcgccggggttcctcggcctccacctcggcaaggacggcttctggagccgctccgggttcggccggggcgtggtgattggggtcttggacaccgggatcctgcccagccacccgtccttcggcgacgccggcctgccgccgccgcccaagaagtggaagggcacctgcgagttcaggtcgatcgccgccgccggctgcaacaacaaggtcattggcgcgcgcgccttcgggagcgccgccatcaacaacaccgccccgcccgtcgacgacgcgggccacggcacgcacacggcgagcacggcggcgggcaacttcgtccagaacgccggcgtgcgcgggaacgcgcacggcacggcgtccgggatggcgccgcacgcgcacctcgccatatacaaggtgtgcgcccggagccgctgctccatcatggacatcatcgccggtctggacgccgccgtcaaggacggcgtggacgtgctctccttctccatcagcgcgaccgatggcgcgcagttcaactacgacctcatcgccgtcgccacgttcaaggccatggagcacggcatcttcgtcagcgccgccgccggcaatgacggccccgtcgccggcaccatccggaacggcgcgccgtggatgctgacggtggcggccggcaccatggaccgcgcgatccgcaccagcgtgaggctcggcaacgggcaggagttggacggcgagtccctgttccagccccggaacaacaccgccgggcgccagctcccgctcgtgttcccgggccgcaacggcgacccggacgcccgcgactgcagcacgctggtcgaggcggaggtgcgcggcaaggtgggtctctgcgagagccggtcgatcagcgagcacgtcgagcaggggcagatggtgtcggcttacggcggcgccggcatgatcctgatgaac

SEQ ID NO: 41233 - protein, 421 aa, Panicum virgatum
  misc_feature: Ceres CLONE 2007084
  misc_feature (28)..(109): Pfam Name: Subtilisin_N Pfam Description: Subtilisin N-terminal Region
  misc_feature (116)..(373): Pfam Name: Peptidase_S8 Pfam Description: Subtilase family
  misc_feature: SWISSPROT Homolog: EC 3.4.21.25 Cucumisin
MRTQRSHLGLLFLLSSALLAVSFAQERKNYVVHLEPREDGSTDSVEEWHRSFLPESTLDSASDDGPRIIHSYSHVLNGFAARLTDAEAESLRNREGCLRLYPEEFLPLATTHSPGFLGLHLGKDGFWSRSGFGRGVVIGVLDTGILPSHPSFGDAGLPPPPKKWKGTCEFRSIAAAGCNNKVIGARAFGSAAINNTAPPVDDAGHGTHTASTAAGNFVQNAGVRGNAHGTASGMAPHAHLAIYKVCARSRCSIMDIIAGLDAAVKDGVDVLSFSISATDGAQFNYDLIAVATFKAMEHGIFVSAAAGNDGPVAGTIRNGAPWMLTVAAGTMDRAIRTSVRLGNGQELDGESLFQPRNNTAGRQLPLVFPGRNGDPDARDCSTLVEAEVRGKVGLCESRSISEHVEQGQMVSAYGGAGMILM

SEQ ID NO: 41234 - DNA, 648 bp, Panicum virgatum
  misc_feature: Ceres CLONE 2007084-R
  misc_feature: Encodes the peptide sequence at SEQ ID NO. 41235
cgccgtggaccccgggctggtgtacgacctgggccccagcgagtacatcgcctacctctgcgggctggggctcggggacgacggcgtgaaggagatagtcgggcggcgcatcgcgtgcggcaagctcaaggccatcaccgaggcggagctcaactacccgtcgctggtggtgaagctgctgtcccagccgatcacggtccggcgcacggtgacgaacgtggggaaggcggactcggtgtacacggcggcggtggacatgcccaggggcgtgtccgtggtggtgcggcccccgatgctgcgcttctcgcgggcgaacgagaagcagagcttcagcgtgacggtgcggtggaacgggcagccggccgtgggcggggccgaggggaacctcaagtgggtgtccaaggagcatgtggtgaggagcccgatcgtgatcccgccggccaaggccgtcgcgtagtagtagtatgttgttgatggcggcgcaatcgtgtcagtcagaacaaggttacttatcagtggtagtgagtggtaggttatcataagattgagtgtgcccggtggtgtacgtatggcgaagggagtaggtgatttgttgttgttgttgtataggcagcaaggtaccgagggagatcatctgcgagtgttgtc

SEQ ID NO: 41235 - protein, 151 aa, Panicum virgatum
  misc_feature: Ceres CLONE 2007084-R
  misc_feature: SWISSPROT Homolog: EC 3.4.21.25 Cucumisin
AVDPGLVYDLGPSEYIAYLCGLGLGDDGVKEIVGRRIACGKLKAITEAELNYPSLVVKLLSQPITVRRTVTNVGKADSVYTAAVDMPRGVSVVVRPPMLRFSRANEKQSFSVTVRWNGQPAVGGAEGNLKWVSKEHVVRSPIVIPPAKAVA

SEQ ID NO: 41236 - DNA, 665 bp, Panicum virgatum
  misc_feature: Ceres CLONE 2007087
  misc_feature: Encodes the peptide sequence at SEQ ID NO. 41237
ctctctttccgcctccacccctcgcgagctcggcacacgcggcggcttccctcctccttcctcctcacccccggcggcggcggcgacggagatgcagatggcagcggcagaggcccccaccgacgccgcggccgcggctgccgcgccgcatcaccacccccacgcgcacgccgcggcggccgcggccccgccgcacccgcacgcgcacgcgccgcacccgcaccaccacatgccgcagccgcggtgggtggtcatcccgtacccgccgccgcaccaccccatggtggccgctcccccgcccccgccgccgcagttcgtcaagcacttcgcgccgctggcctcggtcaccccgccgccgccgcagtcggctggatccggcgggaatggggccgaggacaaccgaacgatctgggtcggcgacctccagtactggatggacgagaactacctccacagctgcttcggccccagcggcgaggtggtgacaattaaagttattcgcaatagacactcgggggtctccgagggttatggttttgtagagttctattctcacgcatcagcagaaaaggcactacagaatttttctggtcatgtaatgcctaatactgaccgggcttttaagttgaactgggcatcatatagtatgggagaaaaacgctccg

SEQ ID NO: 41237 - protein, 191 aa, Panicum virgatum
  misc_feature: Ceres CLONE 2007087
  misc_feature (106)..(177): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MQMAAAEAPTDAAAAAAAPHHHPHAHAAAAAAPPHPHAHAPHPHHHMPQPRWVVIPYPPPHHPMVAAPPPPPPQFVKHFAPLASVTPPPPQSAGSGGNGAEDNRTIWVGDLQYWMDENYLHSCFGPSGEVVTIKVIRNRHSGVSEGYGFVEFYSHASAEKALQNFSGHVMPNTDRAFKLNWASYSMGEKRS

SEQ ID NO: 41238 - DNA, 2021 bp, Panicum virgatum
  misc_feature: Ceres CLONE 2007090
  misc_feature: Encodes the peptide sequence at SEQ ID NO. 41239
cgcttctcctccgtctcgctcgcctcgtcacctctcccgcgcccaccccccacaaatctcactcacagttggtgcacgctcgcgtccaaaccaagcaaacccaaaaccctagcctgccgccgccgctgccggcggggctccctccggtcccgtccccggcctaccctagcctcgcagcaaccctaaccctacccgccttcgccgccgccgccgccggagcaggggggcaaaatgccgcgcgagatcatcacgatccaggtggggcaatgcgggaaccagatcgggatggagttctggaagcagctctgcctcgagcacggcatcggcaaggacggactcctcgaggacttcgccacccagggtggtgacaggaaggacgtcttcttttaccaggctgatgatcagcacttcatacccaggtctcttcttattgacctggagccaagagtgatcaatggaattcagaacagcgagtataggaatctgtacaaccatgagaacatatttgtcgctgagcacggtggtggtgctgggaacaactgggccagtgggtatcatcagggtgaacaagttgttgatgatatcatggacatggttgatagagaagcagatggaagtgacagccttgagggttttgtcctttgtcactctattgctggtggaactggttcaggtatgggttcttatctgttggagacattgaatgatcgatacagtaaaaagcttgtgcagacatatagtgtcttccccaatcagatggaaacaagtgatgttgtcgtccaaccttacaactcgcttttgactctgaagcggctgacactgaatgccgactgtgtggttgttcttgacaatacggctcttaataggattgccgtggagcgtcttcatctatcaaatcctacttttgcacagacaaactctttggtctccacagttatgtctgcaagcacaactactttgaggtaccctggatatatgaacaatgacctggttggtcttcttgcctccttgatccccacaccaaggtgtcattttctgatgacaggttacactccattgaccgttgaacggcaggttaacatgatacgcaaaacgacggtactagatgttatgagaagacttctacagacaaagaatataatggtgtcatcatatgctcggacaaaggaagccagccaggctaaatacatttccatacttaatatcattcaaggagaggtggaccctacacaggtccatgagagtctgcaaaggatacgtgaaaggaagcttgttaacttcatagattgggcccctgcaagcattcaggttgccttgtcaagaaaatccccatatgttcaaacaacacacagggtaagtggtttgatgttagcaaatcatactagtatacggcacttattcagcaaatgcctgggacaatatgagaagctaaggaaaaagcaagcctttcttgacaactaccggaagtttcctatgtttgcggacaatgatctctctgaattcgatgaatctcgagaaataatagagagtctagttgatgagtacaaggcttgcgaatcaccagattacattaaatggggaatggaggatactggagaggcaaatgtcgcggccgcactggattctaagttagtggtgtaaatatcaaggtcctgctggttacccaaagattcaactgtagctgtccagtagttatcagttcgatgctgcctgctcatctagatctcatcggggtgctaccagagcgggtcacgctcttgtttgcaatcttgaagtttgcttcctttttttttccttgtgtgtgtgtgtgtgtgtgtgtgtgtgtggctatgtacatgtcgaaacccacttcctctgatctgtgctgttccatggtcttgttctagctgcccatcattggtggcgatgcattccatgttctgttctataacgctgatagctaggttcatatagtttggagctcctgcccgtcctgtgacactatgcccctgtttgtttcaaagcaagattttatatagtcc

SEQ ID NO: 41239 - protein, 469 aa, Panicum virgatum
  misc_feature: Ceres CLONE 2007090
  misc_feature (46)..(247): Pfam Name: Tubulin Pfam Description: Tubulin/FtsZ family, GTPase domain
  misc_feature (249)..(395): Pfam Name: Tubulin_C Pfam Description: Tubulin/FtsZ family, C-terminal domain
MPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDTGEANVAAALDSKLVV

SEQ ID NO: 41240 - DNA, 602 bp, Panicum virgatum
  misc_feature: Ceres CLONE 2007092
  misc_feature: Encodes the peptide sequence at SEQ ID NO. 41241
ccaatctgttcccgatccgacccgagccggacggccatggcgattagggctggccgctccgccctcctcgccctcgccttcctcctcgccgcctccccctgtctccaagctcgagtggatcaactttaccatggaaaacaggtatctgactggaataggcaactcaactttgaatcacaaaatttctcctcaagtcaaatggatgaatctcatgtccttggaagaccagaagagataacacgcaggaaattaagggcgagaactggtgtaaggaagaaaatggaagtagtgcagcaggatgatgaagccctggtgaaacttgagaacacaggtatcgagcgctcgaaagctgttgattctgctggtctaggaaaatacagcatatggagacgtgaaaatgaaaatgagaaggcagattcaagggttcgtatgatgcgagatcaaatgatgatggctagaatatattctgtacttgccaaatccagggacaagcttgatctttatcaggaactacttgcaaggctcaaagaaagccagcgctcccttggggaagctactgctgatgctgaacttccgaaaagagcttcggaaaggatcaaacc

SEQ ID NO: 41241 - protein, 188 aa, Panicum virgatum
  misc_feature: Ceres CLONE 2007092
  misc_feature: Functional homolog of the protein sequence given in SEQ ID NO 50281
  misc_feature: Useful for making plants with altered cell wall content and/or composition
MAIRAGRSALLALAFLLAASPCLQARVDQLYHGKQVSDWNRQLNFESQNFSSSQMDESHVLGRPEEITRRKLRARTGVRKKMEVVQQDDEALVKLENTGIERSKAVDSAGLGKYSIWRRENENEKADSRVRMMRDQMMMARIYSVLAKSRDKLDLYQELLARLKESQRSLGEATADAELPKRASERIK

SEQ ID NO: 41242 - DNA, 1658 bp, Panicum virgatum
  misc_feature: Ceres CLONE 2007097
  misc_feature: Encodes the peptide sequence at SEQ ID NO. 41243
gcgctgacacgcatcattaattccagaggggaaacgcacgcggtctccatccagtagctggctgggtagcgggggcgcaggtgcaggcgggcgagcgagctcggccatggcgagcgcgatgaacggcggcggcggcggcggggcgctgaagcggatgggcccgctgcggctgcagtactacatcgtgatgggcgcggtggcggcggccgtggtgctggccacgctgcgctacatgccgggccccgccgccgccgccaccagcagcgtggtccggccggacgcctcctccgcggcggcggcccccggcgccgaggcggaggcggagagggagggggataagaggaagaagaagaagggggacggggtggtgctgttcaacttcggcgactccaacagcgacacgggcggcgtggcggcggtgatggggatccgcatcgcgccgccggagggccgggcctacttccaccaccccacggggaggctctccgacggccgcgtcatcctcgacttcatctgcgagagcctgggcacgcaccatctgagcccgttcatgaagccgctggactccaacttcaccaacggcgtgaacttcgccatcgcagggtccacggccatgccaggggtcaccactttctcgctggacgtgcaggtcgaccagttcatcttcttcaaggagagatgccttgatgccatcgagagaggtgagagtgccccggttgatgagatggggttccaaactgctttatacaccatggacatcgggcacaatgatatcaatggcgttctccacatgccctatgatgaaatgcttgccaatcttccccctgtaattactgaaatcaagaaagccattgagaggttgcataaaaatggggccaggaagttctggatacacgggacaggtgcgcttggttgcatgcctcagaagcttgctatgccgagggacaacgacagtggtctcgatgagcatggatgcatcgcaagcataaacaatgtttgcaagaagttcaattctttgctgagcgaagccttggatgagctgcgcttgacccttaaaaagtcggcaatcgtctttgttgatatgtttgctatcaagtatgatcttgttgccaaccacaagaaatacgggattgagaagccgttgatgacatgttgcggccatggaggccctccttacaactacgacccgaaggaaagctgcatgacttcggataaacacctgtgcaagcttggtgaaaagttcataagctgggatggtgttcacttcaccgatgctgcaaacggcattgtggcttccaaggtgctcagcggcgagtactccattcccagggtcaagctggccagcctcgtcagcactgcaaaatctgatgattaatggtgatatggcattctaattggccctccctttggtttctcacaagggcgatgaagatggaaccactaacaaaactgaccccaaaatttaattatttcgaggtttttaccttacagccatcgttgacaaagattttcttttccttttcttctcctttttgtataattggggcgaatgtatagcctacagttttaatacatggtcatcctggtgtctctgttccatgtatgacttcttctttttttcttctgaattttggatcaataaatagagatgaatattt

SEQ ID NO: 41243 - protein, 422 aa, Panicum virgatum
  misc_feature: Ceres CLONE 2007097
  misc_feature (89)..(399): Pfam Name: Lipase_GDSL Pfam Description: GDSL-like Lipase/Acylhydrolase
  misc_feature: SWISSPROT Homolog: EC 3.2.1.51 Alpha-L-fucosidase
MASAMNGGGGGGALKRMGPLRLQYYIVMGAVAAAVVLATLRYMPGPAAAATSSVVRPDASSAAAAPGAEAEAEREGDKRKKKKGDGVVLFNFGDSNSDTGGVAAVMGIRIAPPEGRAYFHHPTGRLSDGRVILDFICESLGTHHLSPFMKPLDSNFTNGVNFAIAGSTAMPGVTTFSLDVQVDQFIFFKERCLDAIERGESAPVDEMGFQTALYTMDIGHNDINGVLHMPYDEMLANLPPVITEIKKAIERLHKNGARKFWIHGTGALGCMPQKLAMPRDNDSGLDEHGCIASINNVCKKFNSLLSEALDELRLTLKKSAIVFVDMFAIKYDLVANHKKYGIEKPLMTCCGHGGPPYNYDPKESCMTSDKHLCKLGEKFISWDGVHFTDAANGIVASKVLSGEYSIPRVKLASLVSTAKSDD

SEQ ID NO: 41244 - DNA, 1342 bp, Panicum virgatum
  misc_feature: Ceres CLONE 2007098
  misc_feature: Encodes the peptide sequence at SEQ ID NO. 41245
ccaaccatctcccccgcccccccgccgcgcccatcccccggcgccgcctcctctcccgaagccacgctcccacccactagccgccgccgccccgactcccgcacccgccgcgggcgggggacactctgcgccgtccagcgagaatttgattcagtcggactccgctgtgatggcggggaaggcgccgatggagcggcaccagtcgatcgacgcgcagctgcggctgctggcgccaggcaaggtgtccgaggacgacaagctggtcgagtacgacgccctcctcgtcgaccgcttcctcgacatcctccaggacctgcacggcccgcacctccgcgaattcgtccaggagtgctacgagctctcagcggagtacgagaacgaccgcgacgaggcgcggctcggcgagctcgggagaaagctcaccagcctgccgccgggggactccatcgtcgtcgccagctccttctcgcacatgcttaacctcgccaacctcgccgaggaggtgcagatcgcgcaccgccgccggatcaagctcaagcgtggggacttcgccgacgaggcctcggcgcccaccgagtccgacatcgaggagacgctcaagcgcctcgtctcgcagctcggcaagtcgcgcgaggaggtcttcgacgcgctcaagaaccagactgtcgacctcgtcttcacggcgcaccccacgcagtccgtcaggaggtccctgcttcagaagcacggcaggatccggaattgcctgagacagctgtatgccaaggacatcactgctgacgacaagcaggagcttgatgaggctcttcagagggagattcaagctgctttcagaactgatgaaatccgcaggacccctcccacccctcaagatgaaatgcgtgctggaatgagttacttccatgaaactatatggaagggcgtacccaaattcttgcgccgtattgacactgctctgaaaaatattgggatcaatgagcgtctcccttacaacgctcccctcattcagttctcatcctggatgggtggtgaccgtgatggaaatccaagagttacaccagaggttacacgggatgtatgcttgttggcgagaatgatggctgctaacttgtacttctctcagatagaagatctaatgtttgagctctctatgtggcgctgcagtgatgaacttcggatccgtgcagatgaattacatcgctcgtcaaaaagagctgcaaagcattatatagaattctggaagcaagttcctccaaacgaaccatatcgtgtcatacttggtgatgtcagggataaattgtactatacacgtgagcgttctcgtcatttattgacaacagga

SEQ ID NO: 41245 - protein, 390 aa, Panicum virgatum
  misc_feature: Ceres CLONE 2007098
  misc_feature (12)..(390): Pfam Name: PEPcase Pfam Description: Phosphoenolpyruvate carboxylase
  misc_feature: SWISSPROT Homolog: EC 4.1.1.31 Phosphoenolpyruvate carboxylase
MAGKAPMERHQSIDAQLRLLAPGKVSEDDKLVEYDALLVDRFLDILQDLHGPHLREFVQECYELSAEYENDRDEARLGELGRKLTSLPPGDSIVVASSFSHMLNLANLAEEVQIAHRRRIKLKRGDFADEASAPTESDIEETLKRLVSQLGKSREEVFDALKNQTVDLVFTAHPTQSVRRSLLQKHGRIRNCLRQLYAKDITADDKQELDEALQREIQAAFRTDEIRRTPPTPQDEMRAGMSYFHETIWKGVPKFLRRIDTALKNIGINERLPYNAPLIQFSSWMGGDRDGNPRVTPEVTRDVCLLARMMAANLYFSQIEDLMFELSMWRCSDELRIRADELHRSSKRAAKHYIEFWKQVPPNEPYRVILGDVRDKLYYTRERSRHLLTT

SEQ ID NO: 41246 - DNA, 658 bp, Panicum virgatum
  misc_feature: Ceres CLONE 2007098-R
  misc_feature: Encodes the peptide sequence at SEQ ID NO. 41247
ccaagggagacccaggaatcgcagctgtgtacgacaaactgctagtggctgaagatctgcaatcctttggggagcagctgaggaagaactatgaggagacaaaagagctactccttcaggttgccggtcacaaggacgtcctcgaaggcgatccttacctgaagcagcgtctgcggctgcgtgagtcctacatcaccaccttgaacgtctgccaggcctacaccctgaagcgaattcgtgacccggccttccaagtgagcccccagccggctctgtccaaggagtttgttgacgagagcctgccagcgcagttggtgcagctgaaccccgagagcgagtacgctccgggcctggaggacacgctgatcctgaccatgaagggcatcgccgccggaatgcagaacaccggctaggccagactctcggtgtacaaataacccatctcacatgagatggtggacaatgtgtgtaagcctgtaggcagttagtttgccggcgctagtgggttactcatctggaggaacttttatgtcgcagacttttggttttgcttgatgtaaatgtcaaggtgagcttattggctgttgaagcctgatgcgtaataaattatggaacaatggtttacgttaatctctaataataaatgtgtatcttctag

SEQ ID NO: 41247 - protein, 136 aa, Panicum virgatum
  misc_feature: Ceres CLONE 2007098-R
  misc_feature: SWISSPROT Homolog: EC 4.1.1.31 Phosphoenolpyruvate carboxylase
KGDPGIAAVYDKLLVAEDLQSFGEQLRKNYEETKELLLQVAGHKDVLEGDPYLKQRLRLRESYITTLNVCQAYTLKRIRDPAFQVSPQPALSKEFVDESLPAQLVQLNPESEYAPGLEDTLILTMKGIAAGMQNTG

SEQ ID NO: 41248 - DNA, 1609 bp, Panicum virgatum
  misc_feature: Ceres CLONE 2007129
  misc_feature: Encodes the peptide sequence at SEQ ID NO. 41249
aatcccccacaaagaccctactctctccacgttccgggtccgcctggcacactcacttacagcgtcccacactcccctcagacctgcacgctacctctctactccaaggattcgggcacaacgaccacccacacatccacatacacacacagaacccccatgtcgcggtagtcccgagccctggcatgtcctcgcccgccctccgccatgatgcttcccccatggacacgcacatcctgatccgccatgcggacagccacgccgacatgcacagcacgaagccggcaccgctgtgtcccaccgacagcgacgccatcctgccctcgcgctccagcaaagatgcccacgcccacacctcctccgcgcccagcaccacgcgccgcgtcgaccgcaagagccccgaatacctaatcaaaagcggcatcgcgggcggcatcgcaggatgcgcagcaaaaaccgtcgtcgggccccttgaccgcgtgaagatcctcttccaaacccaaaacccgcagttcgcaaaatacaccggctcgtggacggggttcccaaaagccgtgcgcgacatctacgcctccgccggcaccgcggggctcttcaaaggccacagcgccactctcctccgcatcttcccctacgcggggatcaaattcctcgcatacgaacagatccgggcgcgcgtgatccactcggccgcacaggagacgccggggcggcgcttcgtgtccggcagcttagcagggatggtcagcgtcttcttcacctacccgctggaagtcatccgcgtgcggttggcattcgagacgcgcgcgggggagcgcagcaacctgagcgccattgtgcgcaagatctacagcgagacttccgcacccacgacccactccccaggcaacgcggtatccgcgtctgctgtgcatgcggtcgagaaactcaccccccagtccggcctcggcaacttcttccgcggcttcacccctaccctgctcggcatggtgccctacgcgggcgcctcgttcctcgcccacgactccctgggcgacgtcatgcgctggccactgctggccccctacacaacactccccaacaccgggcggcctgagacctcagactccagcgccaagcccgcgcagctgcggtactgggccgaactctcgaccggcggcatagcgggcttcgtctcacaaaccgtgtcctacccgctcgaagtcatccggcggcggatgcaggttggtggtgtcgttggcgacgggcacagactgggcattgcagaagtagcaaagcggatctatgcagagagggggtggagggggtatttcgtggggttgacgattgggtacgtcaaggttgtgccgatggtggcgacgagtttcttcgtgtacgaacgggccaagttttactttggtatataagtgctgtggcaatggggctgcgtgcgcatgggtgttttaggcgttttgtgtaagtgcacacacataagatgtgcgcgggattcttgcgtagggggcggaatagtggcgtgtatataaaacgacttcccgcatcagcatgtgcgttttgtggaaacggggaaactggtagatatcccttgaaatgtacatgtcccatcccatcc

SEQ ID NO: 41249 - protein, 394 aa, Panicum virgatum
  misc_feature: Ceres CLONE 2007129
  misc_feature (62)..(157): Pfam Name: Mito_carr Pfam Description: Mitochondrial carrier protein
  misc_feature (304)..(392): Pfam Name: Mito_carr Pfam Description: Mitochondrial carrier protein
  misc_feature (161)..(278): Pfam Name: Mito_carr Pfam Description: Mitochondrial carrier protein
MDTHILIRHADSHADMHSTKPAPLCPTDSDAILPSRSSKDAHAHTSSAPSTTRRVDRKSPEYLIKSGIAGGIAGCAAKTVVGPLDRVKILFQTQNPQFAKYTGSWTGFPKAVRDIYASAGTAGLFKGHSATLLRIFPYAGIKFLAYEQIRARVIHSAAQETPGRRFVSGSLAGMVSVFFTYPLEVIRVRLAFETRAGERSNLSAIVRKIYSETSAPTTHSPGNAVSASAVHAVEKLTPQSGLGNFFRGFTPTLLGMVPYAGASFLAHDSLGDVMRWPLLAPYTTLPNTGRPETSDSSAKPAQLRYWAELSTGGIAGFVSQTVSYPLEVIRRRMQVGGVVGDGHRLGIAEVAKRIYAERGWRGYFVGLTIGYVKVVPMVATSFFVYERAKFYFGI

SEQ ID NO: 41250 - DNA, 661 bp, Panicum virgatum
  misc_feature: Ceres CLONE 2007130
  misc_feature: Encodes the peptide sequence at SEQ ID NO. 41251
ggaaaggatcttttctttatctactggtactgtacgtgcacgtgtgtttgaccgttttctttttgacacaccattcacaaagaatggaaaaacacaaggtggcttagaagaccaatggaagagacgcacagtgcttcagactgagggttcatttcctgctttggtgaaccgcctgctagttaccaaatctgaatctctagagttctctcctgttgagaatgcgattggaatgatcgaaacaagaacagctgcattgagaaatgaactagaagaaccacggagttctgaaggcgatcaactaccaaggcttcaaagcttgcaaaggatactccaaggaagtgtggctgttcaggtcaacagtggagtgttaagtgtgtgcactgcattcttatccggtgagcctgcgaccaggctccgatcacaagaactgcagcagctcatcgctgcattgcttgaattcatggctgtctgcaagcgcgcaatcagagtgcatttcagattgataggcgaagaagaccaggaattccacacccaactcgtcaatggattccagtcactcactgctgagctgtctcactatatccctgctatactttcagagctatgatagtactgtagcaatctggaaattaggtagcatgtgaatggttgttcattcttt

SEQ ID NO: 41251 - protein, 201 aa, Panicum virgatum
  misc_feature: Ceres CLONE 2007130
  misc_feature (8)..(194): Pfam Name: Ded_cyto Pfam Description: Dedicator of cytokinesis
ERIFSLSTGTVRARVFDRFLFDTPFTKNGKTQGGLEDQWKRRTVLQTEGSFPALVNRLLVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 41252 - DNA, 1389 bp, Panicum virgatum
  misc_feature: Ceres CLONE 2007137
  misc_feature: Encodes the peptide sequence at SEQ ID NO. 41253
gatcgccaccgcccgagccgagaccaacaccaaccaccgagctcggagagcagagcagcctctctgctctctggttgctctcgcagccggtcagtcctcacacctcaccgctcactatctgaccgcgacgtccggcgccaagcaaggccgcctcgtccacctccgtccatgtgagtgagtggcagcacaacgctggctcccaggtctcgctcgcccggtggccggacttgcagaagaagaagcagcagcagctaaccgcagcggctgcagaatccggcgggcgacatgggtctgctgtctcaccgggtggagcggtcggagatcaagcccggcgaccacatctacacctggcgcgccggctacacctactcccaccacgggatctacgtcggcgggagcaaggtggtgcacttcacgcgcaagaaggaggcgggcaccgccggcctggactcggccatcgccgtgtcgagcctcctctcgcagggccccgacgagtgcccgaccttcccggactgcggcttccagcgccccgacagcggcgtcgtgctcacctgcctcgactgcttcctccgcggcggcgcgctgcaccgcttcgagtacggcgccccgcccgccgtgttcctcgccaagctccgcggcgggacctgcaccacggcgcgcgccgacggcgggcccgccgccgccgtgcgccgcgccatgcacctcctccagaacggcttcggcgactacgacgtgttcgagaacaactgcgaggacttcgcgctctactgcacgacgggcctcctccccggcgccggcgacgacggcatcgggcgcagcggccaggcggcctccgccgtcgccgtgccgctcgcggcgctcctctccacgccgttcaaggtgctcgccgccggcccgctcggcatggccgccgtcaccgccggcgtgtactgcgccggcaggtacatcaccgacatcggggtgcggaaggacgtcgtcaaggtggaggtggagaacctggcggcgcacctcggctggcgacgcgccaaggctgctgaggaggcggtcaagaaacagcagcatcagccgcagccgccgccgacgccggagaagaaggccagcagcaggctgctccctctgaaacggaaacgagagatttgcgtctgattttgcgtggatacaggcagattgggtcgttgcatagaaatcaataagtgcggtataggtatcgaagcgtcttgatcgagcgtgctttcatttgtttagttgagcgtcgtacgtgatcgatctttctttctcacgaaatggaagattagatagttgcagttttatagcttgcattatgtactacgtagtcaattgctagacttggtctctgtattatctgatatagctcaagagttcatcagt

SEQ ID NO: 41253 - protein, 286 aa, Panicum virgatum
  misc_feature: Ceres CLONE 2007137
  misc_feature (101)..(184): Pfam Name: NC Pfam Description: NC domain
MGLLSHRVERSEIKPGDHIYTWRAGYTYSHHGIYVGGSKVVHFTRKKEAGTAGLDSAIAVSSLLSQGPDECPTFPDCGFQRPDSGVVLTCLDCFLRGGALHRFEYGAPPAVFLAKLRGGTCTTARADGGPAAAVRRAMHLLQNGFGDYDVFENNCEDFALYCTTGLLPGAGDDGIGRSGQAASAVAVPLAALLSTPFKVLAAGPLGMAAVTAGVYCAGRYITDIGVRKDVVKVEVENLAAHLGWRRAKAAEEAVKKQQHQPQPPPTPEKKASSRLLPLKRKREICV

SEQ ID NO: 41254 - DNA, 1887 bp, Panicum virgatum
  misc_feature: Ceres CLONE 2007138
  misc_feature: Encodes the peptide sequence at SEQ ID NO. 41255
ggccagcattaaccagcagctcgcacacgcgccgcggccaactccgtgaggccgtccccccgcccgcccgcgccgcgcgagagagagaaccgcagaggagccgggcatgcagcgcctcgcctcctcctcctcccggaggctcctcggggccgcgctcgcccccgcccgggccaactccagcctctccgcggccgtcgccgcggcgcccgcgccggagaatgccgccgctgcgtccccgaagatgccggccttcgactacacgccgccgccctacgacggcccgcgggccgaggagatcttccggaagcgggccgagttcctcagcccgtccctcttccacttctacgaccgccccttgaacatagttgatggaaagatgcagtatttatttgatgaggatggtcgtcgttacctggatgcttttggtggcattgcaacagtttgctgtgggcactgccatcctgatgtggttgaagccatagtaaaccaggcaaagaggatccaacactccacagttctgtatctcaatcatgccattgtggattttgcagagtcattggcatccaaaatgcctggtgatttgaaggtagttttcttcacaaattcaggcacggaggcgaatgagctcgcactgatgattgcacgtctttacactggttgcaatgacattatctccctcaggaatggataccatgggaatgctgctggaacaatgggtgctactgctcaatccaattggaaattcaatgttgttcagacgggagtacaccatgcgcttaacccagacccctacagaggtgcttttggctctgatggggagaaatatgccagagatgttcaggaaatcattcaatttgggactacagggatagttgctggtttcatttcagaagccatacagggggttggtggaatagtggaattagcaccaggatacttgccagcagcatatgatatagtaaggaaagccggtggtctctgcattgctgacgaagttcaggcgggtgttgcacgaactggaagccacttctggggatttgaaggccacggtgttatcccagacatagttaccatggcaaagggtatcgggaatggcataccgataggagccgtcgtgacaacaccggagattgctcaggtgttgacccgtagaagctacttcaacacctttggtggtaaccccgtcagcactgcgggcgggcatgcagttctcaaagtgctggagaaggagaagctccaggagaatgcgtttgttgtaggctcctatctgaaggaacaacttaacaagctgaaagagaagcatgacatcatcggtgacgttagggggaaaggtttccttcttggagttgagttggtgacagaccgcgaaaagaaaacgccagccaaagctgagatctcacatgtcatgaaccacatgaaagatatgggggtgttggttgggaagggtggcttctacgggaacgtgttcaggattacaccgccgttgtgcttcactaaagaggactctgacttcttcatcgatgtgatggatatcgcgctctcgaaactgtgaggcaggctgcgcgaagatgatgccatgtacatctgttgatccgtaaataagaggagattcgcgagacagcacctcgttgtctcgtgatccgtgctcgccagcttcagcttcgtccaatctgctgttcctccttatccagtcgtttaacaactccttgtttgagatcaataataagttctttttctatgttatatgagccctgtatttctgttatccagaaacaaacccctgtggccctgtcactattaggagatgcagatatacggctttacatatgcagtgccaatgctttggctaaacataacgtgcaattcaaaagaaaaagatcgcgtatc

SEQ ID NO: 41255 - protein, 436 aa, Panicum virgatum
  misc_feature: Ceres CLONE 2007138
  misc_feature (40)..(373): Pfam Name: Aminotran_3 Pfam Description: Aminotransferase class-III
  misc_feature: SWISSPROT Homolog: EC 2.6.1.44 Alanine--glyoxylate transaminase
MPAFDYTPPPYDGPRAEEIFRKRAEFLSPSLFHFYDRPLNIVDGKMQYLFDEDGRRYLDAFGGIATVCCGHCHPDVVEAIVNQAKRIQHSTVLYLNHAIVDFAESLASKMPGDLKVVFFTNSGTEANELALMIARLYTGCNDIISLRNGYHGNAAGTMGATAQSNWKFNVVQTGVHHALNPDPYRGAFGSDGEKYARDVQEIIQFGTTGIVAGFISEAIQGVGGIVELAPGYLPAAYDIVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNKLKEKHDIIGDVRGKGFLLGVELVTDREKKTPAKAEISHVMNHMKDMGVLVGKGGFYGNVFRITPPLCFTKEDSDFFIDVMDIALSKL

SEQ ID NO: 41256 - DNA, 681 bp, Panicum virgatum
  misc_feature: Ceres CLONE 2007146
  misc_feature: Encodes the peptide sequence at SEQ ID NO. 41257
aacaaacgctaaaaaagtaacagtttctgtactttattgggagaccaccactttctcaaccccaacaacactcaagccaaccatgtccaagggagcgtacgaaggcgcgatcggcatcgacctgggcacgacgtactcgtgcgtgggcgtgtggcagaacgagcgcgtggagatcatcgcgaacgaccagggcaaccgcacgacgccgtcgtacgttgccttcacggacacggagcgcctgatcggcgacgccgccaagaaccaggccgcgatgaaccccgcgcacacggtgttcgacgcgaagcgcctcatcggccgcaagttctcggactcggtcgtgcaggcggacgtgaagcactggccgttcaaggtcgtgacgcgcggtgacgacaagccgctcatcgaggtctccttcaagggcgagacgaagcagttcgcgccggaggaggtgtcgtcgatggtgcttgtgaagatgaaggagatcgcggagtcgtacctcggcaaggacgtgaagaaggcggtggtgacggtgccggcgtacttcaacgactcgcagcgcctggcgacgaaggacgcgggcacgatcgcgggcctggaggtgcagcgcatcatcaacgagccgacggcggctgccatcgcgtacggcctggaccgcatgggcgacgcgcaggagcgcaacgt

SEQ ID NO: 41257 - protein, 199 aa, Panicum virgatum
  misc_feature: Ceres CLONE 2007146
  misc_feature (9)..(199): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MSKGAYEGAIGIDLGTTYSCVGVWQNERVEIIANDQGNRTTPSYVAFTDTERLIGDAAKNQAAMNPAHTVFDAKRLIGRKFSDSVVQADVKHWPFKVVTRGDDKPLIEVSFKGETKQFAPEEVSSMVLVKMKEIAESYLGKDVKKAVVTVPAYFNDSQRLATKDAGTIAGLEVQRIINEPTAAAIAYGLDRMGDAQERN

SEQ ID NO: 41258 - DNA, 1213 bp, Panicum virgatum
  misc_feature: Ceres CLONE 2007147
  misc_feature: Encodes the peptide sequence at SEQ ID NO. 41259
actaaattcaagaattcccggtttcagagacgcaccgagccaaaaagcaacagaaacccaaacttcccttctaaaggaggagtcaaggcgacgtctacctttgtgtttttttcccttctcacgtcggtcattttgtaaccatcgttcaccatgagcgaccctaacgccagcgaggcggagaagaacatcgagatctggaaggtgaagaaactcatcaagcagctcgaagctgcacgtggaaatggcaccagcatgatttccttgattattccgccaaaggaccaagtctctcgtgcggcaaagatgttggcagaagaatacggtaccgcatccaacatcaagtcgcgagttaaccgtcaatccgtcctttcagccattacctcgacccagcagcgccttaagctctacaacaaggttccccccaacggtcttgtcgtgtactgcggtgaaatcttgacctcggaaggcaaggagcgcaaggtcaatatcgatttcgagcccttcaagcccatcaacacatcgctctacctctgcgacaacaaattccacacggaggctctcgccgagctgctcgagtcggatcagaagttcggttttatcatcatggatggtaacggagcgttgttcggaacgctcagcggcaacactcgcgacatcgtccagaagttttcggtcgatcttcccaagaagcacggtcgtggtggccagtcggcgctgcgttttgcccgtctgagagaggaaaagcgccacaactatgttcgcaaggtcgctgagttggcggtgcagaacttcatcaccaacgacaaggtcaacgttggcggcattgtgctggccggttcggccgatttcaagaatgacctgaacgcttccgacctgttcgaccagcgtctgcaggtcaaggtcatcaaggtcgtcgatgtgtcgtacggtggcgagaacggtttcaaccaggccatcgagctgtcgtccgagacgttgggcaacgtcaaattcatccaggagaagaaactcatcggcaagtacttcgaggagatcagccaggacacgggccgtatttgctacggtattgaggacacgctcaaggcgctggagctgggtgctgttgagacccttattgtctttgagagtctcgagatcaaccgctggactctgaaggacagcaacaacaccgaatacgtgattcacaccaccaagcagcaagaagcgggcaacc

SEQ ID NO: 41259 - protein, 354 aa, Panicum virgatum
  misc_feature: Ceres CLONE 2007147
  misc_feature (8)..(142): Pfam Name: eRF1_1 Pfam Description: eRF1 domain 1
  misc_feature (146)..(278): Pfam Name: eRF1_2 Pfam Description: eRF1 domain 2
  misc_feature (281)..(353): Pfam Name: eRF1_3 Pfam Description: eRF1 domain 3
MSDPNASEAEKNIEIWKVKKLIKQLEAARGNGTSMISLIIPPKDQVSRAAKMLAEEYGTASNIKSRVNRQSVLSAITSTQQRLKLYNKVPPNGLVVYCGEILTSEGKERKVNIDFEPFKPINTSLYLCDNKFHTEALAELLESDQKFGFIIMDGNGALFGTLSGNTRDIVQKFSVDLPKKHGRGGQSALRFARLREEKRHNYVRKVAELAVQNFITNDKVNVGGIVLAGSADFKNDLNASDLFDQRLQVKVIKVVDVSYGGENGFNQAIELSSETLGNVKFIQEKKLIGKYFEEISQDTGRICYGIEDTLKALELGAVETLIVFESLEINRWTLKDSNNTEYVIHTTKQQEAGN

SEQ ID NO: 41260 - DNA, 663 bp, Panicum virgatum
  misc_feature: Ceres CLONE 2007157
  misc_feature: Encodes the peptide sequence at SEQ ID NO. 41261
ggacaaggacaagtgataaagggatgggacctgggaatcaagactatgaaaaagggtgagaacgcggtcttcactatcccaccagtgctcgcctatggtgagactggctcaccaccaacaatcccaccgaacgcgactcttcagttcgatgttgagctcctttcatggggcagcgtcaaggacatctgcaaggatggtggaatcttcaagaagatagttactgaaggggaaaaatgggagaaccccaaggaccttgatgaagttttcgttaagtacgaggggagacttgaggatggaactgtagtgtccaaatctgatggtgttgaatttgccgtcaaagatggttacttctgccctgcccttgccaaggctgtgaagaccatgaagaagggcgagaaggtcctcctcactgtcaaaccacaatatggctttggagaacaaggaagaccagcttctggagatgagggtgctgtgccccccaatgctaccctgcatatagatcttgagctagtatcatggaagactgtgacacttattggagatcgcaagaggatcttgaagaaggttctcaaggaaggtgaaggctatgagcgccctaatgatggagcagtagtgagagtgaggcttattggtaagttggaggatggcactatctttgtaaag

SEQ ID NO: 41261 - protein, 220 aa, Panicum virgatum
  misc_feature: Ceres CLONE 2007157
  misc_feature (76)..(171): Pfam Name: FKBP_C Pfam Description: FKBP-type peptidyl-prolyl cis-trans isomerase
  misc_feature (1)..(54): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
GQGQVIKGWDLGIKTMKKGENAVFTIPPVLAYGETGSPPTIPPNATLQFDVELLSWGSVKDICKDGGIFKKIVTEGEKWENPKDLDEVFVKYEGRLEDGTVVSKSDGVEFAVKDGYFCPALAKAVKTMKKGEKVLLTVKPQYGFGEQGRPASGDEGAVPPNATLHIDLELVSWKTVTLIGDRKRILKKVLKEGEGYERPNDGAVVRVRLIGKLEDGTIFV

SEQ ID NO: 41262 - DNA, 735 bp, Panicum virgatum
  misc_feature: Ceres CLONE 2007169
  misc_feature: Encodes the peptide sequence at SEQ ID NO. 41263
atgaagagaaccgaatcttctgctcctatcttcaacatggaagatatagaagagggctttgaaggttatgaggatgaaagatcactgcttatgtcccagaaaagcttggagaaacgatttggccagtctccaatttttattgcgtccacttttatgactcaaggtggcataccaccttcaacaaatccagcttccctgctaaaggaagctatccatgtcatcagttgtggatatgaggacaagacagaatggggaaaagagatcggatggatatatggctctgttactgaggatattttaactgggttcaagatgcatgcaagaggttggatatccatctactgcatgccacttcgaccttgcttcaagggttctgctccaattaacctttctgatcgtctcaatcaagttttacgttgggctcttggttcagttgaaattctgctcagcagacactgtcctatttggtacggttataatggaaggctaaagcttctggagagattggcgtacatcaacaccattgtttatccaattacatctatcccactaatagcctactgcgtccttcctgctatctgtctacttaccaacaaattcattattcctgaggtaagttcgccagaacccttggcctttatccaccgtattcgaatgccttgcacttatgttctcttgtgctcatgaagttaacaaacaagcacataataaattgatcttcttggttatgtttgc

SEQ ID NO: 41263 - protein, 216 aa, Panicum virgatum
  misc_feature: Ceres CLONE 2007169
  misc_feature: SWISSPROT Homolog: EC 2.4.1.12 Cellulose synthase (UDP-forming)
  misc_feature: Functional homolog of the protein sequence given in SEQ ID NO 50499
  misc_feature: Useful for making plants with altered cell wall content and/or composition
  misc_feature: Useful for making plants with modulated biomass
  misc_feature: The sequence is a functional homolog of SEQ ID NO 6 in US patent 7285702
  misc_feature: Functional homolog of the protein sequence given in SEQ ID NO 50124
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
MEDIEEGFEGYEDERSLLMSQKSLEKRFGQSPIFIASTFMTQGGIPPSTNPASLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLIAYCVLPAICLLTNKFIIPEVSSPEPLAFIHRIRMPCTYVLLCS

SEQ ID NO: 41264 - DNA, 1586 bp, Panicum virgatum
  misc_feature: Ceres CLONE 2007177
  misc_feature: Encodes the peptide sequence at SEQ ID NO. 41265
aaaccatggcgaggtcagggcgggaaggggagggcgggggcggggaggagcggaggctggtgctgggcaagtacgagctgggccggatgctggggcagggcaccttcgccaaggtctactacgcgcgggacctcagcgccgcggcggcgggctccggctccggctccggcggcggcagcagcgtggcgatcaaggtgatcgacaaggcgcggctgcggcgcacggagggcatggtggagcagctgcgccgggagatctccatcatgcggatggtgcgccaccccagcgtggtgagcatccgggaggtgctcgcctcccgctcccgcgtcttcgtcgtcatggagtacgcccgcggcggggagctcttcgccaaggtggcccgcggccgcctcaccgaggaccacgcccgccgctacttccagcagctcgtcgccgccgtcggcttctgccaccgccgcggcgtcgcgcaccgggacctcaagcccgagaacctgctcctcgacgaggagggccgcctcaaggtcaccgacttcggcctcgccgcgctgcccgagcagctgcgccacgacggcctgctccacacgcagtgcggcaccccggcgtacgtcgcgcccgaggtgctccgcaagcgcggctacgacggcgcccgcgccgacctctggtcctgcggcgtcgtgctctacgtcctgctctgcggctccctccccttccagcacgacaactacgccaagatgtaccagaagatcttcaaggccgactaccaggtgccgccctgggtctccggcgaggcgcgccgcctcatcgctcgcctgctcgtcgtcgaccccgccaagcgcgcctccatcgccgagatcatgctcacgccctggttcaggaagggcttcgtcccgcccgtcctgtcgccccaggtctcgcccaagaaacggctggccgaccaaggcgatgccggcgccctcctcgagggcggcgacgacgacagcgacagcagctccgcctctgtctcgccgcggtcgtgcaacgcgttccagctcatctcctccatgtcctccgggttcgacctgtcggggctgttcgagagcgagcggaaggccgcgacggtgttcacgtcccgcgcgccggcggccgccgtggcggagaagctggagtccgtgggacgcaccctggggttcgaagtcaccaggggcaccaagggctggaatctgcggctggaggtcaaggtcgagggcaccaacgggcggctcgcggtcaccgccgaggtgctggaggtggccgcggacgtggccgtggtggagttcgcgcacgacgccggggacgcgctggacttcaacaagttctgcgcagaggacgtgcgcccggggctcgccgagatcgtctgggcgtggcagggcgacagcccgccggcgccggccgccgtcgccgggtgcgcgtgatgatgaacagagaaagcggccgttgcggcgtccaatctgcgatgtaaaacttctagcggcttggttaggatttgcagttattttttaggatgtaaaattcgtaccttcgttgtacagggagagaagagctgaaccaaagagaggagtttgtagacg

SEQ ID NO: 41265 - protein, 474 aa, Panicum virgatum
  misc_feature: Ceres CLONE 2007177
  misc_feature (23)..(289): Pfam Name: Pkinase Pfam Description: Protein kinase domain
  misc_feature (333)..(392): Pfam Name: NAF Pfam Description: NAF domain
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
MARSGREGEGGGGEERRLVLGKYELGRMLGQGTFAKVYYARDLSAAAAGSGSGSGGGSSVAIKVIDKARLRRTEGMVEQLRREISIMRMVRHPSVVSIREVLASRSRVFVVMEYARGGELFAKVARGRLTEDHARRYFQQLVAAVGFCHRRGVAHRDLKPENLLLDEEGRLKVTDFGLAALPEQLRHDGLLHTQCGTPAYVAPEVLRKRGYDGARADLWSCGVVLYVLLCGSLPFQHDNYAKMYQKIFKADYQVPPWVSGEARRLIARLLVVDPAKRASIAEIMLTPWFRKGFVPPVLSPQVSPKKRLADQGDAGALLEGGDDDSDSSSASVSPRSCNAFQLISSMSSGFDLSGLFESERKAATVFTSRAPAAAVAEKLESVGRTLGFEVTRGTKGWNLRLEVKVEGTNGRLAVTAEVLEVAADVAVVEFAHDAGDALDFNKFCAEDVRPGLAEIVWAWQGDSPPAPAAVAGCA

SEQ ID NO: 41266 - DNA, 689 bp, Panicum virgatum
  misc_feature: Ceres CLONE 2007183
  misc_feature: Encodes the peptide sequence at SEQ ID NO. 41267
aggcgaccaatggccacgggccggcggctcggcggcgtcgacccgttccggcaaccgcgtcttcccctgccgctgccgccctcgccgcgcgcgcgtgcctcctccgcccccgcccccgccccagcaaagccaacctactcccggtgacccggtcgccgacgcgccggtctctccacccagactacaaatggagctccgcacaagcgcggcccgcggctttgcgtcccccgcttccggccgcggcacggtgccatccccacgcttcctctcccgtctcgtctggagccgatcgacacagtgtactgcctcctccctacaaggccctgttgctaggaggaggagccggttttctactctgatgacgactgcctacaacacagggaccccggatctagttgacttcaattgggatgcccttgggtttcaactggtccctacggacttcatgtatttaatgaggtgttcttcagatggggtgttcacaaagggtgaattggtgccatatggaccaattgagctgaacccagcagctgcagtgttgaattatggtcagggattgcttgaaggtctaagagcacatagaaaagaggatggatcaatccttctttttcgcccacatgaaaatgcattgcggatgagaactggtgcagatcggttatgcatgcctgcaccaagcgtagagcaattcc

SEQ ID NO: 41267 - protein, 167 aa, Panicum virgatum
  misc_feature: Ceres CLONE 2007183
  misc_feature: SWISSPROT Homolog: EC 2.6.1.42 Branched-chain-amino-acid transaminase
  misc_feature: Functional homolog of the protein sequence given in SEQ ID NO 51371
  misc_feature: Useful for making plants with modulated nitrogen use efficiency
MELRTSAARGFASPASGRGTVPSPRFLSRLVWSRSTQCTASSLQGPVARRRSRFSTLMTTAYNTGTPDLVDFNWDALGFQLVPTDFMYLMRCSSDGVFTKGELVPYGPIELNPAAAVLNYGQGLLEGLRAHRKEDGSILLFRPHENALRMRTGADRLCMPAPSVEQF

SEQ ID NO: 41268 - DNA, 1759 bp, Panicum virgatum
  misc_feature: Ceres CLONE 2007184
  misc_feature: Encodes the peptide sequence at SEQ ID NO. 41269
agagaggaggaagagctgttgcagcgccgtcggcgggggagcggagcgtgtgggagagcaagaagtcgccgaggtggggcttcagccggaggaacaaggtcggcgtggacgggtcggaggagaggaggttcaagaactcggcggcgagcccgaagggtgcccgcgccggggagccgagcgggccgagccccgcgcggacggtgagcgcgaaggggaggccctggtcgttgcggcggcgcgagaggcggagcgccgggcccgacgcgaaggcggtggtgaggtcgaagcggagctgccgcgggtcgccgcccgccacgaggctcgactggaacggcagcccgagcacgccgatgggcaccttgacccgcatccgcggccggtcgtcgtcgcggaacttgatcgacgccttcatgggcctcgcccactggcgtggcaggaggagatcgccgccgcctgggaccagagcagcgaggagaggggcgcgctccggtcggcttacgccgccgtcagggaaatgatacgcgagctcaaagacgatcctgctcttgcaagttcgatgccgtcatggacaggattgaaaagcttcatgagaaagtgcaaagaccactggagcagctcgtagatggtgaggctctgctggaacttgctaatgttctggtctcatcgaccaaggaggaaaacagaaatgggccgaccccatctgaatttgttacagtcctgctcaggaagtttggtgttacagccacaccgcttaatgattctaatgagtcaatcgactggtcgagtcttggtgctgcaacatcgacattgttcatgacagcaaccgggtgccaaacaatgcatggtccaatggatcttgcaatcaaggaacggaggtgtgtgtttagaagagaatctggccgcttagacagtagacctgcagagcctgatgctttggtgccagaccaggatgaaaggaatgacaccgataagaacatagctgtcatgttcagcctcctagtacatcacaaaagtataaagctggaacatctcattttgaaccggcagtcctttgcacaaaccgttgagaacttatttgcgctctcatttctggtgaaggatgggagagctgagataaacgtggttgatagtggggatcattttgtcgctccaaggaatgctcctgcagctggattgatagcctccaggaaagtgaccaacagccaatttgtgttccggtttgatactgaggactggcagataatgcaacgagtggtcaagccaggagaggaagtaatgcctcacagaagtagttaccatgggggtgaatacaggaacacacaatcatgtcctactcgtgattgcactaagctggtttcagattctgaacatctgaaagaagacaagtttgcaaaagaagacccaacagagttcacagatgacgaagcagtgaagaagttgaccaattggtgctctgaagatgacactccaaagaagaggagaagacagcatgtggctaggaggttgttttctgcagatgactaggaagaaagagcaactgagcaagacgaagcaggctctctgacatagcgagttaacaccattttgaagaaattaaatgcaaagcagttgtaagcatgattaggcagcttttctttccccttttgttcctgctcggaggaaatgatgcttcagagttcagattaactatgtaaattacttgctgtatattgtcctaatgtaagggcatgtgaacatctgccctaaatggctttagttc

SEQ ID NO: 41269 - protein, 319 aa, Panicum virgatum
  misc_feature: Ceres CLONE 2007184
  misc_feature (1)..(241): Pfam Name: Nse4 Pfam Description: Nse4
MDRIEKLHEKVQRPLEQLVDGEALLELANVLVSSTKEENRNGPTPSEFVTVLLRKFGVTATPLNDSNESIDWSSLGAATSTLFMTATGCQTMHGPMDLAIKERRCVFRRESGRLDSRPAEPDALVPDQDERNDTDKNIAVMFSLLVHHKSIKLEHLILNRQSFAQTVENLFALSFLVKDGRAEINVVDSGDHFVAPRNAPAAGLIASRKVTNSQFVFRFDTEDWQIMQRVVKPGEEVMPHRSSYHGGEYRNTQSCPTRDCTKLVSDSEHLKEDKFAKEDPTEFTDDEAVKKLTNWCSEDDTPKKRRRQHVARRLFSADD

SEQ ID NO: 41270 - DNA, 694 bp, Panicum virgatum
  misc_feature: Ceres CLONE 2007185
  misc_feature: Encodes the peptide sequence at SEQ ID NO. 41271
ctcatcacttgttcattattgtgtatctggcgctcattgttcatggccagtgcctgtacctcattcatgtctggtacagaaaaacgacatggatgtatctggcggtgcctgtttgcttgtatgtaggggagagggtgctgaggttcttcaggtctggcagttattctgtcaggttattgaaggtggccatatatcctggtaatgtcttgacactgcaaatgtccaagcctcctgctttccggtacaagagtgggcaatatatgtttgttcaatgtccagcagtgtcaccctttgaatggcatcctttctcaattacttcagcgcccggagatgattatctcagcattcacgttagacaacttggtgactggacacgagagctcaagagggtatttgcagcagcttgcgaacccccagtgggtggtaaaagcggccttcttagagcagatgagacaaccaagaaagccttaccaaagcttctgattgatggaccttatggctctcctgctcaggattacagcaagtatgatgttcttctacttgttggattaggaattggtgcaactccttttatcagcatattgaaagatctgcttaacaatatcatcaaaatggaggaagatgaggatgcttccactgatctttatccaccagttggtccaaataagccgcacattgatctgggcacacttat

SEQ ID NO: 41271 - protein, 230 aa, Panicum virgatum
  misc_feature: Ceres CLONE 2007185
  misc_feature (53)..(169): Pfam Name: FAD_binding_8 Pfam Description: FAD-binding domain
  misc_feature: SWISSPROT Homolog: EC 1.6.3.1 NAD(P)H oxidase
HHLFIIVYLALIVHGQCLYLIHVWYRKTTWMYLAVPVCLYVGERVLRFFRSGSYSVRLLKVAIYPGNVLTLQMSKPPAFRYKSGQYMFVQCPAVSPFEWHPFSITSAPGDDYLSIHVRQLGDWTRELKRVFAAACEPPVGGKSGLLRADETTKKALPKLLIDGPYGSPAQDYSKYDVLLLVGLGIGATPFISILKDLLNNIIKMEEDEDASTDLYPPVGPNKPHIDLGTL

SEQ ID NO: 41272 - DNA, 700 bp, Panicum virgatum
  misc_feature: Ceres CLONE 2007186
  misc_feature: Encodes the peptide sequence at SEQ ID NO. 41273
ccaccccaccccacaggcacagcagccgccggcgccgccgccgcagaccgacccgaggcgagcacggaagcggcgattcgccgacgctccttcagatcttcggcgagccgtgactgagacctctgctgccgtccgccgagcagtttaatcttcacctgcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggcggagcgcgagagaggtatcaccattgatatcgccctgtggaagttcgagaccaccaagtactactgcacggtcattgatgcccctggacaccgtgacttcatcaagaacatgatcacgggtacctcccaggctgattgtgctgtccttatcattgactccaccactggtggttttgaggccggtatctccaaggatggccagacccgtgagcatgctctccttgctttcactcttggagtcaagcagatgatctgctgctgcaacaagatggatgccaccactcccaagtactccaagggccgttatgatgagattgttaaggaagtctcctcctacctgaag

SEQ ID NO: 41273 - protein, 178 aa, Panicum virgatum
  misc_feature: Ceres CLONE 2007186
  misc_feature (5)..(178): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYL

SEQ ID NO: 41274 - DNA, 708 bp, Panicum virgatum
  misc_feature: Ceres CLONE 2007208
  misc_feature: Encodes the peptide sequence at SEQ ID NO. 41275
attcgtctccctcctccattctcccgtttgcttgattgattggcgagcaaccaccccacaaccgcggcagcaatcccctcgccatctccgcgtcgcggaatcccttcgccattgccgaggaggcggggtcgccgcggcgggaggtggtgttccggatctcggatggcgtcggcgaagtcgtcgcggtcgcggccggcgggccactcgggggtgttcccggtgggcagcgccgcggcggtggggagcagcgggggcgggggaggcggcggcggcggcggcgacggcggggtgcagctcgccgacaagctcaagatcttcaagaccgacaacttcgatcccgacgcctacgtgcagtccaagtgccagaccatgaacgagaaggaaatacgacatttgtgttcttatctgcaagacttaaagaaagcttcggctgaagagatgcgcaggagtgtttatgcaaattatgcttcgtttatcagaacatcaaaggagatttcggaccttgaaggggagctactgtcaattagaaatctgcttaatacacaggcagctttaattcatggtctgtctgaaggagttcagatagattcattgacatcaggccctgaaggttccgcagaagacgacatatccaatgttgaagatcaggagcctttccgaaattcagaaatggtctgcagattttcctgacatgcttgacgttttgct

SEQ ID NO: 41275 - protein, 175 aa, Panicum virgatum
  misc_feature: Ceres CLONE 2007208
  misc_feature (52)..(138): Pfam Name: Vps51 Pfam Description: Vps51/Vps67
MASAKSSRSRPAGHSGVFPVGSAAAVGSSGGGGGGGGGGDGGVQLADKLKIFKTDNFDPDAYVQSKCQTMNEKEIRHLCSYLQDLKKASAEEMRRSVYANYASFIRTSKEISDLEGELLSIRNLLNTQAALIHGLSEGVQIDSLTSGPEGSAEDDISNVEDQEPFRNSEMVCRFS

SEQ ID NO: 41276 - DNA, 1946 bp, Panicum virgatum
  misc_feature: Ceres CLONE 2007210
  misc_feature: Encodes the peptide sequence at SEQ ID NO. 41277
acactgctcccacgccgaagcaccaccaccaaggcccaagcagctgctcattagtgagctagaagtagctagctagaaagaacaatggctgccggcggcggcggcatggccgacgagaaggcgcccgaggcgttcgggctgagccggcacgtggcggaggcggagatggaggaggagcacggcggtgctggtggcggcgagtcgtccagcgtcaagtcgaagctgtccgggctgctgtggcacggcgggtcggcgtacgacgcctggttcagctgcgcctccaaccaggtcgctcaggtcctcctgacccttccctactcgttcgcccagctgggcatgctgagcggcatcctgttccagctcttctacggcctgatgggcagctggacggcgtacctgatcagcatcctgtacctggagtaccgcacccggaaggagcgcgacaaggtggactaccggaaccacgtgatccagtggttcgaggtcctggacgggctgctgggccgccactggcgcaacgccggcctcgccttcaactgcaccttcctcctcttcggctccgtcatccagctcatcggctgcgccagcaacatctactacgtcaacgaccgcctcgacaagcggacgtggacctacatcttcggcgcctgctgcgccaccaccgtcttcatcccctccttccacaactaccgggtctggtccttcctcggcctcgtcatgaccacctacaccgcctggtacatcgccgtcgcctcgctcctccacggccaggtcgagggggtcgcgcactcggggcccaccaggatcgtcctctacttcaccggcgccaccaacatcctctacacattcggcggccacgcagtcacagtggagatcatgcacgcgatgtggcgtccccagaagttcaagtccatctacctgctggccacggtgtacgtgctgacgctgaccctgccgtccgccgccgccgcgtactgggcgttcggcgacgcgctgctgacccactcgaacgcgctggcgctgctgccgcgcacgcccttccgcgacgccgccgtggtgctcatgctcatccaccagttcatcaccttcgggttcgcgtgcaccccgctctacttcgtctgggagaagctcatcggcctccacgactgccgcagcctctgcaagcgcgccgccgccaggctccccgtcgtcgtgcccatctggttcctcgccatcatcttccccttcttcgggcccatcaactccgccgtcggctcgctcctcgtcagcttcaccgtctacatcatcccggcgatggcgcatatggtcaccttcaggtcgccgcagtccagggagaacgcggtggagcggccgccgaggttcgccggagggtggacgggcgcgtacgtgatcaactccttcgtggtggcgtgggtgctggtggtcggcttcggcttcggcggctgggccagcattaccaacttcgtgcagcaggtcaacaccttcggcctcttcgccaagtgctaccagtgcccgccgcacctcgctgccccgccgccgcccatggccccggcccccgccatgccaccggcgacggccttcaacgccaccgggttcttccctccggtcccagccccagctccggcgccgtcgcccatgatgaacttcttcctccgccaccaccaccacaggcaccacggccgccatggcctgtgatcgacatggccgcctcaagttaatctggcagattagtatatgttctccgttcgagtttgctgtagttgtagtgctactgcctacttgttgatgggcagcagcgaggttgttcaaggtagccctagtaaaaattcctttgttctactactctatgccaccatctcttcatgttgagagataaaagagagtctggggcggctaggtacctcgagctttgtaccggtagcatgcatttcaagcagagatgtgat

SEQ ID NO: 41277 - protein, 536 aa, Panicum virgatum
  misc_feature: Ceres CLONE 2007210
  misc_feature (53)..(447): Pfam Name: Aa_trans Pfam Description: Transmembrane amino acid transporter protein
MAAGGGGMADEKAPEAFGLSRHVAEAEMEEEHGGAGGGESSSVKSKLSGLLWHGGSAYDAWFSCASNQVAQVLLTLPYSFAQLGMLSGILFQLFYGLMGSWTAYLISILYLEYRTRKERDKVDYRNHVIQWFEVLDGLLGRHWRNAGLAFNCTFLLFGSVIQLIGCASNIYYVNDRLDKRTWTYIFGACCATTVFIPSFHNYRVWSFLGLVMTTYTAWYIAVASLLHGQVEGVAHSGPTRIVLYFTGATNILYTFGGHAVTVEIMHAMWRPQKFKSIYLLATVYVLTLTLPSAAAAYWAFGDALLTHSNALALLPRTPFRDAAVVLMLIHQFITFGFACTPLYFVWEKLIGLHDCRSLCKRAAARLPVVVPIWFLAIIFPFFGPINSAVGSLLVSFTVYIIPAMAHMVTFRSPQSRENAVERPPRFAGGWTGAYVINSFVVAWVLVVGFGFGGWASITNFVQQVNTFGLFAKCYQCPPHLAAPPPPMAPAPAMPPATAFNATGFFPPVPAPAPAPSPMMNFFLRHHHHRHHGRHGL

SEQ ID NO: 41278 - DNA, 1689 bp, Panicum virgatum
  misc_feature: Ceres CLONE 2007222
  misc_feature: Encodes the peptide sequence at SEQ ID NO. 41279
atcgaacaaagacctgccctacaaccgagagcacggtcatcgccgttcaatctgcagattttatcgactttgggttccgctctgcaggaaatcgctagttgactttcactgctcaatcattgacgatcgccgaatcgaaaccagcctcgactccagccatcaccatgtcggacgccaactcaccagccgcctcgcgggctgggtcggccgaaccaacccgccaggatgagcatcaagatagccctgcggatgtgcaggatgccgccgacgccggcaatgaatccgacaaggactccgacctcctctccgaaatcgatgaagatcagttcgaggactacgatcccactctggaagagagacccgtcgagatcgacgagaatgtcgccaagactctgaaagccgcaaagcgcaagcggacagatgccgagacagtcaagaagccaaaagagggccgccgacccaagaagcgggcgcgagcggctgaggatgatggtggcgatgtcgaggacggcgagcgcaggcccagaaaggcgcgcgctgcgggcggcgagcggcgagctgcgcggaaggaggccacaccggaggagcaagtaaatgaagaggaccttacccccgaggagcggcggcgccgggcaattcagcgggctatggataacgcgctgaagaaccccacgaagcggaggcgcaagaaggacgatatcgacctcgaagaggagattgacgaccagctcgccaacctcaaggtcgccatggagaaggcctgcctggcggacaacgaagcccgcgagaaaggcatggccgccacccagaagctccagctactccctcaagtcaccgcgcttctcaaccgaacctcgatccaagattccgtcctcgaccccgagaccaacttcctccagtcggtcaaatacttcctcgagccgctgaacgacggcagcctgcctgcctacaacatccagcgcgacatcttcaatgctctcgccaagctacccatcaacaaggaagtccttctgagcagcggcatcggcaaggtcgtctacttttacaccaggagcaagcgccccgagcccagcatcaagcgcatcgccgagcgactcgtcggcgagtggagccgtccgatcctgaagcgaacagacgactacaagaagcgccacatcgagacgcgcgactttgattttgccgccgcgaaactagcccaacgccaagaagccgccgtgtccggctcacaaatgacactcgcccagcggcccgcgggcggcaagacgcgcttcgagctggagcgcgagcgcgcccttgcccccgagatcaagcgcgccaaccgtgcccaacccgcaggcctgccggccagttacaccatcgccccgcgcagcacgttcgacccgtcgcgcagcgcggcagagttccgccccgctggggctgcgggcatggacgcgttcaggaagatgacgcagaaggggaagggcggcgggcgtcgttagttgtgggagggccgtcggtgatactgggttggggagttggcttgccgtttctcttttggcttttggtgagagaggtgggtgggatggtgataaagggtgcttttgccctgactgggattggactttgggggtatggacgttgggtcttgactggcagacatattcataaccctggaatcagagggatgcaggaggcgtttctccttggcag

SEQ ID NO: 41279 - protein, 437 aa, Panicum virgatum
  misc_feature: Ceres CLONE 2007222
  misc_feature (187)..(436): Pfam Name: IWS1_C Pfam Description: IWS1 C-terminus
MSDANSPAASRAGSAEPTRQDEHQDSPADVQDAADAGNESDKDSDLLSEIDEDQFEDYDPTLEERPVEIDENVAKTLKAAKRKRTDAETVKKPKEGRRPKKRARAAEDDGGDVEDGERRPRKARAAGGERRAARKEATPEEQVNEEDLTPEERRRRAIQRAMDNALKNPTKRRRKKDDIDLEEEIDDQLANLKVAMEKACLADNEAREKGMAATQKLQLLPQVTALLNRTSIQDSVLDPETNFLQSVKYFLEPLNDGSLPAYNIQRDIFNALAKLPINKEVLLSSGIGKVVYFYTRSKRPEPSIKRIAERLVGEWSRPILKRTDDYKKRHIETRDFDFAAAKLAQRQEAAVSGSQMTLAQRPAGGKTRFELERERALAPEIKRANRAQPAGLPASYTIAPRSTFDPSRSAAEFRPAGAAGMDAFRKMTQKGKGGGRR

SEQ ID NO: 41280 - DNA, 419 bp, Panicum virgatum
  misc_feature: Ceres CLONE 2007225
  misc_feature: Encodes the peptide sequence at SEQ ID NO. 41281
ttgtggcaatgtccatagtatttactggaaatccgaagatgacgtaagcgttgctggtctgggaggtgaatcagaggtccatccttacgtctcctttaccataaactttgtctgaacccagtatgtggcctattgtctgccaatattttgaagcagctattaccttgagtaatcgaaacaaacgaatggttcatgtatattacttgtgatacgccaattctttcttgatttgtcgctcttctctggtcctgtaatttatgttggagagatctgccgatcaataatgtagcttttgaggaaactgaaatatgttgtggctgaagaagagatccatcaccttgtaaagcttctgtggatatttttgtaacattgggctactggatttatactgtaataaagccgtgtcaaataaatcctgg

SEQ ID NO: 41281 - protein, 37 aa, Panicum virgatum
  misc_feature: Ceres CLONE 2007225
  misc_feature: SWISSPROT Homolog: EC 3.6.3.14 H(+)-transporting two-sector ATPase
CGNVHSIYWKSEDDVSVAGLGGESEVHPYVSFTINFV

SEQ ID NO: 41282 - DNA, 682 bp, Panicum virgatum
  misc_feature: Ceres CLONE 2007226
  misc_feature: Encodes the peptide sequence at SEQ ID NO. 41283
acttcccaacaacatcgccgttgcacttcaggattccaagctatcacccacagacagccacattactatagccatggcggcgagctcggaccaaacaagcatcaacgtcctcctcgtcccgttcccggtccagggccacatcaacccgctgctccagttcggcaagcggctcgccagccacggaggcgtccggtgcaccctcgcggcgacccgcttcgtcgccaactccaccaggccgaccccgagctcggtgcacgtcgccgtcttctccgacggctgcgacggcggcgggcccgacgaggtcggggggatgggcgccccctactacgagcgcctcgagtcggccgggtccgcgacgctggacgcgctcctcgcttcggagtcggagcggggccggccggtgcacgtggtggtgtacgacgcgttcctgccgtgggcgcggcgtgtggggaggcggtacggtgcggcgtgcgcggcgttcctcacgcagacgtgcgccgtggacatcctgtacgcgcacgcctgggccggccgcgtgccgccgccgccgctgctgcgggcggaggacgtgcggggcctgggcgggctgtcgtgccggctcgaggtgggcgacctgccgacgttcctgaccgacgctagctaccccccgtcgttcagggagctgctggtgaaccagttcctg

SEQ ID NO: 41283 - protein, 202 aa, Panicum virgatum
  misc_feature: Ceres CLONE 2007226
  misc_feature: SWISSPROT Homolog: EC 2.4.1.121 Indole-3-acetate beta-glucosyltransferase
MAASSDQTSINVLLVPFPVQGHINPLLQFGKRLASHGGVRCTLAATRFVANSTRPTPSSVHVAVFSDGCDGGGPDEVGGMGAPYYERLESAGSATLDALLASESERGRPVHVVVYDAFLPWARRVGRRYGAACAAFLTQTCAVDILYAHAWAGRVPPPPLLRAEDVRGLGGLSCRLEVGDLPTFLTDASYPPSFRELLVNQF

SEQ ID NO: 41284 - DNA, 1621 bp, Panicum virgatum
  misc_feature: Ceres CLONE 2007231
  misc_feature: Encodes the peptide sequence at SEQ ID NO. 41285
cgtgctgcgacctgcgacccgcgagccggcaaaacaaaggctacgacgaccaaacggcgtggccgccgcgtgcgcgggtacggtgagcctgcacctgcccgcggcctgccggatgccgccgagagaccgagaggagaatcgaagagaatacccatcactagctagatgccacgaggcccagaggagaaggggtggcgaggatggccggggctgacggcggcgaacgcccgcggcttggcctatatatgagaggccgtggatcgtatccgagcagccgcaggccattccattccagggccaggccagcagcttccgttagccgcccgcccggcctttcccaccaccggagcgcgagatgggtgctcgcggcctccctcgggctctgccttccgcgccggcggcggcgctcctcctcctcctctgcctggtggtcgcgccggcggcggcgcgcgggcacagcagggaagacgacgctcccaccggcaccggcggcggctgcaacagcggcggcggcggcacggccccgccgcggctgtgggtgttcggggactcgtacgcggacacggggaacctgggcgacctcgggcgggagctgacgcacgcgtggtacgacccctacggcgacaccttccccggccgccccaccggccgcttctccgacggccgcgtcctcaccgacttcgtagcttcggccatggggatgccgacgccggtggcgtacaagctgcgcaggggcgccgcccaggggctcctcgcgcgcggcatgaacttcgccgtcggcggcgccggcgtgctcgacaccggcaacttccagcgcaacatcagtgcccagatcgacctgttccaggcccaggcgcagcgcggcgctccctccagcaaccgcggctgcgccggcgccggcgtcgcgctcgtcgtcgtctctggcaacgactactcctacgccgccgacaaggacaacggcacgagcgcggcgatcgcgtacatcccgacggtggtgcggcagctccgggagcagctccggcggctgcgcgacgaggccgggatgcgccgggtggtggtcaccggcctgcacccgctcgggtgcacgccgctcttcacccgcccgctcaactacagcggctgcgacccgctcgccaacgccggcgccgcccagcacaacgccgcgctccggtccgtgctcgccgcgctcgacccggccaaccgcaccttcctcctcctcgacctcaacgcgcccttcgccgccctcgtcgacgctccgccgggggggaggttcgccgagcagaggcggccgtgctgcgaggccctcgccgccgacggctactgcggccagcaggacgacgacggcaagaggatgtacacgctgtgcgacgaccccgcagagcacttctactgggacgacgtgcacccgacgcaggcggcatgggccgccgtcgccgaggctttcaggcccaagatccgcgagtttctcctctccacctgaccagaccttggattccgactattttttgttctgccggggataaaaaaaatgcgcaaaagaaacgcccaaagctaacaaaatgttcttggtctgtctaccagaatcatcatattagtgaaattctactgttactgttcctct

SEQ ID NO: 41285 - protein, 374 aa, Panicum virgatum
  misc_feature: Ceres CLONE 2007231
  misc_feature (60)..(363): Pfam Name: Lipase_GDSL Pfam Description: GDSL-like Lipase/Acylhydrolase
  misc_feature: SWISSPROT Homolog: EC 3.2.1.51 Alpha-L-fucosidase
MGARGLPRALPSAPAAALLLLLCLVVAPAAARGHSREDDAPTGTGGGCNSGGGGTAPPRLWVFGDSYADTGNLGDLGRELTHAWYDPYGDTFPGRPTGRFSDGRVLTDFVASAMGMPTPVAYKLRRGAAQGLLARGMNFAVGGAGVLDTGNFQRNISAQIDLFQAQAQRGAPSSNRGCAGAGVALVVVSGNDYSYAADKDNGTSAAIAYIPTVVRQLREQLRRLRDEAGMRRVVVTGLHPLGCTPLFTRPLNYSGCDPLANAGAAQHNAALRSVLAALDPANRTFLLLDLNAPFAALVDAPPGGRFAEQRRPCCEALAADGYCGQQDDDGKRMYTLCDDPAEHFYWDDVHPTQAAWAAVAEAFRPKIREFLLST

SEQ ID NO: 41286 - DNA, 1939 bp, Panicum virgatum
  misc_feature: Ceres CLONE 2007244
  misc_feature: Encodes the peptide sequence at SEQ ID NO. 41287
gacgcacacgatgaccgcaacaaacgaagctggaggagacatgtcggagttgaaagactccgaagccaatgaaagtgtcgcccacggacatcatcatgcacattttccgtcaatgccggccgttacgatggcaacagaagccaccgctgagtcccctgacccgtcgccgcttccggacctcacgactcagttccagaatcctctcgggtatgcaacgttcgcagatggatacgaactgattgcagagatcggaaagagtgacttcgatgtcgtttaccgcgcccgatgcctcgccaactcgagtctgaaggacgctgctgtcaaagtaattgatcttgacagactgcgggcaacagcgactcaactctccgaagaactcaagctgatgagcggacttcaacaccccagtctcgcttctgttcatacgtgctttatcgatggggtggacctctgggttgtgatgcctttgtttgaaggaggatcttgcgctcgaattctgcaaaccatagctcccgatggtattcgtgacgaatgcgtaattgcaactgtgctgcgagaagctgtgcttgggctccagttcatgcactctcacggcctctgtcaccgaggagtcaaggctggcaacatcctgctgaccgcccaaggcaatgttcgattgagtgacccttgcttgtccccatgccgcatcgcatcggatggcggggacgagcagccgtctcatgagtacctgtgttggatggcacccgagtgtgtgcaagcttccgaaccctctgctcctcaacccagtgctgatatttgggcagttggtatcacagctttggagctcgcctttggctctgcaccttattcttcgcaaccaccgatgaaagtgatgctgcgcctccttggagaggacccgccaagcgcagaatcctacgcccgtccggatcgtgagctcagcaaggagctcacgtcattcatccgtcgctgtctcaaaaagtctccagagaagcgaccgtcggcggcagatttgttggctggcccgttcctttcaacgtttgctcgggacagccagtatctggtggaccatgtgatcctgcggctgccgcacaactacatgagcagtcagcccgacgcgcctcccgtgcactcaaagcgccgctccagaccgcacagggaacgcgcctcctccttcgctggccggcccggcgtgcctattgcgctcaccccgacccgcgccgagcacatggggtcagtcgcacccttcaacgcgggcaaatggctaaccgcagcctcagggcacgcaggcgactccctgtccccgcactccgccagcctccaagtgcgcagctcgagcgtcggggaaaccaaggaggctggcgtgcgctcaccgcctcagcagttccggaagccggcttcctcgaccgacctcggcgccgactccgaacccgaggcgatgacccctcgggacgacactgtgcaccagccggccgtcccgcccatcctcgagctgcccgagtcgcacgcggtctactcgcacgaacactcggagcactccgcgcgcgagcccggcacgccgcgtgactcactgatccagtccgcatctactgactcgcatccgctctcagtcgcgctcttctccccgggcgaaaccgtcgacggcctctactcgccctcgacagtggccggcatcgtatcgcctgcggtgcggcacgccacagccccaacgctgcccccgcccatccccttacagagcctcgacggctccttgcgccctccgcccgcctcgctattgggccagttcgctgccgagtcgtcagatctcaccgagccctcgcccccgccacagtccggccagtcgagccccccgccaccggacctggattctgcccgcgcaagtccggactcttccaaccttccatcctcataactcattgcgaatacactcgacattttgatc

SEQ ID NO: 41287 - protein, 593 aa, Panicum virgatum
  misc_feature: Ceres CLONE 2007244
  misc_feature (35)..(301): Pfam Name: Pkinase Pfam Description: Protein kinase domain
  misc_feature: SWISSPROT Homolog: EC 2.7.11.1 Non-specific serine/threonine protein kinase
MATEATAESPDPSPLPDLTTQFQNPLGYATFADGYELIAEIGKSDFDVVYRARCLANSSLKDAAVKVIDLDRLRATATQLSEELKLMSGLQHPSLASVHTCFIDGVDLWVVMPLFEGGSCARILQTIAPDGIRDECVIATVLREAVLGLQFMHSHGLCHRGVKAGNILLTAQGNVRLSDPCLSPCRIASDGGDEQPSHEYLCWMAPECVQASEPSAPQPSADIWAVGITALELAFGSAPYSSQPPMKVMLRLLGEDPPSAESYARPDRELSKELTSFIRRCLKKSPEKRPSAADLLAGPFLSTFARDSQYLVDHVILRLPHNYMSSQPDAPPVHSKRRSRPHRERASSFAGRPGVPIALTPTRAEHMGSVAPFNAGKWLTAASGHAGDSLSPHSASLQVRSSSVGETKEAGVRSPPQQFRKPASSTDLGADSEPEAMTPRDDTVHQPAVPPILELPESHAVYSHEHSEHSAREPGTPRDSLIQSASTDSHPLSVALFSPGETVDGLYSPSTVAGIVSPAVRHATAPTLPPPIPLQSLDGSLRPPPASLLGQFAAESSDLTEPSPPPQSGQSSPPPPDLDSARASPDSSNLPSS

SEQ ID NO: 41288 - DNA, 1208 bp, Panicum virgatum
  misc_feature: Ceres CLONE 2007251
  misc_feature: Encodes the peptide sequence at SEQ ID NO. 41289
gttccacttcggatcttgaaggtgtcaatggctctctacaacttcaaaaagattcaagttgtcccaaatggcaaagagttcatggacattgttttgacacgaacccaaaggaaaacccccacagtcgtccaccctggttatgcgatcagccgaatccgtaagttttacatgagaaaggtcaagtatacccaatcgaccttgcatgacaaactgtcacaaattttgactgactttcctgtccttgatcaaattcaccccttttatggcgatttgatgaacgtcctttatgacaaagatcactacaaacttgctcttggccaattaagcacagcacgacatcttattgacaccattgcaaaggattacctccgtttgttgaaatttggtgattctttgtaccgttgtaaacaattgaaacgtgctgctcttggaagaatgatgaaagtactcgtcaaaaatggtacttccctctcttatcttgaagaagtccgtcaacatcttgctcgtcttccatccattgacccgaataccagaactctcctcgtttgtggatatccgaatgtaggaaaaagttctttcatcaacaaaatcaccagagccaaagttgatgttcaaccttatgcattcaccacaaaatcattatttgttggacacatggattaccgattttctagatggcaagtcattgataccccgggaattcttgaccatcctctagaagaacgaaatacaattgaaatgcagtctgttaccgcccttgctcacctcagagcctcagttttgttctttattgatatttctgaaagttgcggatacaacattgaacaacaatgcaatttatttcacagcttacgccctcttttcaataacaaaccattgcttcttattatgacaaaaactgatttaatagatccaaattctttatccccacataacagaaaattaatcgaagaagcatcgaaagacgaaaatgttcatttactcccgatgagtactctctcagaagacggagttagtgatgtcaaaaaaactgcttgcgagttattacttgcacagagagttcaaattagattaaaaggaagtaaaatgggagatattggcaatagaatgcacttggctgagcctgtcgcaagagataaaaattgaaaagacctccctcaaattccagattcagttatggctggacaaaaaaaaagttgctgaaaaaa

SEQ ID NO: 41289 - protein, 372 aa, Panicum virgatum
  misc_feature: Ceres CLONE 2007251
  misc_feature (235)..(292): Pfam Name: NOG1 Pfam Description: Nucleolar GTP-binding protein 1 (NOG1)
  misc_feature (169)..(292): Pfam Name: MMR_HSR1 Pfam Description: GTPase of unknown function
MALYNFKKIQVVPNGKEFMDIVLTRTQRKTPTVVHPGYAISRIRKFYMRKVKYTQSTLHDKLSQILTDFPVLDQIHPFYGDLMNVLYDKDHYKLALGQLSTARHLIDTIAKDYLRLLKFGDSLYRCKQLKRAALGRMMKVLVKNGTSLSYLEEVRQHLARLPSIDPNTRTLLVCGYPNVGKSSFINKITRAKVDVQPYAFTTKSLFVGHMDYRFSRWQVIDTPGILDHPLEERNTIEMQSVTALAHLRASVLFFIDISESCGYNIEQQCNLFHSLRPLFNNKPLLLIMTKTDLIDPNSLSPHNRKLIEEASKDENVHLLPMSTLSEDGVSDVKKTACELLLAQRVQIRLKGSKMGDIGNRMHLAEPVARDKN

SEQ ID NO: 41290 - DNA, 710 bp, Panicum virgatum
  misc_feature: Ceres CLONE 2007268
  misc_feature: Encodes the peptide sequence at SEQ ID NO. 41291
cttccattttcgtcgaatcccaggtcttaccaatttaattctttaaggttcttgctccccacttccgcaattggagccacctgcttccgattcctctttctgcagtcgtggagttgtcaaagattcagatttcttgctcctccgcagcaacttgacagggtccgagtgccggagggcggcagctggtagtttccatggttcttggtttgctgctgctggggtggagataacacgggggaggagattgggggcaggcggcgggcgcgcgggatgatggagccccaggcggtggacctcgaggatgacagcatcaacttctgggcttccctcggcgtcaacccccatgtcgaccagatgccgctgcacaacgtccacatcgtcgaccaccaggctcagccaccgccggccgcggcagcggcacagccacagtccgtctgcagggacctcttcccagttgaggccgacgcttgcctggaacctcggttggggatggagtttgagtctggcgaggctgccaaaaccttctacattgcttacgccggccgtgttgggttctccatccgcattgcccggtcgcgcaagtccaagtgcagtgagtccattatcatgctacgattcgtgtgctcgagggaagggttcagcaaggagaaacgctccgtcgcagctgggacgaagacgaggaagcggcccgcctccattagggagggctg

SEQ ID NO: 41291 - protein, 146 aa, Panicum virgatum
  misc_feature: Ceres CLONE 2007268
  misc_feature (84)..(146): Pfam Name: FAR1 Pfam Description: FAR1 family
MMEPQAVDLEDDSINFWASLGVNPHVDQMPLHNVHIVDHQAQPPPAAAAAQPQSVCRDLFPVEADACLEPRLGMEFESGEAAKTFYIAYAGRVGFSIRIARSRKSKCSESIIMLRFVCSREGFSKEKRSVAAGTKTRKRPASIREG

SEQ ID NO: 41292 - DNA, 713 bp, Panicum virgatum
  misc_feature: Ceres CLONE 2007278
  misc_feature: Encodes the peptide sequence at SEQ ID NO. 41293
aatccagtcacatggatactatgcactaaggcggctctctcagcgagcctgtcgaggccaaatggctgcgagagccgccgccgccgccatgctgccatgcctcctcctgctcccgtttctccttctagctgctgcttccggcgccgccaacgatgcagccggcagcacgccgccgatcagccggaaaagcttccctgagggcttcgtcttcgggacggcctcgtcggcctatcagtatgaaggtggtgctaaggaagggggcagaagaccaagtatctgggacactttcacccaccagcatccagaaaaaatcgctgacggaagcaacggggatgtagcagtggactcctaccatctttacaaggaagatgtgcgcctcatgaaggacctggggatggatgcgtacaggttctccatttcatggagcagaatccttccaaatggcagtctgagcggtggaattaatagggaaggtgtcaattactacaataatctcattaatgagctcctgtccaaaggaatgcaaccctatgtgaccctttttcactgggacacacctcaggcattagaagataaatatgagggatttcttagccccaatattgtaaatgacttcaaggactatgctgacgtctgcttcaaggagttcggtgatcgagtgaagcactggatcaccttcaacgagccctggacgttctgcgtaatgggctact

SEQ ID NO: 41293 - protein, 217 aa, Panicum virgatum
  misc_feature: Ceres CLONE 2007278
  misc_feature (40)..(217): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50483
  misc_feature: Useful for making plants with altered cell wall content and/or composition
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50360
  misc_feature: Useful for making plants with modulated biomass
  misc_feature: Useful for making plants with modulated flowering time
MAARAAAAAMLPCLLLLPFLLLAAASGAANDAAGSTPPISRKSFPEGFVFGTASSAYQYEGGAKEGGRRPSIWDTFTHQHPEKIADGSNGDVAVDSYHLYKEDVRLMKDLGMDAYRFSISWSRILPNGSLSGGINREGVNYYNNLINELLSKGMQPYVTLFHWDTPQALEDKYEGFLSPNIVNDFKDYADVCFKEFGDRVKHWITFNEPWTFCVMGY

SEQ ID NO: 41294 - DNA, 724 bp, Panicum virgatum
  misc_feature: Ceres CLONE 2007296-R
  misc_feature: Encodes the peptide sequence at SEQ ID NO. 41295
gcagagcccaaaaaaataggaataccacatttaagaaacgtattaatagcatactcaagacgagcaactcatatcggttactgtcaagcaatgaacatagtgacggctactttgtgcttttatatgcaggaagaagaggctttctggactctttctgctatttgtgaggatattgtaaaagattattatcttgaaggactccaattaattggatcaattgttgatttgaatacattcgtctctctggttgcccactacttcccagaactaaacaaacatttcattcaccttgaatgtccgattgagaccttaaccctcccttggttcatgtgcttctttttgggctacattcctcaagcggcttcactgacggttctcgatttggtatttgctttcggtaagaatgttttgtttcaagttggtttggccgtatttgctctctgtcgtgatcggttactggcagcaaatgacccagaagacatagcacagataatcaaaaaaggagtaacagacaacctcaagctaatggacatcgctttagaccgttttggaaacctccatgaagagggccttgctgaactctcaaagtccaataaatattcatttatggattcaatgcaaaaacaaattgataaaaagagaattggattattatcaaaacaatatccatcggttgctttacaaattgaaggactattgggtggattcaataaagttgcaatgg

SEQ ID NO: 41295 - protein, 241 aa, Panicum virgatum
  misc_feature: Ceres CLONE 2007296-R
  misc_feature (1)..(155): Pfam Name: TBC Pfam Description: TBC domain
AEPKKIGIPHLRNVLIAYSRRATHIGYCQAMNIVTATLCFYMQEEEAFWTLSAICEDIVKDYYLEGLQLIGSIVDLNTFVSLVAHYFPELNKHFIHLECPIETLTLPWFMCFFLGYIPQAASLTVLDLVFAFGKNVLFQVGLAVFALCRDRLLAANDPEDIAQIIKKGVTDNLKLMDIALDRFGNLHEEGLAELSKSNKYSFMDSMQKQIDKKRIGLLSKQYPSVALQIEGLLGGFNKVAM

SEQ ID NO: 41296 - DNA, 1393 bp, Panicum virgatum
  misc_feature: Ceres CLONE 2007296
gttcagagaaaccacagttttgaggatgtgggtccttcctcgccctgtgtctgcaacagaaagcatcctatttaaagaacttttaactggacaaactgaactcttcaaaatgctccattatgaaacgagcttattcaatggcctagttagtacagtctcctctcaaattcttttttacaggatcgtaatggtgcaaccgaatggaggacagactcttttggcggtttctgattcctatgaaaccctcttcaacaagcaatggacctttttactgaaattggagccgttaatcttaaatattgaaaagatcgaagatcggaggaaatttattcttgataaagtctcagggcttgcccaactcgaagaaggagaagaaggaactgatcagttccaaaaagaatttagattcaaattccctgaaatgaaagaacaaaaattcataacagcctattctggattattatggataccagggaagatgactcctattaatggtgtcatgtatctcacaccagatttcattacttttgaatctggaggacaaaaatttagtttttcttttaaaaacgtcacttctctggtcaaagactcactaacagctgtgaaatggacttatcgggatactgataaatctgaaaaaacctattggatgactgtattagaatcggatggattatttgttgtccttgattcgttatggcaagaccatcttgagcaatggaagagaaaactcgatcctcaagggttggggaaaaaatcaacaaattcgatttctcaaaatatggctcaaatgaaacgagcgacaaaagaaaatgacttctcagccgagttcaacgttcctgataaatttaatgaatttcacgcattccattgccttttctggttcaatggtcgttacaggatgggaaagatttatattactgaaaattttttatgttttcatacaaaagaggattatcttagtgtacatggttatagggttgttatcgcttggaataatgttagattgattgctcccaaggagagcatgttaggaatggtctcaaacgcgattgaaattacttcaatatcaggaaacaaattcttattctgtacagccactcctaatcaatcccgtgatgaaatcatgaacataatgatccctaattggaatgaatgtattaattttagagctcggaagctgaaggagttatcctttttaacgcctccggatccaaatgttacagaaggatgggccatgactctaaacaaagatccctcttaccttcaaggagaaaaggaaaaaaagaaaatgtgggatgactactttgaaacttatggtcctccgatgaatatgatattttctggagattaaacgaattcgtcacaggtcttgggtgtccagatgtttatc

SEQ ID NO: 41297 - DNA, 654 bp, Panicum virgatum
  misc_feature: Ceres CLONE 2007301
  misc_feature: Encodes the peptide sequence at SEQ ID NO. 41298
agaggaaccccggggtcccggaccgactccatttccggccaagaggccaagatccatttcgttccgccattctttttttttccttcttggtgatctgatctagtcgcccccgttcgcgtccattaatcctagcagcggcggacctcagcgagcgagcctgttgtcatctcctcgtactaccgccagccgttacagcgtgcaatggcgctcaacctcgcgcaccagaccggcgcggcggcggccgtgacggcggcgccgcgctcggcggttgtcgcggcggcctccaccgtggcgccgtccgcgacggcgccctcgtcggcgcccgcgctccaggcgcagacggtgacggtggacccggcgccggcgcaggcggcggcggactcggtgaagccggacctcgccatggtgtgccaggcgcttgtggacggcggcaagccggaggcggagcacgcggacgtggccgccgaggtgaagagcaaggagggcgtgccggtgttcgtgatgatgccgctcgacacggtgcgcaaggacggcaacagcctgaaccggcggagggcggtggaggccagcctggcggcgctcaagagcgccggcgtcgagggcatcatggtggacgtgtggtggggaatcgccgaggccgagggccccggccag

SEQ ID NO: 41298 - protein, 150 aa, Panicum virgatum
  misc_feature: Ceres CLONE 2007301
  misc_feature: SWISSPROT Homolog: EC 3.2.1.2 Beta-amylase
MALNLAHQTGAAAAVTAAPRSAVVAAASTVAPSATAPSSAPALQAQTVTVDPAPAQAAADSVKPDLAMVCQALVDGGKPEAEHADVAAEVKSKEGVPVFVMMPLDTVRKDGNSLNRRRAVEASLAALKSAGVEGIMVDVWWGIAEAEGPG

SEQ ID NO: 41299 - DNA, 722 bp, Panicum virgatum
  misc_feature: Ceres CLONE 2007304
  misc_feature: Encodes the peptide sequence at SEQ ID NO. 41300
ccgcgacgagcttgtcgtcaaggccttcttcgaggccgagagggcgcaccgtggtcagaagcgggctagtggtgatccatacttgcagcattgtgtggaaactgcagtgcatctggccaaaatcggcgcaaacgcgaccgtcgtgtctgctggccttctccatgacacaattgatgactcgttcatggactatgatgatatcttccggatgtttggcgctggtgtagccgatcttgttgaaggggtatgaactttttgtttagtttatcattattttagatgagaggataacttcccctgtattagtgtattttactgaaggttttgactagatctgcttctagttattcaagttatctagattagcctgtttatctttagacgttaattgagtcatggactccttttgcttaacatatgggtagctttgctactaaataaacaaagtcctcaaatgatgccaagtctaatttcttgaccttggaagcttctatcctgactgagctacttgtttataagctataggccatagcaatcaacttgtgatgaaatttcttagtaaaatagtcccaactattccattcttaaacctctgtctgttttgttaatattacaaattagacatactttctcaattccctaccaagaatagatgcaagaaactggcctgtgtcatgtattcaatgttttcggtggcatggtcccccaagtccgtcagcatc

SEQ ID NO: 41300 - protein, 82 aa, Panicum virgatum
  misc_feature: Ceres CLONE 2007304
  misc_feature: SWISSPROT Homolog: EC 2.7.6.5 GTP diphosphokinase
RDELVVKAFFEAERAHRGQKRASGDPYLQHCVETAVHLAKIGANATVVSAGLLHDTIDDSFMDYDDIFRMFGAGVADLVEGV

SEQ ID NO: 41301 - DNA, 1935 bp, Panicum virgatum
  misc_feature: Ceres CLONE 2007305
  misc_feature: Encodes the peptide sequence at SEQ ID NO. 41302
gcaactcctcctctccccttcctccgcgctgccagccagccagcccacagcccggcgccatcagtgggtggggtgggtggttgcctgcctccgcctgctccactccaccgcgcccgcgcgcccgcgctgctgaccgccgccccgctcgacttacccgccgccgcccgcgccgcggttggctggctggttggtgctaggtaggtgggcggctgcttgcggcacgcgagcgggcgatccggggcggggatctcggcggcgcggatctcatggaggaggacggctcctctgccgccgccgcggtggagaatggcgcggcggtggaggcggagggatgcgtcgccgtgaaggtgggcgcggagggggagcccgtcggcgatcggggggatctcgcggccgtggaagaggcggcgccgccggcagagggcggatctgaggccgccagcccggccgtagcggcggccgaggaggaggcggcggcggcaacggcaaaggcgccgggcaagaaggctggatccggggacgccgccggggcgcggaaggggaagctgcccaacggcagggcgcccgccgccgtcgcggccaaggggaagcggcccggcgtcctctcgcagagcgcctctttcccagcgcgggggccggccggcggcgccaagaaggctgctgccgtggcggctccggctgccgcgcccaagcaggctgcggcggcggcggccaacggatcaggatcagcggcggcgtcaggacgggcggcggtggcagtggacaagaagccgaaggcgaatccggctgttgctcgccggtcgatgcctgccaagtctggatcagtggatgccgcgccaagtgatgcaactcctgcagtccaagagtcacatgagaatgccgccaaaccattgaagcaagcgcagccagggaaaacagatgatgatgttctctccaccacatcaagtacgaatactccccgtgcagcagcccgcaagagtgctgctgctggcttcagtttcagattggagcagcgtgctgagaagcgaaaggagttcttccaaaagcttgaagagaaaatccatgcaaaggagcttgaacaaacaaatttgcaggaaaaatccaaggagagccaagaggctgagatcaaacttctgaggaagagcctgacatttaaagcgacaccaatgccaagcttttacaaggagcagccacctaaagtcgagttgaaaaagattcccccaacacgtgctagatcaccaaagcttgggcggcacaagccaactacttctgctactgctgcttctgcagatggttctgtatgtgagagcccgcggagcacagcgaattctggcaaggtaaatgaagttgtggaaaacaacaaacctcgggctcctgcaaggaaacctgtccagagatcagtcacaaaacctacgtcccaagtgtctggaactgctaaggctgacccaaggcctgtggttacaaaaccgaaaaccttaaactcgaaacctaaggtttcaagggcaaaggctgcgcaagtacaagacaacccagttgaagttcccccttcagaaccttctgctccacaagagctcacagtcgaacatggtgttggagaagcaacaggacctgatctggctgccccatttgtcacttcgaatgaagtcccagtccatggttgatctgcgtcattttgcctattcatttccttcttgcagttctgtgaatagtgagggtgtgtgcttcattgaaagttgaatctctcaaaattgtcgggtcatggggttatcgtttcctgagtagacattcatttttttcagcttgtcattgagcatgccatgtatattgctttgatattttgtccatgtttacatttcccaatcttgtgtatattggatttctatgtcgttggacatcctaggattattgcaatacattaatgcaactttgtggatc

SEQ ID NO: 41302 - protein, 464 aa, Panicum virgatum
  misc_feature: Ceres CLONE 2007305
  misc_feature (245)..(301): Pfam Name: TPX2 Pfam Description: Targeting protein for Xklp2 (TPX2)
MEEDGSSAAAAVENGAAVEAEGCVAVKVGAEGEPVGDRGDLAAVEEAAPPAEGGSEAASPAVAAAEEEAAAATAKAPGKKAGSGDAAGARKGKLPNGRAPAAVAAKGKRPGVLSQSASFPARGPAGGAKKAAAVAAPAAAPKQAAAAAANGSGSAAASGRAAVAVDKKPKANPAVARRSMPAKSGSVDAAPSDATPAVQESHENAAKPLKQAQPGKTDDDVLSTTSSTNTPRAAARKSAAAGFSFRLEQRAEKRKEFFQKLEEKIHAKELEQTNLQEKSKESQEAEIKLLRKSLTFKATPMPSFYKEQPPKVELKKIPPTRARSPKLGRHKPTTSATAASADGSVCESPRSTANSGKVNEVVENNKPRAPARKPVQRSVTKPTSQVSGTAKADPRPVVTKPKTLNSKPKVSRAKAAQVQDNPVEVPPSEPSAPQELTVEHGVGEATGPDLAAPFVTSNEVPVHG

SEQ ID NO: 41303 - DNA, 607 bp, Panicum virgatum
  misc_feature: Ceres CLONE 2007332
  misc_feature: Encodes the peptide sequence at SEQ ID NO. 41304
ctggagttctaaaaaaaaaaactccgccttctgccgccgcgactccgacgccgccagcctctgcagcagccaccgcgcttcctccgtcggcgccgcccccaacttctccgaccgcgccacgcaggccgccgcgctccgcgtcgtcaacgccttcctcgcccccgccgtcacgctccgcgggccgctcccctccgcgcgcgacatccaggccgcgctccgcatcctcctcgaccgcatcgacgcccccccccccccaaaacttcgccggggagagcagcgccgccgccgcggccgctgacgaggaggagccggagaacgggttcgccggcggcgatcaggccattgacttccctggagggaaggtttcatttgtagctgaaatgaacttccttccggaggcacatggggaaaggatcagctgttatcgtgttcttgacgatgatggcagaacaatatctggaagtagattccgagaggtcaatacggaggtggctctgaaaatgtacagggagatggtcaccctccatatcatggataacatcttctatgaagcgcagaggcagggaagaatctcattttatctcacttccactggcgaggaagcgat

SEQ ID NO: 41304 - protein, 201 aa, Panicum virgatum
  misc_feature: Ceres CLONE 2007332
  misc_feature: SWISSPROT Homolog: EC 1.2.4.4 3-methyl-2-oxobutanoate dehydrogenase (2-methylpropanoyl-transferring)
GVLKKKTPPSAAATPTPPASAAATALPPSAPPPTSPTAPRRPPRSASSTPSSPPPSRSAGRSPPRATSRPRSASSSTASTPPPPQNFAGESSAAAAAADEEEPENGFAGGDQAIDFPGGKVSFVAEMNFLPEAHGERISCYRVLDDDGRTISGSRFREVNTEVALKMYREMVTLHIMDNIFYEAQRQGRISFYLTSTGEEA

SEQ ID NO: 41305 - DNA, 1337 bp, Panicum virgatum
  misc_feature: Ceres CLONE 2007334
  misc_feature: Encodes the peptide sequence at SEQ ID NO. 41306
gtgttcctgtcacggacgcctcgtgcacatggcgcggccccgatctgcgcttgctctccttcctcgaccggccggcttctccagatccgaacggtccgctgtaccacaagggctggtaccacctcttctaccaatggaacccggactccgcggtgtggggcaacatcacctggggccacgccgtgtcgcgcgacctcgtccactggctgcacctgccgctcgccatggtgccagaccactggtacgacgccaacggcgtctggtccgggtcggcgaccaggctcccggacggccggatcgtcatgctctacacgggctccacgacggagtcggtgcaggtgcagaacctcgcggagccggccgacccgtcggacccgctgctccggcggtgggtcaagtcggccgccaaccccatcctggtgccgccgccgggcatcgggctcaaggacttccgcgacccgacgacggcgtggcgggtccccaacgacacggcgtggcgcgtcgccatcgggtccaaggaccggagccacgccgggctggcgctggtgtaccggacggcggacttcgtgcggtacgacccggcgccggcgctgatgcrcgtcgtgccgggcaccggcatgtgggagtgcgtggacttctacccggtggccgccgtcgccggcggcgtggagaacgggctggagacctccgtgccgccggggcccggggtgaagcacgtggtgaaggccagcctcgacgacgacaagcgcgactactacgccatcggcacctacgacgccggggccgacgcctggacccccgaagacgcggcgaacgacgtcgggatcgggctcctctacgactacggcaagttctacgcgtccaagaccttctacgaccccgtgctccggcggcgggtgctgtgggggtgggtcggcgagaccgacagcgagcgcgcagccatcctcaagggatgggcgtccgtgcagtcaatcccgaggacggtcctcctggacacgaagaccggcagcaacctgctccagtggcccgtggtggaggtggagaacctccggatgagcggcaagagcttcgacggcgtggcgctggaccgcggctccatcgtgcccctcgacgtcggcaaggcgacacagctggacatcgaggccgtgttcgaggtggacgcggcggccgtggagggcgtgacggaggccgacgtggggttcaactgcagcaccagcgccggcgcggcggggcggggcctgctcggcccgttcggtctgctcgtgctcgccgacgacgacctctcggagcagaccgccgcctacttctacctggccaagggcaccgacggcagcctc

SEQ ID NO: 41306 - protein, 444 aa, Panicum virgatum
  misc_feature: Ceres CLONE 2007334
  misc_feature (28)..(342): Pfam Name: Glyco_hydro_32N Pfam Description: Glycosyl hydrolases family 32 N terminal
  misc_feature (383)..(443): Pfam Name: Glyco_hydro_32C Pfam Description: Glycosyl hydrolases family 32 C terminal
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
  misc_feature: The sequence is a functional homolog of SEQ ID NO 4 in US patent 7253335
  misc_feature (199)..(199): Xaa is any aa, unknown, or other
VPVTDASCTWRGPDLRLLSFLDRPASPDPNGPLYHKGWYHLFYQWNPDSAVWGNITWGHAVSRDLVHWLHLPLAMVPDHWYDANGVWSGSATRLPDGRIVMLYTGSTTESVQVQNLAEPADPSDPLLRRWVKSAANPILVPPPGIGLKDFRDPTTAWRVPNDTAWRVAIGSKDRSHAGLALVYRTADFVRYDPAPALMXVVPGTGMWECVDFYPVAAVAGGVENGLETSVPPGPGVKHVVKASLDDDKRDYYAIGTYDAGADAWTPEDAANDVGIGLLYDYGKFYASKTFYDPVLRRRVLWGWVGETDSERAAILKGWASVQSIPRTVLLDTKTGSNLLQWPVVEVENLRMSGKSFDGVALDRGSIVPLDVGKATQLDIEAVFEVDAAAVEGVTEADVGFNCSTSAGAAGRGLLGPFGLLVLADDDLSEQTAAYFYLAKGTDGS

SEQ ID NO: 41307 - DNA, 804 bp, Panicum virgatum
  misc_feature: Ceres CLONE 2007334-R
gtgcagcattcatcatatggaatgtatcaatacttcatcaaggttgttcccactgtctacactgacataaatgatcacatcatcctctcaaatcagttctctgtgacggaacattttagaagtagtgaaagtggtcgcatacaagctcttcctggcgtgtttttcttttatgacctttccccaatcaaggtcacattcacagagcaacatgtgtcattcttgcacttcttaaccaatgtttgcgcaattgttggtggtgtgttcacagtttctggaatcatagattcatttgtataccatggccagagagcaatcaagaagaagatggagattggtaaattcaactgagtgttgccttcctattgctgccacttattccatcttcagggcttcctttggaagaactctagccgtggtaaagcaagactgcaagcttttggtgcacttgcatagtctggaaacacctgctcattgaatatcgcatggtgtgcttgcttgcttcctgcagaagatgccaggaagcaaaatgatcagcttgtacacttattccgctgtcaaatggaacatttcagaggcgctccatttttgtacgctctagtctaacaggaaaacatttttcttctgtgagatggtgtttgtatcattgtaaatctgtggaagggggcacaagcctctttgtaggattttttttggggttgcaattctgttatctgtgacagattctttttctcggatgtttgtagacttcacagataaagagtaaaaaaaatgtaaagaccatttcaaggaaagacaatttttctt

SEQ ID NO: 41308 - DNA, 1802 bp, Panicum virgatum
  misc_feature: Ceres CLONE 2007336
  misc_feature: Encodes the peptide sequence at SEQ ID NO. 41309
atcccttgctctctgtccgttcctcgcctctagcaggggagcaatggtcctatctcgcctcttcgtggtcgtcctcagcgccgccatggctgctgtactcttcttctctcctgccgatgccggcgtagtgggggtgaactacggcacgctggcgaacaacctgccggacgtggcgtcggtggtaaggctgttgcagaggaacggcatcaaatcggtgaggctgtacgacgccaacgcaatggtgctcaatgccctggccaacaccgggatcacggtgatagtgatgttgcctaacgacaacctcgccgccgcggccctggacccatcgaacgcgcgccggtgggtgcagaggaacgtggcggcgcactaccctgccacgcggatcatcgccgtggacgtgggcaacgaggtgttcctgaaggcgaagaacctgacccggctgctcgtcccggccatgaacaacgtctacgccgcgctggtgaggctgcgcctgcagaaggtggtgaaggtgaccacgcccatcgcgttcaccgcgctgaaggtgtcctggccgccgtccgccggcaggttccaggacgacatcgcgcggtcggtgatgcggcccttgatcgacttcctggaccgcaccggatcgtacctcggcgtcaacgcctaccccttcttcgcgtacatcgcacagcctgacaagatacccctcgactacgctttgggaaactacacacccggcgtgcgcgatcccggcaccgggctcgtgtaccacagcctcctcgacgcccagatcgacgccgcccactttgcgatccagaggctggggtcatcgaccagcgtgcgcggccaaggaaattctttggcgcagtatggcccaacgcaggtgaatgttcctgagaacgggcatcctaacggcggcgggctaaaccaaaaaaaaaaaaagagtcctggcaggaggcgtttgatggctgcgggcgatgaagcagccgcggcagcatcggcagcttcggtggccaacgccaaagcctacaacaactacgtcatcaaccgcatcctgtccggcaacacgggcacgccgtaccggcccaacgccgacctgaacatccacatcttctctctgttcaatgagaacttgaaggggttcggaccaggcgacatcgagcaacacttcggcctattctacccgaaccagaccaaggtgtacgacttcgacttccgcggcacccacttaccgccgccgccgccgccgccgccaccgatgccgagctggtgcgtggcgaacgccgccgtcggggacgcgcggctgcaggcggccatggactacgcgtgcggccacggcgcggactgcagcgacatccagcccggcgccgcgtgcttcgagcccaacaccaaggccgcgcacgcctcccacgccttcaacagctactaccagcgcaatggccggaccggcgggacgtgcgacttcgccggcgcggcttccgtcgtctacaaggcgccaaagattggaaaatgcgtgcttccgtccaaggcgtgaattaagttacaacgacagtgaagtctgaaggatacgctgcaatataatctgatgctccacttgttttcaagaaataaatgaccagttttacccttgttaattgtaatatttcccttatcagtgttaccccaacatagcccaccacgtcctcccgaagctccaagcaagaggttattgtgttattagggcataaacattgcgtgtaaaattaagtgttgatatttgttgattgcataattatacggaaagcttgattgcaaatatataagtgttcttccag

SEQ ID NO: 41309 - protein, 492 aa, Panicum virgatum
  misc_feature: Ceres CLONE 2007336
  misc_feature (29)..(387): Pfam Name: Glyco_hydro_17 Pfam Description: Glycosyl hydrolases family 17
  misc_feature (404)..(488): Pfam Name: X8 Pfam Description: X8 domain
  misc_feature (325)..(486): SWISSPROT Homolog: EC 3.2.1.39 Glucan endo-1,3-beta-D-glucosidase
  misc_feature (29)..(260): SWISSPROT Homolog: EC 3.2.1.73 Licheninase
  misc_feature: Functional homolog of the protein sequence given in SEQ ID NO 51629
  misc_feature: Useful for making plants with altered carbohydrate content
  misc_feature: Functional homolog of the protein sequence given in SEQ ID NO 51178
  misc_feature: Useful for making plants with altered cell wall content and/or composition
  misc_feature: Functional homolog of the protein sequence given in SEQ ID NO 50792
  misc_feature: Useful for making plants with modulated drought sensitivity
  misc_feature: Useful for making plants with modulated water use efficiency
MVLSRLFVVVLSAAMAAVLFFSPADAGVVGVNYGTLANNLPDVASVVRLLQRNGIKSVRLYDANAMVLNALANTGITVIVMLPNDNLAAAALDPSNARRWVQRNVAAHYPATRIIAVDVGNEVFLKAKNLTRLLVPAMNNVYAALVRLRLQKVVKVTTPIAFTALKVSWPPSAGRFQDDIARSVMRPLIDFLDRTGSYLGVNAYPFFAYIAQPDKIPLDYALGNYTPGVRDPGTGLVYHSLLDAQIDAAHFAIQRLGSSTSVRGQGNSLAQYGPTQVNVPENGHPNGGGLNQKKKKSPGRRRLMAAGDEAAAAASAASVANAKAYNNYVINRILSGNTGTPYRPNADLNIHIFSLFNENLKGFGPGDIEQHFGLFYPNQTKVYDFDFRGTHLPPPPPPPPPMPSWCVANAAVGDARLQAAMDYACGHGADCSDIQPGAACFEPNTKAAHASHAFNSYYQRNGRTGGTCDFAGAASVVYKAPKIGKCVLPSKA

SEQ ID NO: 41310 - DNA, 746 bp, Panicum virgatum
  misc_feature: Ceres CLONE 2007339
  misc_feature: Encodes the peptide sequence at SEQ ID NO. 41311
atagatccagatgtcgaatcacgaaggaaatctattatcggagaactccaaagggaagagctacgatttgtccagaccttggaaagaggtgaaaagttattaggtgaccttctagatgaggccttattaagtgatggtaataatggaaataatccttccctatctggaaaggatgttttccttttgtacgatacatatggttttccagtagagattacagctgaaatagctggtgaacgaggtgtcactgttgatatgaagggatttgaaattgaaatggaaaaccaaaggaaacaatctcaggctgctcataatgtagtcaaactttctgtaggaaatgagacagagatagtcaagagcatccctgatactgaatttcttggatatgactcgctctttgccactgctgttgtcaaaggtctcctagttaatggaaacccagttaatgaagtttctgaaggttctgaagtagaaatattattagatcggacaccattctatgcggaatcaggtggccaagttggagataagggtttcttatatttgaatggaggggaggatagaaaacaaacagcagtcatagaaatcactgatgtccaaaagtctctgggaaatatatttgtgcgcaaaggcacgattaagcaggggtctgtagaggttggcagggaaattgatgcctctgttgatgcaaagttgaggcagggtgctaaggcacatcatactgcaacacatttactacaatccgc

SEQ ID NO: 41311 - protein, 248 aa, Panicum virgatum
  misc_feature: Ceres CLONE 2007339
  misc_feature (1)..(232): Pfam Name: tRNA-synt_2c Pfam Description: tRNA synthetases class II (A)
  misc_feature: SWISSPROT Homolog: EC 6.1.1.7 Alanine--tRNA ligase
IDPDVESRRKSIIGELQREELRFVQTLERGEKLLGDLLDEALLSDGNNGNNPSLSGKDVFLLYDTYGFPVEITAEIAGERGVTVDMKGFEIEMENQRKQSQAAHNVVKLSVGNETEIVKSIPDTEFLGYDSLFATAVVKGLLVNGNPVNEVSEGSEVEILLDRTPFYAESGGQVGDKGFLYLNGGEDRKQTAVIEITDVQKSLGNIFVRKGTIKQGSVEVGREIDASVDAKLRQGAKAHHTATHLLQS

SEQ ID NO: 41312 - DNA, 769 bp, Panicum virgatum
  misc_feature: Ceres CLONE 2007350
  misc_feature: Encodes the peptide sequence at SEQ ID NO. 41313
cagaccagtcgcaatcccatcaaccaaagccagaaagcctctcccctctctcaacagcggcgcgcggttcctccccctctcgactcgactcggctccaccccgcccccgcggcgcggcgcgacaagaaaacccaccaaaccctaaccctagctgcggcgccaccgcccgccggagggtcccgagccagcgcgcgaggatgccgtcggggtcggcgacgcagttccgctacacgcagacgccgtccaaggtgctgcacctgcggaacatgccgtgggagtgcaccgaggaggagctcgtcgagctctgcaagcccttcggcagggtcgtcaacaccatgtgcaacgtcggcgccaaccgcaaccaggccttcgtcgagtttgcggatcaaaaccaggcaatttcaatggtttcctattatgcttcatcttcagagcctgctcaagttcgtggtaaaactgtatatatccaatattcaaaccggcaagaaattaccaacaataaaggcactggtgattctactggcaatgtcctgcttgtcacttttgaaggtgttcagcctaatgatgttaccatcgaagtcattcatttggtattttcagcatttggatttgttcacaagatagctacttttgagaaagcagctggtttccaggcacttatccagtatactgatgccccaactgctcttgaagctaaaaactcattggatggaagaagcataccaaaatatttacttccagaacatatcagtgcctggcacatgcgcat

SEQ ID NO: 41313 - protein, 190 aa, Panicum virgatum
  misc_feature: Ceres CLONE 2007350
  misc_feature (19)..(90): Pfam Name: RRM_1 Pfam Description: RNA recognition motif. (a.k.a. RRM, RBD, or RNP domain)
MPSGSATQFRYTQTPSKVLHLRNMPWECTEEELVELCKPFGRVVNTMCNVGANRNQAFVEFADQNQAISMVSYYASSSEPAQVRGKTVYIQYSNRQEITNNKGTGDSTGNVLLVTFEGVQPNDVTIEVIHLVFSAFGFVHKIATFEKAAGFQALIQYTDAPTALEAKNSLDGRSIPKYLLPEHISAWHMR

SEQ ID NO: 41314 - DNA, 1285 bp, Panicum virgatum
  misc_feature: Ceres CLONE 2007352
  misc_feature: Encodes the peptide sequence at SEQ ID NO. 41315
actcctcgcggtcacttcaccagccaaccacgagccggtggagtggcaggcaggcaggcaggctagctcagtagtgagtgcccgagtcgtagccgcctttgaattccacgcggaggggaggcgtcctcgcgctccccggctagacggctagtcccgtcgtttgtcgctcaccacctgatcgagtagcagcagcttcgtcttgtcgaccgccggcggctatataaactgccgcgcaagtcaccgtgctgagcactccagctagagcacgaaccattgtctgactgtcttctgcagttctatgttaccgagctctgctgtgctgtactaaagctagctgcgagtctcactgttggtggtgttgtgcaactggtctgcagagatgggggagaacggtaagcactgctacccggcggcggccatggaggtgacctccgcggagctcggccacacggcggcctccaagtgctacgacgacgacggccgcctcaagcgcaccgggacgatgtggacggcgagcgcgcacatcatcacggcggtcatcgggtccggcgtgctgtcgctggcgtgggccatcgcgcagctcggctgggtggccggccccgccgtcatgctgctcttctccttcgtcacctactacacctccgggctgctcgccgactgctaccgctccggcgacgcgtgcaccggcaagcgcaactacacctacatggacgccgtcaacgccaacctcagtggcgtcaaggtccagatctgcggcttcctgcagtacgccaacatcgtcggcgtcgccatcggctacaccatcgccgcctccattagcatgctggcgatcaagaaggccaactgcttccacgtggaggggcacggcgacccgtgcagcatctccagcacgccctacatgatcatcttcggcgtggcggagatcttcttctcgcagatcccggacttcgatcagatatcgtggctctccatcctggccgccgtcatgtccttcacctactccgccatcggcctgggcctcggcatcgtccaggtggtcgccaacaagggcgtccagggcagcctcaccggcatcagcgtcggcgccgtcacccccgtcgacaaggtgtggcgcagcctgcaggcgttcggcgacatcgccttcgcctactcctactccctcatcctcatcgagatccaggacacgatccgcgcgccgccaccgtccgagtccaaggtcatgcgccgcgccaccatcgtcagcgtcgccgtcaccacgctcttctacatgctctgcggctgcacg

SEQ ID NO: 41315 - protein, 301 aa, Panicum virgatum
  misc_feature: Ceres CLONE 2007352
  misc_feature (38)..(301): Pfam Name: Aa_trans Pfam Description: Transmembrane amino acid transporter protein
MGENGKHCYPAAAMEVTSAELGHTAASKCYDDDGRLKRTGTMWTASAHIITAVIGSGVLSLAWAIAQLGWVAGPAVMLLFSFVTYYTSGLLADCYRSGDACTGKRNYTYMDAVNANLSGVKVQICGFLQYANIVGVAIGYTIAASISMLAIKKANCFHVEGHGDPCSISSTPYMIIFGVAEIFFSQIPDFDQISWLSILAAVMSFTYSAIGLGLGIVQVVANKGVQGSLTGISVGAVTPVDKVWRSLQAFGDIAFAYSYSLILIEIQDTIRAPPPSESKVMRRATIVSVAVTTLFYMLCGC

SEQ ID NO: 41316 - DNA, 626 bp, Panicum virgatum
  misc_feature: Ceres CLONE 2007352-R
ttttacgagcccttctggctccttgacgtcgccaacgccgccatcgtcgtgcacctcgtcggcgcctaccaggtctactgccagccgctcttcgccttcgtcgagaagtgggcgcagcagaggtggcccgagtccaggtacatcaccggcgaggtcggcgtcccgctctccctctccggctccgccggccgctgctacaagatgaacctgttccgcctgacgtggcggacggcgttcgtggtggcgaccacggtggtctccatgctcctgcccttcttcaacgacgtggtcgggctgctcggcgcgctggggttctggccgctcaccgtctacttccccgtggagatgtacatcgtgcagaagaaggtgcccaggtggagcacgcggtgggtgtgcctgcagctgctcagcctcggctgcctcatcatcaccgtggcctccgccgctggctccgtcgccgggatcatctccgacctcaaggtgtacaagccgttcgtcaccacctactgatggatcgatcgttcgtcgcactgaacatatgcacagattgatggacagacagatgatttggcgcctagtatgtgcagtctttaattaaattagtcattaattaattaccacacggt

SEQ ID NO: 41317 - DNA, 673 bp, Panicum virgatum
  misc_feature: Ceres CLONE 2007360
  misc_feature: Encodes the peptide sequence at SEQ ID NO. 41318
aagatccaagaagatcgaagggccgggctgctcgagcgctagctaactactcgccatggccagcaacggcacggacgccgccgccgaggtgccgcagccgccgccgtcgcaggggcggctcatcaccgtgctcagcatcgacggcgggggcatccgcgggctcatcccggccaccatcatcgcctgcctcgaggccaagctccaggagctggacggcccggacgctcggatcgcggactacttcgacgtgatcgccgggacgagcaccggcgccctgctcacgtcgatgctggcggcgccagacgagaacaagcgccccatcttcgccgccaaggacctcaccaccttctacctcgagaacggccccaagatcttcccccagagaaagatggggttcctgaagccggtggcgaacctggtgagcctgatgaggggccccaagtacgacggcgccttcctgcacgacaagatcaagagcctgacgcgcgacatgcgggtcgcggacacgatcaccaacatcgtcgtgccggccttcgacgtcaagtacctgcagccggtcatcttcaccacctacgaggccaaggccgacccgctcaagaacgcgcacctctccgacatctgcatcagcacgtcggcggcgccgacctacttcccggcccacttcttcaccacc

SEQ ID NO: 41318 - protein, 205 aa, Panicum virgatum
  misc_feature: Ceres CLONE 2007360
  misc_feature (26)..(205): Pfam Name: Patatin Pfam Description: Patatin-like phospholipase
  misc_feature: Functional homolog of the protein sequence given in SEQ ID NO 51529
  misc_feature: Useful for making plants with modulated heat sensitivity
MASNGTDAAAEVPQPPPSQGRLITVLSIDGGGIRGLIPATIIACLEAKLQELDGPDARIADYFDVIAGTSTGALLTSMLAAPDENKRPIFAAKDLTTFYLENGPKIFPQRKMGFLKPVANLVSLMRGPKYDGAFLHDKIKSLTRDMRVADTITNIVVPAFDVKYLQPVIFTTYEAKADPLKNAHLSDICISTSAAPTYFPAHFFT

SEQ ID NO: 41319 - DNA, 1800 bp, Panicum virgatum
  misc_feature: Ceres CLONE 2007363
  misc_feature: Encodes the peptide sequence at SEQ ID NO. 41320
cttccagcttcatccacattccactgacaagaagtcacaaaaccctagttggctcgttccccgctctcgtctcgcctaaacctcgcctccgccccccctcaaccccggccggccgaaagacgaaccaccgaaccggcggcggcggcgggtggtagccatggcagagctgaagcggctgtcggagagccgcgacctgacgcggatcgagcgcatcggcgcgcactcccacatccgggggctagggttggactcctccatggaggcgcgcgacgcctccgagggcatggtcgggcagctcccggcccgccgcgccgcgggcctcatcctccagctaatccgccaggggaagatcgccggccgcgccgtgctcatcgcgggccagcccggcaccggcaagaccgcgctcgccatgggtatcgccaagtcgctcggcgcggagacgcccttcgcctccgtcgccgcctcggagctcttctccctcgacctatccaagacggaggcgctcacgcaggccttccgccgcgccatcggcgtccgcatcaaggaggaggcggaaattatcgagggcgaggtcgtcgagatctccattgaccgccccttagcatcctctggcgctggcagcagctccgccgcgccttcgggcgctactgcggccggaaaatccggccggctcacgctgaagaccacggacatggagacggtgtacgagctcggagggaagatgattgaggctcttggaaaggagaaggtgcagagtggggatgtgattgcccttgacaaggcctcggggaaggtcaccaagcttggccgctccattgggaggtcgcgggattatgatgctgttggcccccacaccaagtttgtcaagtgtcctgatggtgagctccagaagcgcaaggaggtcgtgcactgtgtcaccttacatgagattgatgtgatcaatagcaggacacagggttttcttgcactgttcactggggacactggtgaaattcgtgcggaggttcgggagcagattgacacaaaagttgcagagtggagagaagaaggaaaggctgagattgtgcctggggttctgtttatcgatgaagtccacatgctagatattgagtgcttctccttcctcaaccgagcattggaaaatgatatggctccaatcctagtcatcgcaacgaaccgagggatcacatccatccgcgggacaaactaccggtcgccgcatgggatcccgccggacttcctcgaccggctcctgatcatcacgacgcagccctacaaggaggatgagatccggaagatccttgacatccggtgcgacgaggaggacgtggagatgtccgcggacgccaaggtcctgctcaccaagattggcatcgagacctccctgaggtatgccatccacctgatcaatgccgccgcgctggcctgccagaagcgcaaggggaaggtggtggagatggaggacatcagccgggtgtaccagctgttcctggatgtgaagcgatcgacgcagtacctgatggagtaccagagccagtacatgttcagtgaagtgtcgggggaagcagatggagatgatgccatgcattcctagacgacctttgtgttacaaggtggctgggttattgtgcccggcgtcgtgtatttcggatgcttgttgctcgtttaggttgctggtattaccctgacaaggcgtggtgtgtgcgatggactctgttagctgctgtaggtgaaggtgactatgcaattcaatgtatctgatcaaattcatcccagctaagtgccgtgattttttttttt

SEQ ID NO: 41320 - protein, 478 aa, Panicum virgatum
  misc_feature: Ceres CLONE 2007363
  misc_feature (121)..(447): Pfam Name: TIP49 Pfam Description: TIP49 C-terminus
MAELKRLSESRDLTRIERIGAHSHIRGLGLDSSMEARDASEGMVGQLPARRAAGLILQLIRQGKIAGRAVLIAGQPGTGKTALAMGIAKSLGAETPFASVAASELFSLDLSKTEALTQAFRRAIGVRIKEEAEIIEGEVVEISIDRPLASSGAGSSSAAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYKEDEIRKILDIRCDEEDVEMSADAKVLLTKIGIETSLRYAIHLINAAALACQKRKGKVVEMEDISRVYQLFLDVKRSTQYLMEYQSQYMFSEVSGEADGDDAMHS

SEQ ID NO: 41321 - DNA, 748 bp, Panicum virgatum
  misc_feature: Ceres CLONE 2007364
  misc_feature: Encodes the peptide sequence at SEQ ID NO. 41322
ggtggcgtgcctctcacacttgaaccgtctctagcaccaagtactctatccttctcccctagcttcctgctttctctctctgatcgatccctccctcatacgcaaaaacagaaacacagagaacagcctgaaaaagagggttgctggaacaatggaggaagcaaggatcccggggtacttcaagaacaagggcatcctcatcactggctcaacgggcttccttggaaagatacttgtggagaagatactgagggtccagccggacgtcaagaggatctacctcccggtgagagcgccggacgcggaatcggccaagaaacgggtggagactgaggtgatcggtaaggagctgtttgggctcctgcgggagacgcacggcaaggggttccagtccttcgtcgacgacaaggtcgtcccgctggccggcgacatcatccacgagaacttcggcgtggagggagcccagctggcgcagatgacccaagagatgaacgtcatcgtcaacggagccgccaccaccaacttctacgagaggtacgacgtggccctggacgtgaacgtgatgggagtgaagcacatgtgccggctggccaggcagtgccccaacctcgaggtcatcctccatgtctccaccgcttatgtggttggggagaggcagggggtgatccaggagcggccgttcaagcacggcgagacactgcgcggggacgacgcgcggctgcggctggagctggacgtcgacgccgag

SEQ ID NO: 41322 - protein, 198 aa, Panicum virgatum
  misc_feature: Ceres CLONE 2007364
  misc_feature (17)..(197): Pfam Name: NAD_binding_4 Pfam Description: Male sterility protein
  misc_feature: SWISSPROT Homolog: EC 1.2.1.31 L-aminoadipate-semialdehyde dehydrogenase
MEEARIPGYFKNKGILITGSTGFLGKILVEKILRVQPDVKRIYLPVRAPDAESAKKRVETEVIGKELFGLLRETHGKGFQSFVDDKVVPLAGDIIHENFGVEGAQLAQMTQEMNVIVNGAATTNFYERYDVALDVNVMGVKHMCRLARQCPNLEVILHVSTAYVVGERQGVIQERPFKHGETLRGDDARLRLELDVDA

SEQ ID NO: 41323 - DNA, 721 bp, Panicum virgatum
  misc_feature: Ceres CLONE 2007365
  misc_feature: Encodes the peptide sequence at SEQ ID NO. 41324
gaaaggaaagaagctgttgattctttccgtctggatccggaggtgaaggttgtaataattggaattactgctggcggtgttggcttagacttctcatctgctcagaatgttgttttcgtggagctcccgaaatcagcttcggaattgcttcaggccgaggatagagctcatagacgtggccaaactaatgcagtcaacatatatatattctgtgcaaagaacacatcggatgaatcacactggctccaattaaatcagagtctgttccgtgtctcatctttgatgaatggaaaaaaggatgctataagagagatcgaggttgatcaggtgtgccatcttgaggaaatcaggaacactgagaaaatagaatgcaaacttcatcctttggagaatcataatacagaaagtgatgatatttctattgaatgttttcctggcattgaagatttggaacttgactcagatttcactattaggacaattcctcttgaatttgaggatgaaagccttgggacatccttgaaaaataatccaactccaacagtacttgaagatagatcttgcattgatgtttctctttcgccagctgcagccttttgcactgcaatatcaagttgtaaatcaattaaggctcgtaggaggctttctggaaattcagggaccttaagtcagactgcacctatttcagattttcccattcaagtggagtctctgcgttttg

SEQ ID NO: 41324 - protein, 240 aa, Panicum virgatum
  misc_feature: Ceres CLONE 2007365
  misc_feature (1)..(60): Pfam Name: Helicase_C Pfam Description: Helicase conserved C-terminal domain
ERKEAVDSFRLDPEVKVVIIGITAGGVGLDFSSAQNVVFVELPKSASELLQAEDRAHRRGQTNAVNIYIFCAKNTSDESHWLQLNQSLFRVSSLMNGKKDAIREIEVDQVCHLEEIRNTEKIECKLHPLENHNTESDDISIECFPGIEDLELDSDFTIRTIPLEFEDESLGTSLKNNPTPTVLEDRSCIDVSLSPAAAFCTAISSCKSIKARRRLSGNSGTLSQTAPISDFPIQVESLRF

SEQ ID NO: 41325 - DNA, 1807 bp, Panicum virgatum
  misc_feature: Ceres CLONE 2007367
  misc_feature: Encodes the peptide sequence at SEQ ID NO. 41326
aaacacgcttcgcccttctttttcctttgcccaactcgtctcgtcttcgttcccctttcctcctccgcatcccggcttctcctcaccgcgtcaaacccagcaccaagcaaccgcccccgccaatctgccgccgcggtgcctaatccggccgatcccccctccgatccgcgggtgcccgccgcaaaggcggcgcctttgggcctcccccgatgtatagcaacttcaaggagcaggcaatcgagtacgtcaagcaggcggtccaggaggacaatgccggcaactatgtcaaggcgttcccgctctacatgaacgcgctcgagtacttcaagacccacctcaagtacgagaagaaccccaagatcaaggaggcaatcaccgccaagttcaccgagtacctccgccgcgccgaggagatccgggccgtcctcgatgagggcggcgcggggcccggggccaacggcggcgacgcggccgtcgccacgcgccccaagaccaagggcaaggacggggacggcggcaacggcggggacgactccgagcagtccaagctgagggcggggctcaattccgccatcatcaccgagaagccgaacgtcaagtggaacgacgtcgccggcctcgagagcgccaagcaggcgctgcaggaggccgtcatattgcccgtcaagttcccgcagttcttcacgggcaagcggaggccttggagggcttttcttttgtatggcccccctggaacgggaaagtcttatttggcaaaagctgttgcaaccgaggctgattcaacatttttcagtatatcttcatcagatctggtttcaaagtggatgggtgaaagtgagaaattagttgcgaaccttttcgaaatggctcgtgaaaatgccccttcaattatctttatcgatgaaattgattctttatgcggtcaacgtggagaaggcaatgaaagcgaagcttcaaggagaatcaagactgaactacttgtgcaaatgcagggtgttggccataatgatgataaagttcttgttcttgctgctacaaatacaccatatgctctggaccaggctgtgcggcgaagatttgacaagcgtatctacattccgctacctgacatgaaagcaaggcagcatatgtttaaggtccatctcggggatacaccccacagcttaacagaaagtgattttgagagcttggcccgtcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagccgggtgccatccagaccaccatgcaggagctagcatccaagggccttgctgcgaagattcttccaccacccatctccaggacagattttgaaaaggtcctgtcgaggcagaggccgacagttagcaagaaggacctggaggtgcacgagaggttcaccaaggagtttggcgaggagggctgatacaccgctcgcggacactcacccatgcacagctgcaccacagaaatgtatattgtttatgactttgattgttctgcatgcaagttggattcacaggattgtacattcggtagcccaactaaggttgatcatggctgcggctttatcatgtgttgggctatcgatgtgcgtctgttgtcatcttatttcgattttacacatacatggaatttttccacaggtgtataaaggaataataattcttaacgtggagtccttgtggtgcagtctgtatgtacagctgttttctc

SEQ ID NO: 41326 - protein, 435 aa, Panicum virgatum; identical to SEQ ID NO: 15243
  misc_feature: Ceres CLONE 2007367
  misc_feature (167)..(352): Pfam Name: AAA Pfam Description: ATPase family associated with various cellular activities (AAA)
  misc_feature (367)..(432): Pfam Name: Vps4_C Pfam Description: Vps4 C terminal oligomerisation domain
  misc_feature (5)..(73): Pfam Name: MIT Pfam Description: MIT (microtubule interacting and transport) domain
  misc_feature (118)..(353): SWISSPROT Homolog: EC 3.6.4.3 Microtubule-severing ATPase
  misc_feature (7)..(73): SWISSPROT Homolog: EC 2.7.11.1 Non-specific serine/threonine protein kinase

SEQ ID NO: 41327 - DNA, 726 bp, Panicum virgatum
  misc_feature: Ceres CLONE 2007373
  misc_feature: Encodes the peptide sequence at SEQ ID NO. 41328
gttgaatcttgagaattgagagagacaaatatccgtcgaggaggcgagagctcgaaggggaagcgagacgaccgccatggcaggcgccaccaacggcggcggcaaggtgatcagcctgccgctgcagtacttctgcgtgctggcggtggttgtggtggccgtgatggtgctgtcgctggccttcatgtcgccggcggccatggtagccgtccgccagaacctcggctccgtggccgccgcctccgccgggagcagcagcaacagcagcggcgccggagcgggaggcgcgggcctggccgccccagcaccgccggtggcccggagggagaaggagcaggcgcagcggccgccggtggtgctgttcaacttcggcgactcgaactcggacaccggcggcgtggcggcggccggaggcatccggatcatgccgccggagggccgcacctacttccgccgccccaccgggcggctctccgacggccgcgtgatcatcgacttcttctgtgagagcctgggaacccatgagctgaatccatacctcaagggaattggttcagactacagcaacggcgtcaacttcgccatggctggctcgacagcgagtcacggtgtctctacctactccttgaacgtccagatcgaccagttcgtctacttcaggcacagatccctcgagatgttcgaacgaggactgaaaggcccggtgagcaaaggagggtttgagaa

SEQ ID NO: 41328 - protein, 216 aa, Panicum virgatum
  misc_feature: Ceres CLONE 2007373
  misc_feature: SWISSPROT Homolog: EC 3.2.1.51 Alpha-L-fucosidase
MAGATNGGGKVISLPLQYFCVLAVVVVAVMVLSLAFMSPAAMVAVRQNLGSVAAASAGSSSNSSGAGAGGAGLAAPAPPVARREKEQAQRPPVVLFNFGDSNSDTGGVAAAGGIRIMPPEGRTYFRRPTGRLSDGRVIIDFFCESLGTHELNPYLKGIGSDYSNGVNFAMAGSTASHGVSTYSLNVQIDQFVYFRHRSLEMFERGLKGPVSKGGFE

SEQ ID NO: 41329 - DNA, 1341 bp, Panicum virgatum
  misc_feature: Ceres CLONE 2007375
  misc_feature: Encodes the peptide sequence at SEQ ID NO. 41330
gttttgtttgggctttagcgctcgctcgcttccctctctcttcgcgtgcggcggaaccgcggaacggctgcgctccgcctccatccctgcgctcgggaggcttcgatctgcggccgcgcttcggtgacatcttaaagaagattttcatatattttgttgaagatgaagagaacgcgaaaggcacagtcaggaaaatcccactcatggtggtgggatagccatatcagtcctcaaaactctaagtggctctccgagaatgtagaagaaatggagaagcaagtgaaagagatgctggagcttattggaggagaattctctgcagaaaaggctgaggtgtttaaccagcaacgacctttgcttgtcactcatgtggagaacttccatcacatgtatcgtgctctttctgcgcgatatgacaatgtgattggagaattgcgcaaatatatcccatcatctctgcaatcacatggctcttttggtgtctctgaatcagattctgagacactgtcttcctcatctcccgaatctgacatgcaagaaaatatgccacagcagaaacaaaaacctggaccagattaccttgatgtttctgttggctttggtgttagctctgatgtattgaagaaggggagtgaaggttcttcttcatcttcagattctgattcagagcttgatgaggcgaaagaggaaaatggaagtattgtgtatgccctgagccaaaaaatcattgagctagaagatgagcttcacgaagcaaggggaaagctcgttgctctggaggaaaagcatgcacattgccaggattattatggtaccaactcaaaagttgctgaacatgacgaaaaactggagacttcggatatggaatccaacaacattcagaaagaccttgaagaaagagaatctgctttaaagatccccacagaagtcaacagtggaaaggaagcatttgaaactgtgctgttggagcacaaacatgagatcgaagtgctgaagggagcaatggcctcagctgctaagcagtttgaggttgaattggcacatcgtgatcttgaaattgataagtgcaagcatgagcttgaagtagtctcagagaagtatttgcatgatatgtctactcttgaggatgagcacagaaggctccagggagttatcaagaatatggaaggtgacctagcaaaaatgtcagaggagaaattgctgctcgagtctcggattgaagaacttgagcaggcagctcacagcttagaacattcagcttctgagatagtgaagctgcaagaagtaacaaggaatacacaagcagaattagaaaaggttacagaggagaaagaagtcctc

SEQ ID NO: 41330 - protein, 392 aa, Panicum virgatum
  misc_feature: Ceres CLONE 2007375
  misc_feature (14)..(85): Pfam Name: KIP1 Pfam Description: KIP1-like protein
  misc_feature: SWISSPROT Homolog: EC 2.7.11.1 Non-specific serine/threonine protein kinase
MKRTRKAQSGKSHSWWWDSHISPQNSKWLSENVEEMEKQVKEMLELIGGEFSAEKAEVFNQQRPLLVTHVENFHHMYRALSARYDNVIGELRKYIPSSLQSHGSFGVSESDSETLSSSSPESDMQENMPQQKQKPGPDYLDVSVGFGVSSDVLKKGSEGSSSSSDSDSELDEAKEENGSIVYALSQKIIELEDELHEARGKLVALEEKHAHCQDYYGTNSKVAEHDEKLETSDMESNNIQKDLEERESALKIPTEVNSGKEAFETVLLEHKHEIEVLKGAMASAAKQFEVELAHRDLEIDKCKHELEVVSEKYLHDMSTLEDEHRRLQGVIKNMEGDLAKMSEEKLLLESRIEELEQAAHSLEHSASEIVKLQEVTRNTQAELEKVTEEKEV

SEQ ID NO: 41331 - DNA, 623 bp, Panicum virgatum
  misc_feature: Ceres CLONE 2007375-R
gcaagtttatgctgacaaggaagaagaatctctcaataatgagaagcaaatttctgtgctcaatcatgatatcgctgatctcaggagcaagcttgaattattatcatctgagaaagccacagttgatgataggttggccaatctgctagctgatattatggctcgcgatgaaaagatgaagcaggtggacgatcacctgaatcagcttcagtttgagcatgccaagctgatggcagagtctgactctgccagcaagtccttatcagaggtgcgtgcgcgagtttctgagctggaggaagaggtcgaaaaacagaagcttgtgatatccgagagcgcagagggaaagcgagaggccatcaggcagctgtgcttctccattgaacactaccgcagcgggtatgagcagctccggcagctgctgcaaggccacaggaggctattggtgatggcaacctgataaatgaacaatatcagtttgccaatgaaatgcacactcgcatgtcttttgtcctgttctatatgtggtatgtgcgtgaaatgtaatggggtgggataatcgtattgctcctttgtactctttggagttttgttcttgtcagctattgaatattatgaacattgct

SEQ ID NO: 41332 - DNA, 314 bp, Panicum virgatum
  misc_feature: Ceres CLONE 2007377
  misc_feature: Encodes the peptide sequence at SEQ ID NO. 41333
aagccgagcaacgcaaataaaggcatcctcgtactcgcctatcaccgcaagtctaagctttcacccctacccccaacccaccgccgccgcccaggcctgccgacgacaccaggacggacgtgcatctcgatcaacatcgctcacggcgggatccagttcggaaacgcatgctgggagctctactgcctctagcatgggattcagggtgatgggcagatggcagccgacaagaccagtggaggaggtgatgatggtttcaacaccttcttcaccgagactggcgctgggaaggccgtcccccgcgctgtatttgc

SEQ ID NO: 41333 - protein, 32 aa, Panicum virgatum
  misc_feature: Ceres CLONE 2007377
  misc_feature: Functional homolog of the protein sequence given in SEQ ID NO 50141
  misc_feature: Useful for making plants with altered cell wall content and/or composition
MAADKTSGGGDDGFNTFFTETGAGKAVPRAVF

SEQ ID NO: 41334 - DNA, 1338 bp, Panicum virgatum
  misc_feature: Ceres CLONE 2007379
  misc_feature: Encodes the peptide sequence at SEQ ID NO. 41335
aattaaggcaaccacccaacccaaatcatgacgccccaaagcaattttaagcaaagcaaagcaattaagcaaaggcaaagccttcctccgctcagctgtcagctccgaggaccctcgcctggagcgccatgagaggagatcccaagccgccgccgaggaaaagcccagcagctcccaccctcgccggcaggctgcggaagcactccacgtcccttctcctcctcctcctctggttcgccctctccctctacctcttcatctcccccacgccgcccgccgccgcgccgctccggcgctccgccttcctccgctccaaggcccgcgccctctcagccaccaccgcaggcgcaccccccgttcggatctacgtctacgacctccccgcccgcttcaaccgcgactgggtggccgccgacgcgcgctgcgcccgccacctcttcgcggccgaggtggccgtgcacgaggcgctgctggcctacgccggccgcgccgcgcgccccgacgatgccgacctcttcttcgtccccgtctacgtctcctgcaacttctccacgcccaacggcttcccctcgctctcgcacgcgcggggcctgctcgccgacgccgtccacctcctccggacccagatgccctactggaatcgctccgccggggccgaccacgtcttcgtcgcctcgcacgacttcggcgcctgcttccatcccatggaggatgtggccatcgccgacggcataccagagttcctgaagagatccatcctgctgcagacatttggtgtgcagggccatcacgtatgtcaggaggtggagcatgtggtgatcccacctcatgtgccaccagaggtgtctcatgagctaccggagccagaaaaggtgcggagggacatttttgccttcttccggggcaaaatggaggtgcaccccaagaacattagtggccgcttctacagcaagaaggtgaggactgagctactacagcattatggtcgcaatcgcaagttttatcttaagagaaagcgattcgacaactaccaatcagaaatggctcgttctctgttctgtctctgtccgctgggatgggctccatggagtcctcggcttgtggaatcagtcctcctcggctgcattcccgtcataattgctgataacatacgtctgccgttcccttctgtccttcggtggccagaaatctcattgcaggtagctgagaaggacatagccagtcttgagacggtgctcgatcatgttgtggcgaccaatttgaccagaatacagaggaacttgtgggatccaatgaagcggaaggcactggttttcaaccgcccaatggaagtgggag

SEQ ID NO: 41335 - protein, 403 aa, Panicum virgatum
  misc_feature: Ceres CLONE 2007379
  misc_feature (79)..(385): Pfam Name: Exostosin Pfam Description: Exostosin family
  misc_feature: Functional homolog of the protein sequence given in SEQ ID NO 51525
  misc_feature: Useful for making plants with altered cell wall content and/or composition
  misc_feature: Functional homolog of the protein sequence given in SEQ ID NO 51524
  misc_feature: Useful for making plants with altered carbohydrate content
MRGDPKPPPRKSPAAPTLAGRLRKHSTSLLLLLLWFALSLYLFISPTPPAAAPLRRSAFLRSKARALSATTAGAPPVRIYVYDLPARFNRDWVAADARCARHLFAAEVAVHEALLAYAGRAARPDDADLFFVPVYVSCNFSTPNGFPSLSHARGLLADAVHLLRTQMPYWNRSAGADHVFVASHDFGACFHPMEDVAIADGIPEFLKRSILLQTFGVQGHHVCQEVEHVVIPPHVPPEVSHELPEPEKVRRDIFAFFRGKMEVHPKNISGRFYSKKVRTELLQHYGRNRKFYLKRKRFDNYQSEMARSLFCLCPLGWAPWSPRLVESVLLGCIPVIIADNIRLPFPSVLRWPEISLQVAEKDIASLETVLDHVVATNLTRIQRNLWDPMKRKALVFNRPMEVG

SEQ ID NO: 41336 - DNA, 683 bp, Panicum virgatum
  misc_feature: Ceres CLONE 2007379-R
aagtgggagatgctacatgcaaagtgttgagggaacttgagattttgctagaccagtctcagagaaggtatgttggctcctggaggtgaagaccatagaggattcgttcatccaatctgctgcagctgtgcaactattgcctgctgcacatgcctaactcacagcatcgacggtcagtccacgctgagcctgagatctacttctgacatggatttttttttctggccagaaattcagaatatgaatctcaaaccagagaatctcaaaccagagctctatttgtgatatatttttcttgccagaatcttagaatataaacctcataccagagatcccaaccttcatcagtcaatgggatgctagctcaaccagggttggtgcctaactggagctctcaattccagcgtggcaagttgaccccgactccgtgtgtatagggaattttttactcatttatttattctttggagaagtgggaagagcctgctttttcttgccataggaagaacattagatcttattgtattacatgatgtgcatatctatgtatgtattttctggttgtacctgtacacttgtagagttggtaggcttttccaattagtatccagtagatcgaagggtgccaaaaaaatgtattggtgattggatgataaccagtagcactctactattgaaagcac

SEQ ID NO: 41337 - DNA, 1285 bp, Panicum virgatum
  misc_feature: Ceres CLONE 2007388
  misc_feature: Encodes the peptide sequence at SEQ ID NO. 41338
aagcagcttcccgggtatgaaatcggtgaaaaagaggatctaaaagggccgtgactcacctggttgggccaaagcaaccactgtaacaaagtttcatgaagccttttctgcaaccccctctcttttcaccactcgttggtattgcgctcaactttcacacagtcacggccccaagggtctttcggtttccggttcgtggcctcacagctctcgctccttctaccccgcgatcgtacgctttcaaaaagtatacgcccaccaaaaaaaaagaaaacgcccagtatgaccacgacagccaccaccctcaagggccagcccctcgacaaggcggccctcgaatccctcctgcgccgtcgcttgttctacactccctcgttcgagatttacggtggtgtctcgggtctttacgactacgggccacctggctgcgccctgcaggcaaacatcatcgacctatggcgcaaacacttcatcctcgaggaggacatgctcgaggtcgattgtaccgtcctcacgccccatgaggttctcaagaccagcggccacgttgagaagtttgcggactggatgtgcaaggaccctaagaacggcgagattctccgtgccgaccattttgtggaggatgtcctcgagtcgcggctaaagggagataaggaggcccgcggccaaaaggtggaagagaaggcggatgttggcgatggccagaagacagaggagaaggcagaggactctaagcggaagaagaagaaggcaaagggccaggaggccatcaagctggatgacgctgtggttcaggagtacgaggaggtgctagcaaagattgacaactacaatggcgatcagctgggtgagctcatcaagaagtacgacctcaggaaccccgcgaccggcgaacagcccagccctccggtggcgttcaacctcatgttccagacggccattggccccagcagcaacacacctggctacctccggccggaaaccgcccagggccagttcttgaacttcgccaagctccttgagttcaatactggtcagatgccctttgcctctgcttccattggaaagtcgtaccgcaacgagatttccccaagggctggtcttctacgtgttcgggagtttcttatggcggagatcgaacactttgtcgaccccgaaggccacaagaagcaccaccggttccatgaagtcgaggacatcgagcttgagttcctggaccgccacgtccagctgtctggcaagactactacgacgaagctgaccgttgggaaagccgtcaaggacg

SEQ ID NO: 41338 - protein, 334 aa, Panicum virgatum
  misc_feature: Ceres CLONE 2007388
  misc_feature (51)..(334): Pfam Name: tRNA-synt_2b Pfam Description: tRNA synthetase class II core domain (G, H, P, S and T)
  misc_feature: SWISSPROT Homolog: EC 6.1.1.14 Glycine--tRNA ligase
MTTTATTLKGQPLDKAALESLLRRRLFYTPSFEIYGGVSGLYDYGPPGCALQANIIDLWRKHFILEEDMLEVDCTVLTPHEVLKTSGHVEKFADWMCKDPKNGEILRADHFVEDVLESRLKGDKEARGQKVEEKADVGDGQKTEEKAEDSKRKKKKAKGQEAIKLDDAVVQEYEEVLAKIDNYNGDQLGELIKKYDLRNPATGEQPSPPVAFNLMFQTAIGPSSNTPGYLRPETAQGQFLNFAKLLEFNTGQMPFASASIGKSYRNEISPRAGLLRVREFLMAEIEHFVDPEGHKKHHRFHEVEDIELEFLDRHVQLSGKTTTTKLTVGKAVKD

SEQ ID NO: 41339 - DNA, 604 bp, Panicum virgatum
  misc_feature: Ceres CLONE 2007388-R
  misc_feature: Encodes the peptide sequence at SEQ ID NO. 41340
agccgtcgttcggtattggccggatcctgtactcgctgatggagcacaactactggacccgagccagcgagggtggcgatgaggcccgtggtgtcctgtccttccctcccgcggtcgcgccgacgaaggtccttatcgttcctctgtcatcccacaaggactttgcgcccgccgtccgcaagctgtcgcagaagctcaggtccgccggcatctctagccgtgtggatgactcgtccgctagcattggcaagcggtacagcagaaacgacgagctgggcacgccattcggtattaccgtcgactttcagacggtcaaagacgacaccatcactctcagagagcgtgatagcacgcgacaggtgcgcgctgaggaggacaagatcatcgaggccatccgggcgttggtcgagggcaccaagacatggcaggacatcgagtctgaactgcctctctttgagggccagcaggaggtggaggttactgtccgttaagaacagcagcgtcgagttaaaagatggttcggttttatttggtcgggttgagcgcgccttgccaactacatacaccctttggcatacgccacaatagagctctctctagacgg

SEQ ID NO: 41340 - protein, 162 aa, Panicum virgatum
  misc_feature: Ceres CLONE 2007388-R
  misc_feature (42)..(134): Pfam Name: HGTP_anticodon Pfam Description: Anticodon binding domain
  misc_feature: SWISSPROT Homolog: EC 6.1.1.14 Glycine--tRNA ligase
PSFGIGRILYSLMEHNYWTRASEGGDEARGVLSFPPAVAPTKVLIVPLSSHKDFAPAVRKLSQKLRSAGISSRVDDSSASIGKRYSRNDELGTPFGITVDFQTVKDDTITLRERDSTRQVRAEEDKIIEAIRALVEGTKTWQDIESELPLFEGQQEVEVTVR

SEQ ID NO: 41341 - DNA, 652 bp, Panicum virgatum
  misc_feature: Ceres CLONE 2007395
  misc_feature: Encodes the peptide sequence at SEQ ID NO. 41342
tgttggtgatcgtttgtatgatgaagagctgtatgaagctgcaaagatcatctatgctttcatctcaaactgggctaagctggctgttaccctggttaagctgaagcagttccaaggtgctgtggatgctgctcgtaaggctaacagcgcgaaaacatggaaggaggtctgctttgcttgtgttgacgcagaggagttccgtcttgcacagatatgtggtctaaatattattgtccaggttgatgacttggaagaagtgagtgaatactaccagaatagaggatgcttcaatgaacttattgctctcatggagagtgggcttggacttgaacgtgcacacatgggcatcttcacagaactgggagttctgtatgctagataccgatctgagaagcttatggagcacatcaaacttttctccacccgtctcaacattcctaagctaatccgggcttgcgatgaacagcaacactggaaagaacttacctacctgtacatacagtacgatgaatttgacaatgctgccaccactatcatgaaccactctccagatgcatgggatcatatgcagttcaaggatgtttgtgttaaagttgcaaatgttgaactatattacaaggcagttcacttctatttgcaagagcaccctgat

SEQ ID NO: 41342 - protein, 216 aa, Panicum virgatum
  misc_feature: Ceres CLONE 2007395
  misc_feature (74)..(216): Pfam Name: Clathrin Pfam Description: Region in Clathrin and VPS
VGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRSEKLMEHIKLFSTRLNIPKLIRACDEQQHWKELTYLYIQYDEFDNAATTIMNHSPDAWDHMQFKDVCVKVANVELYYKAVHFYLQEHP

SEQ ID NO: 41343 - DNA, 741 bp, Panicum virgatum
  misc_feature: Ceres CLONE 2007396
  misc_feature: Encodes the peptide sequence at SEQ ID NO. 41344
agaactatttctccctcccgccctccgccgacgccgccgctctctctccctccctgctccttcactcttccatctcatcaccaacccccagccgagctcgcaaatgctctctgccaccatcgccgcgcaccccgccgccgccataaccctgcggcaacggcactcgctccgccctctccagcgactccgtgttcccatcggcgcggcgccgccgaggcggcggatggcaacggcgaggcccttagtggtcaaggccctagctagccagggcgtccccgcggtgccccccaagctctcctttccgatactggtgaatagttgtactggaaaaatggggaaggctgtggcagaagcagctgtatcagccggtcttcagttagttccggtatcattcagtgccatggaagtccctgatggaagacttgaaatctgcgacagagaaattcaaattcatgacccttctgaaagtgaaaaaattctcccttccattattgaagagtacccagatctcatagtcgtcgattacactgttcctgatgctgtcaatgccaatgctgaactctattgcaaattgcgcttgccatttgtaatgggcacgacaggtggaaataggcaactgctgcacaaaaccgtgcaggatgcaaatatttatgctgtgatatccccacagatgggaaagcaggtcgttgcttttcttgctgccatggaaatcatggcagagcaattccctggtgcattttc

SEQ ID NO: 41344 - protein, 212 aa, Panicum virgatum
  misc_feature: Ceres CLONE 2007396
  misc_feature (66)..(190): Pfam Name: DapB_N Pfam Description: Dihydrodipicolinate reductase, N-terminus
  misc_feature: SWISSPROT Homolog: EC 1.3.1.26 Dihydrodipicolinate reductase
MLSATIAAHPAAAITLRQRHSLRPLQRLRVPIGAAPPRRRMATARPLVVKALASQGVPAVPPKLSFPILVNSCTGKMGKAVAEAAVSAGLQLVPVSFSAMEVPDGRLEICDREIQIHDPSESEKILPSIIEEYPDLIVVDYTVPDAVNANAELYCKLRLPFVMGTTGGNRQLLHKTVQDANIYAVISPQMGKQVVAFLAAMEIMAEQFPGAF

SEQ ID NO: 41345 - DNA, 1453 bp, Panicum virgatum
  misc_feature: Ceres CLONE 2007407
  misc_feature: Encodes the peptide sequence at SEQ ID NO. 41346
aatatcataaattattctcacctctccaaatgccaaaggaaaagattcacgttaacttggtcgtcatcggtcacgtcgatgctggtaaatccacctccactggtcacttgatctacaagtgcggtggtatcgacaagagaaccatcgaaaagttcgagaaggaagccaacgaactcggtaagggttctttcaagtacgcttgggtcctcgataagctcaaggctgaaagagaaagaggtatcaccatcgatatctccctctggaaattcgaaactggtaagtatcacttcaccattatcgatgcccccggccatagagatttcatcaagaacatgattaccggtacttcccaagccgatgttgctctcctcatgattgcctctccccccggtgaattcgaagctggtatctccaaggaaggacaaaccagagaacacgctctcttggccttcactttgggtgtcaagcaaatgatcgtctgtgttaacaagatggacgaaaagaccgtctcctggtctcaatccagattcgacgaaatccaaaaggaagtcgccgaatacttgaagaaggtcggttacaaccccgctaaggttcccttcgtccccatttccggatggcacggtgacaacatgctcgaaaagtcccccaaccttacctggttcaagggccccactctcctcgaagccctcgatgctatcatcccccccaagagacccctcgacaagcccctcagacttccccttcaagacgtctacaagatcggtggtatcggaacagtccccgtcggtagagtcgaaaccggtatgttgaagcccggcatgaccgtctacttcgctccctccaacgtctccactgaagtcaagtccgtcgaaatgcatcacgaatccgtccaagaagccatccccggtgacaacgtcggtttcaacatcaagaacgtcgctgttaaggacatcagaagaggtaacgtttgcggtgatgccaagaacgatccccccaaggaagctgcttctttctatgctcaagttatcgtcctcaaccatcccggtcaaatcggtaacggctactgccccgtcctcgattgccacactgcccatattgcctgcaagttcgctgaaatcaaggaaaagatcgacagaagaactggtaccgtcctcgaagaagaacccaagtccgtcaagtctggtgattgcgctatggttaccctcatccccaacaagcccatgtgcgttgaagccttctctgactatccccctcttggtagattcgccgttagagacatgaagcaaactgtcgctgtcggtgtcatcaagtccgtcgaaaagaagacccccgctgccaagaaataaacttgattgttttatttcatattatttgatataagtatattcataaatatgctttcatataatttgcccaataagagttattataattgacccttaaaaaaaacatc

SEQ ID NO: 41346 - protein, 438 aa, Panicum virgatum
  misc_feature: Ceres CLONE 2007407
  misc_feature (5)..(226): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MPKEKIHVNLVVIGHVDAGKSTSTGHLIYKCGGIDKRTIEKFEKEANELGKGSFKYAWVLDKLKAERERGITIDISLWKFETGKYHFTIIDAPGHRDFIKNMITGTSQADVALLMIASPPGEFEAGISKEGQTREHALLAFTLGVKQMIVCVNKMDEKTVSWSQSRFDEIQKEVAEYLKKVGYNPAKVPFVPISGWHGDNMLEKSPNLTWFKGPTLLEALDAIIPPKRPLDKPLRLPLQDVYKIGGIGTVPVGRVETGMLKPGMTVYFAPSNVSTEVKSVEMHHESVQEAIPGDNVGFNIKNVAVKDIRRGNVCGDAKNDPPKEAASFYAQVIVLNHPGQIGNGYCPVLDCHTAHIACKFAEIKEKIDRRTGTVLEEEPKSVKSGDCAMVTLIPNKPMCVEAFSDYPPLGRFAVRDMKQTVAVGVIKSVEKKTPAAKK

SEQ ID NO: 41347 - DNA, 688 bp, Panicum virgatum
  misc_feature: Ceres CLONE 2007415
  misc_feature: Encodes the peptide sequence at SEQ ID NO. 41348
gctcctgaaggccctcaaggctgctggtgccgagagcgtccagatcgacgagcccgtcctcgtcttcgatctccgccccgagatcaaggccgccttcaagcccgcatatgaggctattgccgctcagggcagcgccgttccctctgtcgtcgtcgccacctacttcggtgacatcgtccacaactttgacgtcctccctgcctttgccaaaacccagggtctccacgtcgaccttgtccgcaaccccgagcagctcgagcctgtcctcaagcagctcggcgccaaccagatcctctctgccggtgtcgttgatggcaggaacatctggaagaacgacttcaagaagtcgcttgaccttctccagaccgccatcaaggccctcggccctgagcgtgtccttgttgccacttccagctctctcctccacaccccgcacaccctcgccagcgagaagaagcttcccgctgacgtctacgagtggttctcatttgccagcgagaaggtcaaggaggttgctatccttgccaaggctgtgtccgatgccggcgctgtcagcgctgagctcgaggccaacgctgccgccatgaaggcacgcgccgagtcgacccgcaccaacgaccccaaggtcaaggagcgtcagtctcaggttaccgaggctcagcacaaccgcaagactgagttcgaccac

SEQ ID NO: 41348 - protein, 228 aa, Panicum virgatum
  misc_feature: Ceres CLONE 2007415
  misc_feature (1)..(128): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
LLKALKAAGAESVQIDEPVLVFDLRPEIKAAFKPAYEAIAAQGSAVPSVVVATYFGDIVHNFDVLPAFAKTQGLHVDLVRNPEQLEPVLKQLGANQILSAGVVDGRNIWKNDFKKSLDLLQTAIKALGPERVLVATSSSLLHTPHTLASEKKLPADVYEWFSFASEKVKEVAILAKAVSDAGAVSAELEANAAAMKARAESTRTNDPKVKERQSQVTEAQHNRKTEFD

SEQ ID NO: 41349 - DNA, 704 bp, Panicum virgatum
  misc_feature: Ceres CLONE 2007439
  misc_feature: Encodes the peptide sequence at SEQ ID NO. 41350
ccacccaaaacccacgcaggaggagccagcgcagccggagcagcaaaccgcccgccccctcctccccccgcccgccgcttcgcccccatggagccggtgccgccggcgacggccgccggcatggggggccccgggcccgggcccgggtaccccgagtccacggagtcctccccccgcagccgcggcggggactcgtgggacgagcccttcccgtcctccgcggcggccgcggccgccgcggccggcggcgggggccggctccgcctgatgtgcagcttcgggggccggatcgtcccgcgcccgacggacaagtccctctgctacctgggcggggagacccggatcgtggccgtcgaccgccacgcctcgctcgccgacgtccacgcgcgcctctcgcggtcgctgctcgggggccagcccttcacgctcaagtaccagctccccaacgaggacctcgactcgctcatctccgtctccaccgacgaggacctcgacaacctcgtcgacgagtacgaccgcatcgccgccgcctcctccggcggcggatcctcgcgcacctcgcggatccggctattcctcttccccgccaagcccgagtcctcctcctccctcggctccctcctcgacgactcctccaagtccgagaactggttcgtcgacgccctcaacagcgccatctccggctccctcgacggcatccccag

SEQ ID NO: 41350 - protein, 205 aa, Panicum virgatum
  misc_feature: Ceres CLONE 2007439
  misc_feature (72)..(167): Pfam Name: PB1 Pfam Description: PB1 domain
MEPVPPATAAGMGGPGPGPGYPESTESSPRSRGGDSWDEPFPSSAAAAAAAAGGGGRLRLMCSFGGRIVPRPTDKSLCYLGGETRIVAVDRHASLADVHARLSRSLLGGQPFTLKYQLPNEDLDSLISVSTDEDLDNLVDEYDRIAAASSGGGSSRTSRIRLFLFPAKPESSSSLGSLLDDSSKSENWFVDALNSAISGSLDGIP

SEQ ID NO: 41351 - DNA, 717 bp, Panicum virgatum
  misc_feature: Ceres CLONE 2007441
  misc_feature: Encodes the peptide sequence at SEQ ID NO. 41352
gcacgcctttcacacttgatgggttgccgccaccgacgacgaaccgcccggcggcagggatgtcccggcgttcgcggagttctccctggcggacctccgcgcggccacgggcgggttcgcggccgagaacatcgtctccgagagcggcgagaaggcgcccaacctcgtctacaggggccagctcgagggcagcggcggcgcgccgccgcgcgcgattgccgtgaagaagttcgccaagctcgcgtggcccgaccccaagcagttcgcggaggaggccaagggggtggggggcctgcgccaccggaggatggcgaacctgatcggctactgctgcgacggcgacgagcgcctgctcgtcgccgagttcatgcccaacgacaccctcgccaagcacctgtttcactgggaaaaccagactatagaatgggctatgcgtctgagagttgcatactacatctcccaagcattggaatattgtagtatcaagggaaggcctttatatcatgacttaaatgcatacagggtcctctttgatgagaatggtgaccctcgtctgtcatgctttggtctgatgaaaaacagcagggatggcaaaagctatagcacgaacctagcatatacacctccagaatatctcagaaatggaagggttactccagaaagtgtcatattcagttttggcactgtacttctcgaccttctcagtggaaaacgtat

SEQ ID NO: 41352 - protein, 136 aa, Panicum virgatum
  misc_feature: Ceres CLONE 2007441
  misc_feature: SWISSPROT Homolog: EC 2.7.11.1 Non-specific serine/threonine protein kinase
MANLIGYCCDGDERLLVAEFMPNDTLAKHLFHWENQTIEWAMRLRVAYYISQALEYCSIKGRPLYHDLNAYRVLFDENGDPRLSCFGLMKNSRDGKSYSTNLAYTPPEYLRNGRVTPESVIFSFGTVLLDLLSGKR

SEQ ID NO: 41353 - DNA, 658 bp, Panicum virgatum
  misc_feature: Ceres CLONE 2007445
  misc_feature: Encodes the peptide sequence at SEQ ID NO. 41354
cagtcaagtccaactcgagatctgtcacaagcattaccgatgtcaacttctcatccgactgaggcctcagacaccaatacaagcagcaatgatgaccattcatcaggaacaccaaataggaggtctaaagtttgggaacactttgagacagagttggtcgaggtggatggtgctctgaaggttgtttgcagatactgcagcatgaagatggctagcggaaaatcaggtacaaatagtttgagaaatcacataaaagattcttgttgaaaaattagtgcagatgatagatagatgtttattgccacaattcagaaacaaccagcgggtccatttaccttcaatcctcaaataagtcgtgagttaatgataacttggtgcattcgggcagaggttgcatttaataaatttgaggacccaagtttttcaccatggatggcatccttgcagcccacatttgattgcattgggcgccaaacaatccgcaatgattgtgtttgtatgtatgggagagtgaagcaaacattagcaagtgaactgcaaggtcttgattctcacatatgctttacttctgatctgtggacatctaaccaaaagctgggatatatatgtctaacaacccattatgtggatgctaactttgccttgcataagaaaatat

SEQ ID NO: 41354 - protein, 75 aa, Panicum virgatum
  misc_feature: Ceres CLONE 2007445
  misc_feature (29)..(72): Pfam Name: zf-BED Pfam Description: BED zinc finger
MSTSHPTEASDTNTSSNDDHSSGTPNRRSKVWEHFETELVEVDGALKVVCRYCSMKMASGKSGTNSLRNHIKDSC

SEQ ID NO: 41355 - DNA, 695 bp, Panicum virgatum
  misc_feature: Ceres CLONE 2007449
  misc_feature: Encodes the peptide sequence at SEQ ID NO. 41356
accagcccacctactccttgctttgcaaagttgcagggtgcttccggcacaagcaagaacacggatttgcaagtgacaccagctgcagctgatcctacagcatcagctcacctcatctcctcgtcgatttcgagtcgtaatttgtttctggacatgttttagaagaagtgttgctctcaggtgcagtcctggcaattggattggtgagttgagctagcaggagaggggagaggaatgcctcctggtgccatgggcggaaggagccggggcaggtggaggagcggctcgtggggggcggcgctgctgctgcggtgcgcgctcgccatggcgtgcgtgggctgcgcgctcgctgcggacgcgcagggcgcggcgctgctggcgtggaagcgcacgctgcggggcggcgcggcggaggcgctcggggactggagggactccgacgcgtcgccgtgcaggtggaccggcgtgacgtgcaacgccgcggggcgcgtcacggagctcagcctgcagttcatcgacctgcacggcggcgtgccggccgacctgtccgcggtgggcgccacgctcgcgcggctggtgctcacgggcaccaacctgacaggccccatcccgccgcagctcggcgacctgcccgcgctcacgcacctcgacctcagcaacaatgcgctcacgggatccatcccggcgagcctgtg

SEQ ID NO: 41356 - protein, 148 aa, Panicum virgatum
  misc_feature: Ceres CLONE 2007449
  misc_feature (35)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MGGRSRGRWRSGSWGAALLLRCALAMACVGCALAADAQGAALLAWKRTLRGGAAEALGDWRDSDASPCRWTGVTCNAAGRVTELSLQFIDLHGGVPADLSAVGATLARLVLTGTNLTGPIPPQLGDLPALTHLDLSNNALTGSIPASL

SEQ ID NO: 41357 - DNA, 706 bp, Panicum virgatum
  misc_feature: Ceres CLONE 2007464
  misc_feature: Encodes the peptide sequence at SEQ ID NO. 41358
gggaaggagagcgaggcgggtggaagcacggatgaggattccggaagggatgaggtggtggaggttgtaacgccggaggttgagacggtggaggtggacgacgatgatcctgtcagcaagaagaagatgaggaaaatgaggaacagagattccgccatgaaatcgagggagaggaagaagacgtatataaaggacttggagacgaagagcaagtatttggaggcagagtgccgccgcctcagctatgcacttcagtgctatgcagctgagaacatggcactgcgccagagcttgttgaaggataggcttgttggtgctcccacagccatgcaggagtctgccgtactcacggaaaccctgccgttggtttccctgctttggctagtgagcatcgtgtgcctgttcctgatgcccggtctgcccaaccgaagtccagcagctccaagcagcgccggaagaggtctcgggatggtagccggaaagacaagcagtgaaaacccagagatattggaactcatcctccatggaaggcgctgcaagggcacaagggcaaaaatcaagctagatacagtaccatttcatgaagtagctgcttgctagcctttccataggcctcttttgcaagcatccagtatgtagtgtagtacttgccaagctcagcatgcctgttatatatgtgtcatgcagttgatatccatggaatatc

SEQ ID NO: 41358 - protein, 199 aa, Panicum virgatum
  misc_feature: Ceres CLONE 2007464
  misc_feature (36)..(99): Pfam Name: bZIP_1 Pfam Description: bZIP transcription factor
GKESEAGGSTDEDSGRDEVVEVVTPEVETVEVDDDDPVSKKKMRKMRNRDSAMKSRERKKTYIKDLETKSKYLEAECRRLSYALQCYAAENMALRQSLLKDRLVGAPTAMQESAVLTETLPLVSLLWLVSIVCLFLMPGLPNRSPAAPSSAGRGLGMVAGKTSSENPEILELILHGRRCKGTRAKIKLDTVPFHEVAAC

SEQ ID NO: 41359 - DNA, 1320 bp, Panicum virgatum
  misc_feature: Ceres CLONE 2007465
  misc_feature: Encodes the peptide sequence at SEQ ID NO. 41360
aatcttaaaaatcaattctcatactgtttataactatttctactttctacaaacatgcccggatcatttgttattagacctattgaagctaacctcactcataacaccgaccttctcggcaagatggatccttattgtgcctttaatgtaggcggtaccaggatcaggagccagatctgcaagaagggaggcaagcaccctcattgggctgattcagttaccattccacctaccaatgaatccaaaatcttagtcgaacttatggacaaagacaagatcactcatgatgatcacattggcagcttcatgttggatttgaacgaaatccaagcatcaggacaagtcagcagatggtaccaactctaccacaagaacaaggctgcaggtgaaatcttgctcgaagcagtttatcaacctggtcaaggagaattcttacaaggccagcaatacggtagtcaatacggcgcggttggtgctggtgctggtgccattggaggcgctggtttgaccagcggccagagtccatactgggagcaagaaaaacttcgtactgctcaaccagaaattattcagaaagaagaaaccatcactactactaccactcagcctgtagttcaacaacaagagttccttgctactggcgtttcgagacacagccaccaccatgaaggcgctcacgtttggactgaacagcatcaagtagtcgaacctcacactttcgtcaaggaagtcgaagttgttgaaaccagaccagctctcaaggaaatcgaggttatggagccagtcaaagtgctcaaggatgttcaatacacccaagccgttccagtcagatcacaaattgaagttagtgagccacaagttgtgatgaaggaagtcgaagttattgaacccagactcgtcactaagaccatccaagtcgttgagaatgtcccagtgaaaagacaggttgaggtcatcgagatgagaaatactctccaagaggtagagacttttgagcctcagaccttccataagccagtcgaagtcactgagtacgttcctcacatgcaacaagtcgaagtaactcagcctgttactctcaagaagaatgttgaatttgtcgagcctgtgaccaccactcagaccatcactaaggaaatgcaacccgccgtcatcattgacgagaaatttaccaccgaagttggacctgcctcagttattggtatgtctagtacttatggatacacagcattcagtgaaatctcactctctgagagacaaagactcgctggactccaaagatggactggatatgaaaagatctttggtgggttgactgaa

SEQ ID NO: 41360 - protein, 421 aa, Panicum virgatum
  misc_feature: Ceres CLONE 2007465
  misc_feature (5)..(85): Pfam Name: C2 Pfam Description: C2 domain
MPGSFVIRPIEANLTHNTDLLGKMDPYCAFNVGGTRIRSQICKKGGKHPHWADSVTIPPTNESKILVELMDKDKITHDDHIGSFMLDLNEIQASGQVSRWYQLYHKNKAAGEILLEAVYQPGQGEFLQGQQYGSQYGAVGAGAGAIGGAGLTSGQSPYWEQEKLRTAQPEIIQKEETITTTTTQPVVQQQEFLATGVSRHSHHHEGAHVWTEQHQVVEPHTFVKEVEVVETRPALKEIEVMEPVKVLKDVQYTQAVPVRSQIEVSEPQVVMKEVEVIEPRLVTKTIQVVENVPVKRQVEVIEMRNTLQEVETFEPQTFHKPVEVTEYVPHMQQVEVTQPVTLKKNVEFVEPVTTTQTITKEMQPAVIIDEKFTTEVGPASVIGMSSTYGYTAFSEISLSERQRLAGLQRWTGYEKIFGGLT

SEQ ID NO: 41361 - DNA, 666 bp, Panicum virgatum
  misc_feature: Ceres CLONE 2007465-R
caacagagactcagtagacttaatgaacaagaatgggtccttgagagagacagacttatgagactcagtgagcaagaaagacttcatcaccagagaagcttcttccagagaatcaaggatcactttagcactggcagaccctattatcagtatagcaacagatggaaaggacttgataactggttcagtgggcttaacgacagccagagaaactacactcaagagagattcaaccgacttaatgatcaagagtggaatcttgagaaacaaagactgttaggattgagcgatcaagaaagaatccgtgagctccaaaaatactacaacgactatcagaagacaggaaactttggacaaagctactcttactcagctcagtacaatccaaaccctaacttctaagcgttaggactaatgaagaaacacagagacagatgtcatatttgagtgtctatataataaataataagtcttgtgtttctggaggtatagaaaagcttccgataatatgttgttaatagctattttgatgtcgaataattattaattgtatagaacataataatatagaccattatcttgttctttaatctattacgacctaaaattgaggacgtttcgatataacagaatacgatatactgttatataatattttacctccat

SEQ ID NO: 41362 - DNA, 1069 bp, Panicum virgatum
  misc_feature: Ceres CLONE 2007485
  misc_feature: Encodes the peptide sequence at SEQ ID NO. 41363
agagcagggggatggaagaaaataaactactggccaaaccctagccgagccccgggtccgctcaccgccttcccacccccccacccacccacctgccccccccccccccccgccctcgccgtccgcgatgcgccgggcgaagccgccgcagccgcagccgtcgccgtcgccggagatccggtaccgcggcgtgcggaggcggccatcggggcgctacgccgccgagatccgggacccggccaagaagaccccgatctggctcggcaccttcgactccgccgaggccgccgcgcgcgcctacgacgccgccgcccgatccctccgcgggcccaccgcccgcaccaacttccccagcgccgcggcccccgcgccgcggcacagcaggccccccgccccctccgccgccgcgcaggcggctgccgcggcggcagcggccacgtccagccacagcagcaccatagagtcgtggagcgacggcgcgacccgcgccgcgctggcgcgtagcgctgcctccgtcctggcgcgcagcgccgctccgacggaggaggaagacgaggactgccgcagctactgcggatcctcgtcgtccgtcctctgcgaagacactgggggcgacgatgcggccgcctcccgcgcgcccctgccgttcgatctgaacctgccgccgcctcatgacgcggcctccgagaccgatcagatgggtgcccgctacgacacgttgcttcgcctctagctcacgagaacgacgggatcccgtccgaaccagaaatcagaggaaggatcgggaccaagcactgctctctgcttcaacggtgtcctcctttggctgctgatccggtggtgttctctcgctagatggataattcgtgccttttcccttctttttcattcttttttcttctttcttaccacgatgatgaagaagatgatgatttgatatgtgaataattctgtcatgtccaagtaagctgcgaggaaagaaatctgagcttttccttatctttgtctgggatttggagtgaaattgcaactgtggtttcgttagttggaaagattatggaagaagtct

SEQ ID NO: 41363 - protein, 201 aa, Panicum virgatum
  misc_feature: Ceres CLONE 2007485
  misc_feature (17)..(68): Pfam Name: AP2 Pfam Description: AP2 domain
  misc_feature: Functional homolog of the protein sequence given in SEQ ID NO 50343
  misc_feature: Useful for making plants with altered carbohydrate content
  misc_feature: Functional homolog of the protein sequence given in SEQ ID NO 50249
  misc_feature: Useful for making plants with altered lignin content
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
MRRAKPPQPQPSPSPEIRYRGVRRRPSGRYAAEIRDPAKKTPIWLGTFDSAEAAARAYDAAARSLRGPTARTNFPSAAAPAPRHSRPPAPSAAAQAAAAAAAATSSHSSTIESWSDGATRAALARSAASVLARSAAPTEEEDEDCRSYCGSSSSVLCEDTGGDDAAASRAPLPFDLNLPPPHDAASETDQMGARYDTLLRL

SEQ ID NO: 41364 - DNA, 1551 bp, Panicum virgatum
  misc_feature: Ceres CLONE 2007489
  misc_feature: Encodes the peptide sequence at SEQ ID NO. 41365
aaaaccccctagccggcaaggcaaaccccggtgattataatccccacgcgacggaacgctcactccccgtccaattcgatctgccatgaactcgctccagtccttcctcgccccgtctcggcctgcctcgccacgccgccgccgccgccgcccccgaccgccgcggcggcggcgcggcgggagttgtcggcggcgagcctggcggtcgtcgaggacgaggcgcggtacctcgtgggcacctacaaccgctcccgcgtcgtcatcgacggcgggcgcgggtgcaagctctacgacctcgacggccgcgagtacctcgacatggcctccggcatcgccgtcaccgcgctcggccacgccgaccccgacgtcaccgccaccctcgcgcgccagtccgccaccctcatccacgccagcaacgtccagtacaccaggccccaggtggcgctcgcgaagcggctcgtggaggcgtccttcgcggaccgcgccttcttcgccaactccggcaccgaggccaacgaggcggccatcaagttctcccgcaagttccagcgggtcgcgcaccccgacaccgacgcgccccccgccgagttcctggccttctccaactgcttccacggccggaccatgggctccgtcgcgctcaccagcaagtcgcagtaccgggagcccttcgcgcccgtcatgcccggcgggaccttcgtggagtacggcgacttgcacgaggccaagaaggtgatacagtccggcaagctcgccgctgtgttcgtggagcccgtgcagggtgagggtggcattcatagtgccacccaggagttcttgcaggggctgcgggaggcatgcgacgaggctggagctctcttggtctttgatgaggtgcaatgtggtttggggcgcacaggttacctctgggcccatgaggcgtatggagtagcaccggacattatgaccttagcaaagccactagccaatgggctccccatcggggctgtcttggtcaaggaaaaggttgctgcagccataagctacggtgaccatggtactacattcggcggtaaccctcttgtctgccaggctgcgttaactgtattggacaaaatccagaaacctggtttcttggctgaggtgtccaagaaaggagagaacttcaagcagcttctccgcaccaagctgagcggaaacccgcacgtaaaggaggtccgtggtgttggcctcattgttggcatcgagctagatgtaccggctggtcctcttgttgatgcatgccttgatgctggtgtcatagtgctgacagctgggaaaggcaatgttgtgaggctcgtgccgccactcatcatctcagagaaggagctgcagcatgccgcggatgttataagggactgtctaccggcgcttgatgttgctacttcttaatgtaaccacaggtctttacccattggtgctagagtgatcctcccttttgggaggttcagataatgtatgttataggtccacatatggaagcttgttccaaattctggaatcgaataatttcatgttggatctacttttccg

SEQ ID NO: 41365 - protein, 363 aa, Panicum virgatum
  misc_feature: Ceres CLONE 2007489
  misc_feature (1)..(306): Pfam Name: Aminotran_3 Pfam Description: Aminotransferase class-III
  misc_feature: SWISSPROT Homolog: EC 2.6.1.11 Acetylornithine transaminase
  misc_feature: Functional homolog of the protein sequence given in SEQ ID NO 51630
  misc_feature: Useful for making plants with modulated nitrogen use efficiency
MASGIAVTALGHADPDVTATLARQSATLIHASNVQYTRPQVALAKRLVEASFADRAFFANSGTEANEAAIKFSRKFQRVAHPDTDAPPAEFLAFSNCFHGRTMGSVALTSKSQYREPFAPVMPGGTFVEYGDLHEAKKVIQSGKLAAVFVEPVQGEGGIHSATQEFLQGLREACDEAGALLVFDEVQCGLGRTGYLWAHEAYGVAPDIMTLAKPLANGLPIGAVLVKEKVAAAISYGDHGTTFGGNPLVCQAALTVLDKIQKPGFLAEVSKKGENFKQLLRTKLSGNPHVKEVRGVGLIVGIELDVPAGPLVDACLDAGVIVLTAGKGNVVRLVPPLIISEKELQHAADVIRDCLPALDVATS

SEQ ID NO: 41366 - DNA, 746 bp, Panicum virgatum
  misc_feature: Ceres CLONE 2007490
  misc_feature: Encodes the peptide sequence at SEQ ID NO. 41367
ctctctccccaatttcaaaatccagctcccttgctagggtttgcctttgcggcgcggcgcagcccccctcttctcgccatccaagggaaaaggcgatggagctcaacatcgtggacaagtacgagaagctggagaaggtgggggagggcacctacggcaaggtgtacaaggcgcaggacaaggccacgggccagctcgtcgccctcaagaagacccgcctcgagatggacgaggagggcatcccgcccaccgcgctccgcgagatctccctcctcaacctcctctcccactccatctacgtcgtccgccttctcgccgtcgagcaggccgccaagaacggcaagcccatcctctacctcgtcttcgagttcctcgacaccgacctcaagaagtacctcgacgtctaccgcaaggggcccaaccccaggccgctacccccgcacctcgtcaaggtaaccaactgacaataatcacccatctgaattctgatcacttcttctttttcatctagtactgttattgaaaaaaatgctcaattcaactccatcaactgtaaaaatgacaccttgtctactgattctccagttgatctaagcaactattgattacttcattgtcagagattcagaactaagatctaagcgactattgatcacttcgtgctcagagattcagaactaagtaacctatgcattacatacagtacaatcctgatcaggctgaaaaaaaaacgacaccttctatac

SEQ ID NO: 41367 - protein, 122 aa, Panicum virgatum
  misc_feature: Ceres CLONE 2007490
  misc_feature: SWISSPROT Homolog: EC 2.7.11.22 Cyclin-dependent kinase
  misc_feature: Functional homolog of the protein sequence given in SEQ ID NO 51564
  misc_feature: Useful for making plants with modulated nitrogen use efficiency
  misc_feature: Functional homolog of the protein sequence given in SEQ ID NO 51518
  misc_feature: Useful for making plants with modulated growth rate
MELNIVDKYEKLEKVGEGTYGKVYKAQDKATGQLVALKKTRLEMDEEGIPPTALREISLLNLLSHSIYVVRLLAVEQAAKNGKPILYLVFEFLDTDLKKYLDVYRKGPNPRPLPPHLVKVTN

SEQ ID NO: 41368 - DNA, 653 bp, Panicum virgatum
  misc_feature: Ceres CLONE 2007494
  misc_feature: Encodes the peptide sequence at SEQ ID NO. 41369
atcgcatcgcattctcgctctgttgtgtgactgattgccaagaaggaaacgctctctgcttgtgttccagcctctgaatctcgtgtgaggatgtcgtgctgcggaggcaactgcgggtgcggctccggctgcaagtgcggctccggctgcggagggtgcaagatgtacccggacatggctgagcagggcaccaccaccaccaccacccagactgtcatcatgggcgttgcaccaaacaacaactgcacctgcaatccctgcacctgcaagtgaggagctcatggccatggccggaccggaggagatctcggaaggacaaaaaagctagtatagcagtgttgtgtatgtgcgtcgttcgtttgtctgaaagtgtgtgtggcatgcttagtaacagtgttgcgcgtgctgctagtagatggtactgatgaggaacaataataatgatggtgctgagatgtcgtcggcgtcgccgccgtcgtgtccttcctccccggccggtcgagcacctgtggcggtactctagcagtgtgtcggtgtgtgcagcaggccatgctctgatctgtggtgttggtgtgtggtctgcttggtgtcccttgtgtctcgtgtaaccatccatctatatctatatctatctatcgacatccatgttgtgc

SEQ ID NO: 41369 - protein, 60 aa, Panicum virgatum
  misc_feature: Ceres CLONE 2007494
  misc_feature (1)..(59): Pfam Name: Metallothio_2 Pfam Description: Metallothionein
MSCCGGNCGCGSGCKCGSGCGGCKMYPDMAEQGTTTTTTQTVIMGVAPNNNCTCNPCTCK

SEQ ID NO: 41370 - DNA, 1780 bp, Panicum virgatum
  misc_feature: Ceres CLONE 2007503
  misc_feature: Encodes the peptide sequence at SEQ ID NO. 41371
gactccacaccatcatcttctccaagcctttgagaattgagagagttgataggctgtaggcatggagattgagagggaaactcggggcaacgatagctggagagctaatgcgcaggaagagtctaagaagctcgaagacagtgatcgactgatcaaggagcctgcatggaaaaggttcctggctcatgttggaccaggatttatggtgtcattggcatacttggatcctgggaacttggagacggatctgcaagctggagcaaatcacagatatgagctcctttgggtgattctcattggtctcatcttcgcactgatcatacaatcactagcagctaatcttggagttgtgacagggaggcatcttgctgagatatgcaagagtgagtacccaaagtttgtgaggatctgtctatggatccttgcagaggtagctgtgattgctgcagatattccagaagttatagggacagccttcgctttcaaccttttgtttcacatccccgtgtgggttggggttctcatcaccggctccagcactctcatgcttctaggcctgcaacgatatggggtgcggaagctggagtttctaatctcgatgctggtgttcgtcatggcggcgtgcttcttcggggagatgagcttcgtgaagcctccggcggtggaggtcctcaaagggctcttcatccctaggctcaagggcgctggcgccaccggggacgctattgccctccttggagctcttatcatgccgcacaacctgttcttgcactctgcactggtgctgtcaagaaagaccccctcatcggttagaggaatcaaggacgcctgcaggttcttcctctacgagagcgggttcgcgctgttggtggccctgctgatcaacatcgccgtcatctccgtctccgggaccgtctgcttcgccgacaacctctcgccggaggacgccgagaagtgcagcgacctcacactcgactcctcctcctttctcctcaagaacgtgctgggcaggtcgagtgctatcgtgtacggcatagcgctcttggcgtctgggcagagctccaccataacaggcacttactccggccaatacatcatgcaggggtttctggacatcaggatgaagaagtggctgaggaacctgatgacccgctgcatcgccattgcaccgagcttagtcgtctccatcatcggtggttccaatggcgccggccgtctcatcatcatcgcctcgatgatactgtcctttgagctgccatttgccctgatcccacttctcaagttcagcggcagcagcagcaagatggggccccacaagaactccgtctacatcatcgtgttctcgtggttgctcgggctgatgatcatcggcatcaacatgtacttcctgagcacgagcttcgtggggtggctcatccacaactcgctgcccaagtatgccaacgtgctggtcggccttctcatcttcccactcatgctcgtctacattttcgcggtcatctacctcaccttcaggaaggacaccgtcgtcaccttcgtcgtcgactctgcccaaatcgacaccgagaaggccaaggcggaggaggaagaggagaaccagcctgtgccattccgggaggacctggcaaacatccctctcccggaatagaaaggctctagagtctatatatgtagtatatatgttgattccacgctgtgttcacttttagtgtactacgagcaaactagtgtcgaatgtaaatgaatagtggatggtaattctatctacaatcttggtgcc

SEQ ID NO: 41371 - protein, 528 aa, Panicum virgatum
  misc_feature: Ceres CLONE 2007503
  misc_feature (59)..(422): Pfam Name: Nramp Pfam Description: Natural resistance-associated macrophage protein
MEIERETRGNDSWRANAQEESKKLEDSDRLIKEPAWKRFLAHVGPGFMVSLAYLDPGNLETDLQAGANHRYELLWVILIGLIFALIIQSLAANLGVVTGRHLAEICKSEYPKFVRICLWILAEVAVIAADIPEVIGTAFAFNLLFHIPVWVGVLITGSSTLMLLGLQRYGVRKLEFLISMLVFVMAACFFGEMSFVKPPAVEVLKGLFIPRLKGAGATGDAIALLGALIMPHNLFLHSALVLSRKTPSSVRGIKDACRFFLYESGFALLVALLINIAVISVSGTVCFADNLSPEDAEKCSDLTLDSSSFLLKNVLGRSSAIVYGIALLASGQSSTITGTYSGQYIMQGFLDIRMKKWLRNLMTRCIAIAPSLVVSIIGGSNGAGRLIIIASMILSFELPFALIPLLKFSGSSSKMGPHKNSVYIIVFSWLLGLMIIGINMYFLSTSFVGWLIHNSLPKYANVLVGLLIFPLMLVYIFAVIYLTFRKDTVVTFVVDSAQIDTEKAKAEEEEENQPVPFREDLANIPLPE

SEQ ID NO: 41372 - DNA, 1389 bp, Panicum virgatum
  misc_feature: Ceres CLONE 2007504
  misc_feature: Encodes the peptide sequence at SEQ ID NO. 41373
gaacaattccgcattacacaaagatgaaaggcttggtctggtccttggaccctcccagcaaaagagaagaattgggtcgtggtgccttctcgactgttgcttctggaaccatcacctttcgaggagtaaccaaaccaacagccataaaggtcatagattatgagagaaaaacagcctatgaaaaagtctatttggaccgagaaattgaggtgatgcggctcatttcgcatccaaatcttttgcacatgttccattctgaaaaaagggacagatgtcttttcctgattttagagagaatgtgctgtgatttgaaagcatacattggtagtggattacgagaagacgtcgctcgatcatttatcctccaaatctctgctggaatgaaatatctaaatgaaaatagcttcgtccatcgtgacctcaaacctccaaatattttactctcagagagatcaccatttgcgacaatcaaaattgctgattttggaatggctagacgtctggactcaggagaaacaactgaatctttcgttgggacacctgactacgaagctccagaaattctattcaaaatcccttacacttcaactgcagatctctggagtcttggctgtgtattctttgaaatgttgcatggttcttctccttgcttgtccttaaatctcagaggtggtgcctggatccagaaactaaaatcaacagattcccttggtcctctcctcaaacgaccaaaaggtgtatctgatagtgcctgggatttaattgctggacttcttaaatgtgatcccaatacaagattaggatggaacgatttctttggacacaaatatctctctcaagaatatcttgcaaaacctgcaagtctcttagaatccagtcttagattggagggggatgaacaatttgatgtgattccgttagtgatgaccatggtcaatatttatagtttttcttctcatggacaatttcgtgcaatttttgagcgtcaacctgtcctactttcgacattgcaacaaaaaatagaatcttgggtgcatcctgatgatcaacttcttcttacaaacactggagagttgattaccgataagaaccttcaagaatatttatcaaaacaaaatcctatctatgttgttgacacccaactcttcacgactgagttgtgtgttgcttcttttacttttggtgatttgccgtatgatttggatattattgggttgtcagagttccctggagcatctcatccaagatcagcagcttggtttacattaagagctgattatatagataaactattacttaacgccgcagcaagagtctccaatggtaaacaaatgtgggacgcccaagaatatcaagaacgtgtctatcacgtgttttctactcatgtaa

SEQ ID NO: 41373 - protein, 455 aa, Panicum virgatum
  misc_feature: Ceres CLONE 2007504
  misc_feature (11)..(270): Pfam Name: Pkinase Pfam Description: Protein kinase domain
  misc_feature: SWISSPROT Homolog: EC 2.7.11.1 Non-specific serine/threonine protein kinase
MKGLVWSLDPPSKREELGRGAFSTVASGTITFRGVTKPTAIKVIDYERKTAYEKVYLDREIEVMRLISHPNLLHMFHSEKRDRCLFLILERMCCDLKAYIGSGLREDVARSFILQISAGMKYLNENSFVHRDLKPPNILLSERSPFATIKIADFGMARRLDSGETTESFVGTPDYEAPEILFKIPYTSTADLWSLGCVFFEMLHGSSPCLSLNLRGGAWIQKLKSTDSLGPLLKRPKGVSDSAWDLIAGLLKCDPNTRLGWNDFFGHKYLSQEYLAKPASLLESSLRLEGDEQFDVIPLVMTMVNIYSFSSHGQFRAIFERQPVLLSTLQQKIESWVHPDDQLLLTNTGELITDKNLQEYLSKQNPIYVVDTQLFTTELCVASFTFGDLPYDLDIIGLSEFPGASHPRSAAWFTLRADYIDKLLLNAAARVSNGKQMWDAQEYQERVYHVFSTHV

SEQ ID NO: 41374 - DNA, 674 bp, Panicum virgatum
  misc_feature: Ceres CLONE 2007504-R
agagtcaatcaaaaaaacatgggattagttatcaaacaactttttcagttcgtgaattgggtattcattgtatcccaagaaaagaaatcctagattctcattcattacttgaacgagcagaaaaagtctccgaaatactatgtacagctcttatatttctagaacaatatttcagagccgtctctgagttacaacgtcgaagtgtcattcgaaatagtttaaatactcaaataacatcaaatcaattaatgtttgatcaaatggttaattctgaaaatgcaagaagagctgcttttttttctgaaaaaaatccatatcttgaaaaagctattccgctattatttaatgacaatgttgttgttaaggggcctgtgctggaagttcctcataagggtgcagtgtttaatcagcttccttcgggttctggattatcgtttcctcttccaaatgcatcgaagcctttttatgattcttgggagaagaatttggaaaaggaaaatgtttcacttgatgaaacgaaaaagaaattacttgaaaggaaagagaagatggggcctgttacaaatgagaataatgaatatttggggtatttggcgaagaaggctcaagctcttgaagaagtcaaacagtcaaaaattacggagtgggcacaaatgagggaaaagattagacag

SEQ ID NO: 41375 - DNA, 689 bp, Panicum virgatum
  misc_feature: Ceres CLONE 2007526
  misc_feature: Encodes the peptide sequence at SEQ ID NO. 41376
aaagcaacaagtctggtgccatggcgggcggtggagaaggcgacgccggcagcggcagcggcgctgttcacgtcgtcatgttcccctggctcgctttcggccacataagcccgttcgcgcagctggcgcgcaggctggtctccggcgaggccgccggggtccgcgtcacgttcctcacggccgccgggatcgcgccgcgcgtcgaagccatgctggcttccgccgccggcgcggtgagggtcctgcccctgagcctgccgcaggtccctggcctgcccgcgggcgccgcgagcaccgcggacgtctcggccgacggcgcggagctgctcaagctctccctcgacggcacccgccccgaggtgcgcgcgcggctcgccgagctccgcccggacgccgtgctggtcgacttcaccaccccgtgggtccgcgacgtcgccgagccgctcggcgccaaggtgctctacttcaacgtcttctccgccgccgccttcgcttacgtcaatgtccctgcccgcctcgccggcgggaagcggccgtcgtccgcccgcgacctcacggcggcgcccgccgggtttcctgcggcctcggcgctcgcctccatgccgccccaccagggagcggacctggtgtacgtgtacaccagcttccacggcatgccgtgcgcgtccgaccgcgctgttgccggcgtc

SEQ ID NO: 41376 - protein, 222 aa, Panicum virgatum
  misc_feature: Ceres CLONE 2007526
  misc_feature: SWISSPROT Homolog: EC 2.4.1.115 Anthocyanidin 3-O-glucosyltransferase
MAGGGEGDAGSGSGAVHVVMFPWLAFGHISPFAQLARRLVSGEAAGVRVTFLTAAGIAPRVEAMLASAAGAVRVLPLSLPQVPGLPAGAASTADVSADGAELLKLSLDGTRPEVRARLAELRPDAVLVDFTTPWVRDVAEPLGAKVLYFNVFSAAAFAYVNVPARLAGGKRPSSARDLTAAPAGFPAASALASMPPHQGADLVYVYTSFHGMPCASDRAVAG

SEQ ID NO: 41377 - DNA, 726 bp, Panicum virgatum
  misc_feature: Ceres CLONE 2007529
  misc_feature: Encodes the peptide sequence at SEQ ID NO. 41378
ctcccacggctccactcacgccacgcggcggcggttaccatcaccggcgccggtacaccctgccttatccgacccggcgagaagcaccacccagcccacacgcacagggggccgcggggacccgcgaattcggcacgcaccacagccatggacgcgccccagctcctcctcggcgcgctcctcttcctcctccccgccgcgctcctcctccaccgctcgcggggcaagcgcccgcgcctcccgccgggcccgccgtccctgccgctcctcggcagcgtggtgtggctcaccaactcgcccgccgagatcgagcccctgctgcggcgcctcttcgagcggcacggccccgtcgtggcgctccgcgtcggggcgcgcctctccgtcttcgtcgccgaccgccgcctcgcgcacgcggcgctcgtcgagcacggcgccacgctggcggaccgcccggcgctcgcgtcggccaggctcctcggcgagaacgacaacaccatcacccgcgccagctacgggcccgtgtggcgcctcctccgccgcaacctcgtcgccgagacgctgcacccgtcgcgggtgaggctcttcgcgccggcccgcgcctgggtgcgccgcgtgctcgccgacaagctcggggaggccgcacccggcgcgccgccgccccgcgtcgtggagacgttccagtacgccatgttctgcctcctcgtgctcatgtgcttcggcgagcgc

SEQ ID NO: 41378 - protein, 192 aa, Panicum virgatum
  misc_feature: Ceres CLONE 2007529
  misc_feature: SWISSPROT Homolog: EC 1.14.13.88 Flavonoid 3',5'-hydroxylase
MDAPQLLLGALLFLLPAALLLHRSRGKRPRLPPGPPSLPLLGSVVWLTNSPAEIEPLLRRLFERHGPVVALRVGARLSVFVADRRLAHAALVEHGATLADRPALASARLLGENDNTITRASYGPVWRLLRRNLVAETLHPSRVRLFAPARAWVRRVLADKLGEAAPGAPPPRVVETFQYAMFCLLVLMCFGE

SEQ ID NO: 41379 - DNA, 792 bp, Panicum virgatum
  misc_feature: Ceres CLONE 2007530-R
  misc_feature: Encodes the peptide sequence at SEQ ID NO. 41380
ctaccagagcgcgggagggcaggcggccgtcggcccccagcacccgatcttgtactacgtgcacaagcggccgcactgcgacgagtttctgcgacgcgtcagcaagtggttcaacctggtcgtcttcacggcgtcggtgcaggagtacgccgacccggtcatcgactggctcgaggccgaacgcaagtacttctcggcccgctactaccgccaacactgcaccttccgccacggcgccttcatcaaggaccttagctcggtcgagcccgacctgagtaaggttatgatcctggataacagcccgttgagttacatgttccaccaagacaacgcaatcccgatacagggctggatcagcgaccccacagatagcgacctgtcgaacttgataccctttctcgaggggctgcagtacgtgtctgacgtacgtgcgctcctagccctgcgcggcggcgaggacgggcagcatatggcctgacgagaggattcgcattgattgggggcattgtttattgtggcattacatggattggcgggggccgggacacagcacatttctctctctttttttttggagataggtgggcggggaggaggcaagcaagcaaaagagttgaatgttttgcagagcgggtcaagcgaaggcatgcggagtgaagaggctcgtgtcgtgtgtgtggtatgcttgggggttttttgttgcctgcggggcatcacacctatggcatgtgacggagtactgagtaactctgctgtggcccagtagcttcctggtaattgagcctttacatt

SEQ ID NO: 41380 - protein, 158 aa, Panicum virgatum
  misc_feature: Ceres CLONE 2007530-R
  misc_feature (2)..(148): Pfam Name: NIF Pfam Description: NLI interacting factor-like phosphatase
  misc_feature: SWISSPROT Homolog: EC 3.1.3.16 Phosphoprotein phosphatase
YQSAGGQAAVGPQHPILYYVHKRPHCDEFLRRVSKWFNLVVFTASVQEYADPVIDWLEAERKYFSARYYRQHCTFRHGAFIKDLSSVEPDLSKVMILDNSPLSYMFHQDNAIPIQGWISDPTDSDLSNLIPFLEGLQYVSDVRALLALRGGEDGQHMA

SEQ ID NO: 41381 - DNA, 1380 bp, Panicum virgatum
  misc_feature: Ceres CLONE 2007530
  misc_feature (1242)..(1242): n is a, c, t, g, unknown, or other
acgaaccctgggcccgtcccttgctccctccattttgtcggtattcgtatcacctatcctccacaccacacgaacctctcgccgagcgagcccgcagagtgcaaacttggaatcaagggtggaacagcagaaagggtcttcggtgtgctgagcgcatagcattttcatttttggccacctggccgcgaatccacaccatcgacccaagtcctgctggttcgcccagtcgagttccctcccccccctggcgcggtcgcacttcgtccttcatggccttctcgatgtcgacggcaagatgaactccctcaacatcatctcggcccgagtctcccctccgccgagcccaggaccgacaagatcaaactcgcttaacgctctaggactggcagtcagctccgaagccgacgggccacggcagaaccagaccgagagcgcgctacgcaatattaatgagaaggatggattgatggccgagcccgacgacttccgtttagaaaacccaccaactgacgaccggcgccacgaatacgcgatcgacgaaacggcccccctaatatcccaagcaaaagactctaagcctcaaggctggttgtgggtgctttacccaaagcgtgttacaaacgcctttgtggactctgtacggtggatcctgtcgacgttggctacgcccggcgtctatttgtacgcctgcttttgcgacgagaacggccacttcgcgccgctgcagcagctcgggcggctgttcggcctctacgggggtgatgcgaagaggatggcattggattatcacgaagggatagctgcgtccgagaagcgcaggcagggtacagacgggtccgcaggcgggagtgggcggaggaatagtagaacattacgtgtcgtcgggtcgaacgcttcttcgtcgtccggcctctcgtcggaatcggagtcggacccggaccgtaagaggcagggcacccgtcgaggctcaagtggaagacacttgcgctcgaaatcactaccggattccgacgaggttgcgccggcacagcgctccataagaatcaaactccactctgacgaagccctgcggcagaggaagcaccggaaatcgcagtcgaccagcgctcgcggaagcggcgggtccggcgacgccatggacagcatctcggcccagctaaagtccccaacctctcccgccggcgctctgaccaagtaccccaagacgccggcgcctccacggccactaatcccacgccgacnaccctcgtatatcaacaagaacgtagaaatgaccgacgtcagacaccaaaagacattgatcctcgatctcgatgagacactgatccacagcatgtccaagggcgggcggatgagctcggggcacatgggtggaggtgc

SEQ ID NO: 41382 - DNA, 769 bp, Panicum virgatum
  misc_feature: Ceres CLONE 2007532
  misc_feature: Encodes the peptide sequence at SEQ ID NO. 41383
actctctctcttcttccaccccctctcctccctccccatcaggctccctgaccggtcaccatctccccatccgtccccttgcccttcgtcttcgccttgttcttggcttcctcggggcagggaggggaagggggaaggaggaggcgagaccctgatttgatctgcttgcttttggttgccgaggagacgagaggagaggggttggtgcagttggaggcgtgcctctgtgtctgtgtgcgcggagatggaccccaagttccccacacccccaccgctaaacaaagcggagcccaccaccgcgacgaccaccaccaccacctcgaccgcgcagcagctggatcccaaggactaccagcatcagcagccggcgcagcaccaggagcagcaccaccaccacctgcaaatccaaatccaccagccgccgcagcaggacgggggcggcggcggcaaggagcagcagctgcaggtggcggcgccggcaggggagcgaagggtggcgctcgcgcccaagcggagctccaacaaggaccgccacaccaaggtcgacggccggggccgccggatccggatgcccgcgctctgcgccgcgcggatcttccagctcaccagggagctcggccacaagtccgacggcgagacggtccagtggctgctccagcaggccgagccggccatcgtcgccgccaccggcacgggcaccataccggcgtccgcgctcgcctccgtcgcgccctcgctcccgtcgcccacctcaaggttcgccaggccc

SEQ ID NO: 41383 - protein, 174 aa, Panicum virgatum
  misc_feature: Ceres CLONE 2007532
  misc_feature (83)..(174): Pfam Name: TCP Pfam Description: TCP family transcription factor
  misc_feature: The sequence is a functional homolog of SEQ ID NO 166 in the 10/225,068 US patent application
  misc_feature: The sequence is a functional homolog of SEQ ID NO 220 in the 10/374,780 US patent application
MDPKFPTPPPLNKAEPTTATTTTTTSTAQQLDPKDYQHQQPAQHQEQHHHHLQIQIHQPPQQDGGGGGKEQQLQVAAPAGERRVALAPKRSSNKDRHTKVDGRGRRIRMPALCAARIFQLTRELGHKSDGETVQWLLQQAEPAIVAATGTGTIPASALASVAPSLPSPTSRFAR

SEQ ID NO: 41384 - DNA, 1320 bp, Panicum virgatum
  misc_feature: Ceres CLONE 2007567
  misc_feature: Encodes the peptide sequence at SEQ ID NO. 41385
gatttaaataagtttctcctcttttcctccgtccctcttttccggcgccttcccggggcgcggacacacacgcctcccctgctgctgcccgcgccgctcttcgtcctcccttctgtctgcaagttcccgcgccgcaagttcccgcgccacggcggcgccggggaggcggaggcgcgtctcgcggcgctgcggcggcacgacggccgccgccacggccgactcctcctcggcgccgccgacctgcccctcggcggcgtcgggctccccaccgagaccggataggtgaccgaccaaccaaccaacctcgcctgcgcctttccccgccgcgccgtgtctgactggggctctcctcgccggggcagcctgtacttcacgcggattgagatcggggcgccgcccaggggctactacgtgcaggtggacaccggcagcgacatcctctgggtcaactgcatccgctgcgacggctgccccacccggagcggccttgggatagagctgacgcagtacgacccggcggggagcgggagcacggtggggtgcgaccaggagttctgcgtcgccgccaacgccggcgtgccgccgccgtgctcgtcggagtcggagtcgccgtgccagttcaggatcacctacggcgacgggagctccaccaccggcttctacgtcaccgacctcctgcagcacgaccgggtgtccggcgacggccagaccaccccgtccaacgccaccatcacgttcgggtgcggcgctcagctcggtggggatttggggtccgacagccaggccctcgacgggattctggggttcggccaggccaattcgtcggtgctgtcgcagctggctgctgctaagaaagtccccaagattttcgctcactgcttggacaccgaccgtggcggtgggatcttcgcgatcggggatgtggtgcggcccagagtgaagacgacgccgttggtgccaaacatgccacactacaacgtcaacctggaaggaatttctgttggtggtgctacacttcagcttccaacaaatattttcgattcaggtgaaaataaaggcactatcattgacagcgggacaacattggcatacctcccagaggaagttcacaagactttgatggctgcggtattcaacaagtaccaagatatggccttccataattatcaagacttcctctgtttccagttctctggaagtgtagatgatggatttcctataatcacctttaattttgagggagaccttacactgaatgtttacccacatgattaccttttcaaaatggggatgatttctactgtgtagggttcctgaaat

SEQ ID NO: 41385 - protein, 114 aa, Panicum virgatum
  misc_feature: Ceres CLONE 2007567
  misc_feature: SWISSPROT Homolog: EC 3.4.23.12 Nepenthesin
MPHYNVNLEGISVGGATLQLPTNIFDSGENKGTIIDSGTTLAYLPEEVHKTLMAAVFNKYQDMAFHNYQDFLCFQFSGSVDDGFPIITFNFEGDLTLNVYPHDYLFKMGMISTV

SEQ ID NO: 41386 - DNA, 573 bp, Panicum virgatum
  misc_feature: Ceres CLONE 2007567-R
gccgcccctccctctctctctcggccgccgcccatgctgtgcgtgcggtgctagcacaccgacgtccggcgtttcatccccgtacgtgtggactctgtggaggcgctgctgcgactgctgcgctgatcggctgctgggatcaggtacgaggagctcggttcgtgggacgtgatcgactacttcctctacatcgacgcgcgacttcttccgctgcgctgcgcgtctagtggtaacgatctatgatcttctactcgcaagtatcttgggtatatgcgatagtgatgctagcgtagcctacccgtttccctacagtggtaccagagccatcttgcgtagtttttggtctggatcttttgcatataggtgatatgttgttgtagtagattggatctattacttttgcacggtttgattagatcaattggtcataaggggttaaaactggagcgagttgattgcgcggcatgtgacaaaagattagtttgtgttctttctctgttatgcatacgatatgtccctaccggctggaatcaccatcgggactaactgtgtgcatagtcagcaaattgaacc

SEQ ID NO: 41387 - DNA, 705 bp, Panicum virgatum
  misc_feature: Ceres CLONE 2007574
  misc_feature: Encodes the peptide sequence at SEQ ID NO. 41388
aagcatcgaacgaagcacacgatcgacacgagattggggacaccactgccactcgtccaccccaatggcgaccgccagagccagtacggctcatttcctcctcatcctcctcgccaccctcctctgcgccgccgccgccgcgtcgtcctgggacggccgcgagccctggcgctgcgagcggcggtgcgaggaccggccccggcaccagcgcgcacggtgcgtgcaggagtgccgggaggagcaggagcggggcgggcacgagctcggccgccgtggcgagggctccggagacgagcgcgagagcgagagcgagagcgagagcgagagcgagcaggagcaggagagccgccggccgtacgtgttcgaccggcgcagcttccggcgcgtcgtccggagcgagcaggggtccgtcagggcgctccggccgttccacgaggcgtccaagctcctgcgcggcatccgcgactaccgcgtcgcggtcctggaggcgaacccgcgctccttcatcgtgcccagccacaccgacgcgcactgcatctgctacgtcgcccaaggcgagggtgtggtggcgacgatcgagaacggcgagaggcggtcgtacaccgtcaaggaaggcgacgtcttcgtggcgccggtcggggcggtgacctacctgggcaaacacgacggccggaggaagctcgtcatcgccaagatcctccacac

SEQ ID NO: 41388 - protein, 213 aa, Panicum virgatum
  misc_feature: Ceres CLONE 2007574
  misc_feature (105)..(213): Pfam Name: Cupin_1 Pfam Description: Cupin
MATARASTAHFLLILLATLLCAAAAASSWDGREPWRCERRCEDRPRHQRARCVQECREEQERGGHELGRRGEGSGDERESESESESESEQEQESRRPYVFDRRSFRRVVRSEQGSVRALRPFHEASKLLRGIRDYRVAVLEANPRSFIVPSHTDAHCICYVAQGEGVVATIENGERRSYTVKEGDVFVAPVGAVTYLGKHDGRRKLVIAKILH

SEQ ID NO: 41389 - DNA, 683 bp, Panicum virgatum
  misc_feature: Ceres CLONE 2007603
  misc_feature: Encodes the peptide sequence at SEQ ID NO. 41390
agtagcagcaagcttcaaatccctccccctctgcttttccctctccctcttcctcctcctccaccccctttcccacctcagcgagaaccttccaaagcctcccgagaggttccctcgccagtccgaaccatcgggaagcgctcgcgcgcgccgcgccctcccccgagctcgccggagccatggagaagtacgagctgctcaaggacatcggcgccggcaacttcggcgtggcgcggctgatgcggaacaaggagaccaaggagctcgtcgccatgaagtacatcccccgcggccaaaagattgacgagaatgtggcgagggagatcatcaaccaccgctcgctgcggcaccccaacatcatcaggttcaaggaggtggtgctcacgccgacgcatctggcgatcgtgatggagtacgccgccggcggcgagctgttcgaccggatctgcaacgccggcaggttcagcgaagacgaggcgaggtacttcttccagcagctgatttgcggcgtgagctactgccacttcatgcaaatttgccatcgcgacctgaagctggagaacacgctgctggacggcagcccggcgccccgcctcaagatctgcgacttcggttactccaagtcgtcgctgctgcactcgaagcccaagtcgacggtgggcacgccggcgtacatcgccccg

SEQ ID NO: 41390 - protein, 167 aa, Panicum virgatum
  misc_feature: Ceres CLONE 2007603
  misc_feature (4)..(167): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50598
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 50599
  misc_feature: Useful for making plants with modulated water use efficiency
MEKYELLKDIGAGNFGVARLMRNKETKELVAMKYIPRGQKIDENVAREIINHRSLRHPNIIRFKEVVLTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIA

SEQ ID NO: 41391 - DNA, 1453 bp, Panicum virgatum
  misc_feature: Ceres CLONE 2007606
  misc_feature: Encodes the peptide sequence at SEQ ID NO. 41392
agcccgctgtccaaattctgtcgtgttactgtcgggaaggatcaatcatcaggtaaccttttcttctccggtggctggtcccggttcctggcgtccaacggcatcacggaatatgatgtcctgctgctgaggtacgagggaaacatggtgttcactgtcaaggtgtttgggcctgacggctgccagaaaggttacaaggaccaaggcaccagtagcaaggaacaagagcagagtgatgataaaacgacatttgccgatactaagacggaagaggaagaccctccatcttccagtaggaaaggcaagggcatggagaagaagccaggtggtgaagagaattccaagaggccaacaagtcccataacttcgtcgaacaaagcacaattatcaatgaataggccagtctacaaggttggaccaccatcctggatgaagagggagatcagcagctctacactttggaaacgcctttctgttccgaggaatttctgcaaggcgatcgggctttggaggacgtccgaggtcacgctcaggacaactgcgtacgaggatcatggccacaggtcatggcaggtgcgctttctgttctacgagaatcgcaattccggtgagctctctcggggttggaggaggttctgcacggacaacaggatcaaggaaggagatatctgcaccttcaacgtcatcgagaccacattgtggcacgtcgacatcacgcgtcatggtgagggccagggcaccattagcaatgagctagagcagagtgataaaacgccattttcagacacggaaaaggaagatgttccatcttccagtaggaaacgcaagtgcgaggacaagaagccagacggtgaagagaattccaagaggacaaaaggtcctacaacttcattgaatgaggccccatcatcaattgtctacgagatcggaccaccatcctggttgaagagggagatcagcgcccatatgctctcggatcaactgtatgttccgaggaatttttacaaggcgatcgggctttacagggcctctggcatcacgctcaagactacggcgaatgaggatcatggcctcaggtcatggcaggtgcgcttcttggtgtatcggaatcgtggcacgctgactcggggctggaggacgttctgggcggacaacatgatcaaggaaggtgacatctgcaccttcaacatcatcaaacccatgctatggcacgtcgacatcatgcgtcacagctaagccttgtgtatttggcatcagttggtcatgtatgaaatgatgctgcctaatcttattcatgactttttggtcaaaaactgatcgagctctcatgaggcctgcactccattttctgttgggatataagttaacaatggagctctaggacgtgtttgtaaaaatgcctatgtcaggcaatctgtattcagtcagtgaaccaagcaccatttgcagttct

SEQ ID NO: 41392 - protein, 411 aa, Panicum virgatum
  misc_feature: Ceres CLONE 2007606
  misc_feature (143)..(243): Pfam Name: B3 Pfam Description: B3 DNA binding domain
  misc_feature (314)..(408): Pfam Name: B3 Pfam Description: B3 DNA binding domain
SPLSKFCRVTVGKDQSSGNLFFSGGWSRFLASNGITEYDVLLLRYEGNMVFTVKVFGPDGCQKGYKDQGTSSKEQEQSDDKTTFADTKTEEEDPPSSSRKGKGMEKKPGGEENSKRPTSPITSSNKAQLSMNRPVYKVGPPSWMKREISSSTLWKRLSVPRNFCKAIGLWRTSEVTLRTTAYEDHGHRSWQVRFLFYENRNSGELSRGWRRFCTDNRIKEGDICTFNVIETTLWHVDITRHGEGQGTISNELEQSDKTPFSDTEKEDVPSSSRKRKCEDKKPDGEENSKRTKGPTTSLNEAPSSIVYEIGPPSWLKREISAHMLSDQLYVPRNFYKAIGLYRASGITLKTTANEDHGLRSWQVRFLVYRNRGTLTRGWRTFWADNMIKEGDICTFNIIKPMLWHVDIMRHS

SEQ ID NO: 41393 - DNA, 670 bp, Panicum virgatum
  misc_feature: Ceres CLONE 2007607
  misc_feature: Encodes the peptide sequence at SEQ ID NO. 41394
ctcctgcgccccactcgcctcccccctacccctcccacgccgcgagcgaatccggacggctcgctgccccggctcccctctcctgtcccgcgatggcggcgtccatggcgtcgccgcgggggcggtcgatccgggagacggtgctggagaccgtcgcggcgtaccacaaccagcagcggatgaggcgcaagctgcgcaagagcctcacctacgccggcgagctctcctccgcgggccgggcacgcggggacggcgcgtcctcgtccgcctcggtatcctcgctctgcgggcccgaggacgacgacgagcccttctgggaggaggaggagggcaccgtcgagctcgtccagctcggggccaaccgcgccaagaacgtcctcatcctcatgagcgacaccggcggcggccaccgcgcatccgcggaggccatcaaggacgccttccggatcgagttcggcgacgagtaccgggtcttcgtcaaggatctgtgcaaggatcacgccggctggccgctcaacaacatggagagctcatacaagttcatggtgaagcatgtgcagctctggaaagtggccttccataccacctctcctagatggatccattgcttctacctcgctgctctcgcctcattctatgccaagaaggtggaggctggactgaagaagta

SEQ ID NO: 41394 - protein, 192 aa, Panicum virgatum
  misc_feature: Ceres CLONE 2007607
  misc_feature (106)..(192): Pfam Name: MGDG_synth Pfam Description: Monogalactosyldiacylglycerol (MGDG) synthase
MAASMASPRGRSIRETVLETVAAYHNQQRMRRKLRKSLTYAGELSSAGRARGDGASSSASVSSLCGPEDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHTTSPRWIHCFYLAALASFYAKKVEAGLKK

SEQ ID NO: 41395 - DNA, 675 bp, Panicum virgatum
  misc_feature: Ceres CLONE 2007608
  misc_feature: Encodes the peptide sequence at SEQ ID NO. 41396
gtctcgcccctccctcctccgtgtcatgtcctgctgcctctgctgcttctctatcgtctccatccatgtccgccccgctggctcggtgtccttcaacctcaccttctcccagccccgcgcccccggcaacctgctgcagctgatcaactgcaccggcgactcctacctgagcccggatacgctcgagctgaccaagaaccggcgtgatcagagcagcacatacagcaccggccgcgcgaagtacacgcagagggtgcccctctgggacagggcctccggcgaggtcgctagcttcaccaccaccttccgcttccaaatcactctggaccccagcacgaattggacaggagacggcatggctttcttcctcgggagtttccagtcggacgtccccgccaacagcggcggcgggaggctgggcctcctcccgggctacaccaacggcaccggcgacggcaccatcgtcgccgtcgagttcgacaccttcaagaatgcggagcccgccgacatcagcggcaaccatgtgggcatcgacgtcaactccctcacctccacggggtccacggacaccacctcgcccacccacaacctgacgtccaggtaccccatgggtggccaaccgtgaggaacgaaaactccacccatttgctggccgtccacctccaaaataaacgc

SEQ ID NO: 41396 - protein, 199 aa, Panicum virgatum
  misc_feature: Ceres CLONE 2007608
  misc_feature (19)..(198): Pfam Name: Lectin_legB Pfam Description: Legume lectin domain
MSCCLCCFSIVSIHVRPAGSVSFNLTFSQPRAPGNLLQLINCTGDSYLSPDTLELTKNRRDQSSTYSTGRAKYTQRVPLWDRASGEVASFTTTFRFQITLDPSTNWTGDGMAFFLGSFQSDVPANSGGGRLGLLPGYTNGTGDGTIVAVEFDTFKNAEPADISGNHVGIDVNSLTSTGSTDTTSPTHNLTSRYPMGGQP

SEQ ID NO: 41397 - DNA, 1799 bp, Panicum virgatum
  misc_feature: Ceres CLONE 2007611
  misc_feature: Encodes the peptide sequence at SEQ ID NO. 41398
attgaggacttgaggtggttgaggagcacaaggaaacgacggctccccccgttccgttcccgacgactcccgcgagaggcgtgggcgcggccatggcctccgccaccggctccggctccggccagcagcaatccccaagcacagcagcagcagcagatgctaacccgggagctggggccgacaagctcgtgttcgaggcggcggcgcagcccatgagggaggactacgtcgagaacgccgtcaagttcctctcccaccccaaggtcaggggctcccccgtcgtctacaggcgctccttcctcgagaagaagggcctcaccacccaggagatcgacgaggccttccgaagagtccctgatccgcaaccaagtgccactactgctacagcttcacaatcacagcagcaggcgaacatccagaatcaatccactggagtccaaacttacacaccagtgcagtctctgcagccaggaactgctggccctgtagtccttcgtacacagcccaggttcagctggtaccgagcattccttgctgcagggctgttgcttggttttggtgccagtgctgctgtcttcgtcaagaaactgttccttcccaggctcaagtcttggatacgcaaagttgtagcacaaggcgatgaaactcaaggcaatcaacttaaggccaagattgatgaggaaacagcagaggctgtaaaggcttctgcgtctgctgtttctgctattgctaaaacgaaccaacaactgcttgcttcaaaagatgaagaaaagaagatacttgtgacattaacacaagctctagattcccaagccaaggagttaaaatctttgagtgagtcactcaatcatagcagggagtccataaacattaccagggaggataggttttctcagtaccgtccactggaagagcatgcccctcctgctataaggaatggaccagttaacagttcatggagagcttctcagcaaactaacatttacggcgcatcaaacggcgactttggctctgggaggtcttcatttgcgccagcacctatggaacctacgtctgggtcattttcaagatcatatgcggagacaatgtccactgcacaccgaggggataggtcttctagcagtaagccatgggagatgcagcagtattcacagcagcggcctggttatggatccaactctcagctgagtgatgatggatcacacaccgatgcccatgacagctatcctccttcctatcaccagaatggaaaggcccctgattttcaagcagatgagcctaggcctttgacctacaacactgggattgaggaaaggcctccgcctcagcgccgctgggtcccccctcagcctccaggtgttgtcatgccagaagcagtggctgccatacgtcaaccaaagacccttcctaagcagccatcgagcgacgtctctgagacagctagtgagatgcaggtgaatggtgcttcaagtgcatcggctgttgtcactgaggtgcctgttaatggagctgctgcaagtgatgctggacgtagcgagatcgaagaacaatcagaggccatctaagcaaaagtgaggtccaccaagaaccgagaagcaatctaagctagatccgggtacattttggagtttgacatacatttctgaataatatctatatcagaacaacagctcagcagtggaagatggatacccacgattcaagaacttacaaatagtttctatatttaggctaatgctacttgtacacagaaaaacgtatcaataagattccatggttgtgcatctgggggttcttac

SEQ ID NO: 41398 - protein, 490 aa, Panicum virgatum
  misc_feature: Ceres CLONE 2007611
  misc_feature (41)..(171): Pfam Name: Pex14_N Pfam Description: Peroxisomal membrane anchor protein (Pex14p) conserved region
MASATGSGSGQQQSPSTAAAADANPGAGADKLVFEAAAQPMREDYVENAVKFLSHPKVRGSPVVYRRSFLEKKGLTTQEIDEAFRRVPDPQPSATTATASQSQQQANIQNQSTGVQTYTPVQSLQPGTAGPVVLRTQPRFSWYRAFLAAGLLLGFGASAAVFVKKLFLPRLKSWIRKVVAQGDETQGNQLKAKIDEETAEAVKASASAVSAIAKTNQQLLASKDEEKKILVTLTQALDSQAKELKSLSESLNHSRESINITREDRFSQYRPLEEHAPPAIRNGPVNSSWRASQQTNIYGASNGDFGSGRSSFAPAPMEPTSGSFSRSYAETMSTAHRGDRSSSSKPWEMQQYSQQRPGYGSNSQLSDDGSHTDAHDSYPPSYHQNGKAPDFQADEPRPLTYNTGIEERPPPQRRWVPPQPPGVVMPEAVAAIRQPKTLPKQPSSDVSETASEMQVNGASSASAVVTEVPVNGAAASDAGRSEIEEQSEAI

SEQ ID NO: 41399 - DNA, 654 bp, Panicum virgatum
  misc_feature: Ceres CLONE 2007618
  misc_feature: Encodes the peptide sequence at SEQ ID NO. 41400
acttgactcctcagcttccaccctcctggcttcccctctctcttcccttccgcttcccatgtgggcggcctcgagctctgcttagatcacagctgtgcttgttggtttggtgatccgccccttgtcggctcggctcctttcagctccgagctctgggacagggaggtctgcgctgtcgcccgcctcggctcccttttgtgttgtgcgcctaggggcactgagcaatcgctgggaggatgcagcacgacctgaagaagaagggaccttcagaaatggattttttcacggaatatggtgagggcagcaggtacaagatagaagaggtcatagggaaagggagctacggtgtggtttgctctgcgatggacacccatactggcgaaaaggttgctataaagaagataaatgacatcttcgagcatgtgtctgatgcgacaaggatactccgcgagatcaagttgcttagactactgcgacatccagatattgtggaaataaaacatattctacttcctccatcaaggagagaattcagggatatatatgtagtttttgaactcatggagtctgatttgcaccaagttataaaggctaatgatgacttgaccccagagcactatcagtttttcttgtatcagttgcttcgaggattga

SEQ ID NO: 41400 - protein, 139 aa, Panicum virgatum
  misc_feature: Ceres CLONE 2007618
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MQHDLKKKGPSEMDFFTEYGEGSRYKIEEVIGKGSYGVVCSAMDTHTGEKVAIKKINDIFEHVSDATRILREIKLLRLLRHPDIVEIKHILLPPSRREFRDIYVVFELMESDLHQVIKANDDLTPEHYQFFLYQLLRGL

SEQ ID NO: 41401 - DNA, 1346 bp, Panicum virgatum
  misc_feature: Ceres CLONE 2007619
  misc_feature: Encodes the peptide sequence at SEQ ID NO. 41402
aagcgccgcgcatcgccatctcccattgctcatagaagaaaggaagagggagcggcgagcgagcagggagggcagggcaggtcggtccatggcgacgtgcgcagggcaggtcggtccatggcgacgtgcgccgcgagcctcgcgccgctgctgggcccggcggcggcgaacgcgacggactacctgtgcaaccggttcgcggacaccacgtcggcggtggactcgacgtacctgctcttctcggcgtacctcgtcttcgccatgcagctggggttcgccatgctctgcgcgggctccgtccgcgccaagaacaccatgaacatcatgctcaccaacgtgctcgacgccgccgccggcgcgctcttctactacctcttcgacttcgccttcgcgtacgggacgccgtccaacggcttcatcggcaagcagttcttcggcctcaagaggctcccccagatcggcttcgactacgacttcttcctcttccagtgggccttcgccatcgccgcggccgggatcacgtcgggctccatcgccgagcggacgcagttcgtggcgtacctcatctactccgccttcctcaccggcttcgtgtacccggtggtcccccactgggtctggtccgccgacggctgggcctcggcgtcccggacgtcggggaagctgctcttcggctccggcatcatcgacttcgccgggtccagcgtcgtccacatggtcggcggcatcgccggcctctggggcgccctgatcgagggcccccgcatcggccggttcgaccacgccggccgctcggtggcgctgcgcgggcacagcgcgtcgctcgtcgtgctgggcaccttcctgctgtggttcgggtggttcggcttcaacccggggtcgttcctcaccatcctcaagagctacggccccgccggcagcatccacgggcagtggtccgccgtggggcgcaccgccgtgaccaccaccctcgccggcagcacggcggcgctcacgacgctcttcggcaagcggctccagacggggcactggaacgtgctcgacgtctgcaacggcctcctgggcggcttcgccgcgatcaccgccggctgctcggtcgtggacccctgggcggccgtgatctgcgggttcgtgtcggcgtgggtgctcatcagtctcaacgcgctggcggcgaggctcctgttcgacgacccgctggaggccgcgcagctgcacggcgggtgcggcgcgtggggagtcctcttcacggggctgttcgcgcgcagggagtacgtggagcagatctacggcgcgccggggcggccgtacgggctcttcatgggcggcggcgggcggctgctggcggc

SEQ ID NO: 41402 - protein, 409 aa, Panicum virgatum
  misc_feature: Ceres CLONE 2007619
  misc_feature (36)..(409): Pfam Name: Ammonium_transp Pfam Description: Ammonium Transporter Family
  misc_feature: Functional homolog of the protein sequence given in SEQ ID NO 51423
  misc_feature: Useful for making plants with modulated carbon-nitrogen partitioning
  misc_feature: Functional homolog of the protein sequence given in SEQ ID NO 51424
  misc_feature: Useful for making plants with altered carbon content
  misc_feature: Useful for making plants with altered nitrogen content
MATCAASLAPLLGPAAANATDYLCNRFADTTSAVDSTYLLFSAYLVFAMQLGFAMLCAGSVRAKNTMNIMLTNVLDAAAGALFYYLFDFAFAYGTPSNGFIGKQFFGLKRLPQIGFDYDFFLFQWAFAIAAAGITSGSIAERTQFVAYLIYSAFLTGFVYPVVPHWVWSADGWASASRTSGKLLFGSGIIDFAGSSVVHMVGGIAGLWGALIEGPRIGRFDHAGRSVALRGHSASLVVLGTFLLWFGWFGFNPGSFLTILKSYGPAGSIHGQWSAVGRTAVTTTLAGSTAALTTLFGKRLQTGHWNVLDVCNGLLGGFAAITAGCSVVDPWAAVICGFVSAWVLISLNALAARLLFDDPLEAAQLHGGCGAWGVLFTGLFARREYVEQIYGAPGRPYGLFMGGGGRLLA

SEQ ID NO: 41403 - DNA, 214 bp, Panicum virgatum
  misc_feature: Ceres CLONE 2007619-R
cccgcgcccccgccgaggacgagagggccggcagggaccagacgcggcacggcggggccgcggacgcgcaccacgacgacgagaacccgagcggcaggcccaagggcgggcagaccccgcagaacgccagcgcgcccagcggcgagaccaagcgacgcggggccagccggcagccgcaaaagaaggagcacacaaacaaacccaacccaccccc

SEQ ID NO: 41404 - DNA, 649 bp, Panicum virgatum
  misc_feature: Ceres CLONE 2007625
  misc_feature: Encodes the peptide sequence at SEQ ID NO. 41405
gctccattttaggagaaatgtgggattgcttaatatgttttctcacttgaaaatgtcaacatccgaggttactaatcccaaagacccggaaattgttgattctcttctccttgatctgttggatccagaaaacaaagtgtatgccctttccatgttaccaaagaaaagggagacgcttaataatttggccccactgctgtggtactcttttggcacaatagccgcactgcttcaggaaattgtgtcagtctaccctgcactttcacccccaacattatcggcaagtgcagcgaaccgagcctgcaatgcacttgcacttcttcagactgttgcagcacaccctgagaccaggaccccctttttagaagctgaaattccctcttacttgttcccaatcttgaacactaccagcgaggccaaatctttcgagtacctgcgtcttactagccttggtgttctcggtgctcttgctaaggtagatgatactgaagttgtcaaattcctgctgaaaaaagaggtcattcctctgtgcttgcgaatcatggggacaggcagtgagctttcaaaaacagtggccactttcattgtccacaagattatgctagatgaagtggggctacagcatatatgtgccaccccagaatgtttc

SEQ ID NO: 41405 - protein, 198 aa, Panicum virgatum
  misc_feature: Ceres CLONE 2007625
  misc_feature (17)..(198): Pfam Name: Rcd1 Pfam Description: Cell differentiation family, Rcd1-like
MSTSEVTNPKDPEIVDSLLLDLLDPENKVYALSMLPKKRETLNNLAPLLWYSFGTIAALLQEIVSVYPALSPPTLSASAANRACNALALLQTVAAHPETRTPFLEAEIPSYLFPILNTTSEAKSFEYLRLTSLGVLGALAKVDDTEVVKFLLKKEVIPLCLRIMGTGSELSKTVATFIVHKIMLDEVGLQHICATPEC

SEQ ID NO: 41406 - DNA, 629 bp, Panicum virgatum
  misc_feature: Ceres CLONE 2007626
  misc_feature: Encodes the peptide sequence at SEQ ID NO. 41407
cttttactggaaagaaaggagaatttgttgaacttgaagagacaatttctggattcagagatattgttgcaggaaaatatgatcatcttcctgaacaagcattttatatggttggaaatattaatactgtgcttgcaaaggctgagactattgctgctgaggttgctaaggcaaaggagagtggatctgctgatgcgaaatcaaaggattcaaagaaagatgtaactgagcagactcattcaaatgatgaaattagaggaattttgaaagcacttgctgacgagatcaaagcacatgatcttaagaaagcacgtgatattaaagcagcggatagaggaacagatgagttacaggttggatggagatttccaaaagaagaacaaatcttgaagacatgggatgaatgggaggcaagatttaataaggaaacaaatttggatttggcatttgaagagcattttgttaaagctactgcaagacttcaagaagaacgtgctaaggatttggctgagtttggagctttgggataaattgcttgaaaaattcaaaagaagagaaaatgttgctatttgacaaaaaaatcattgaagcaaattctttttaaaaaaaaaaaaataaacggcttttgt

SEQ ID NO: 41407 - protein, 175 aa, Panicum virgatum
  misc_feature: Ceres CLONE 2007626
  misc_feature: SWISSPROT Homolog: EC 3.6.3.14 H(+)-transporting two-sector ATPase
FTGKKGEFVELEETISGFRDIVAGKYDHLPEQAFYMVGNINTVLAKAETIAAEVAKAKESGSADAKSKDSKKDVTEQTHSNDEIRGILKALADEIKAHDLKKARDIKAADRGTDELQVGWRFPKEEQILKTWDEWEARFNKETNLDLAFEEHFVKATARLQEERAKDLAEFGALG

SEQ ID NO: 41408 - DNA, 1771 bp, Panicum virgatum
  misc_feature: Ceres CLONE 2007633
  misc_feature: Encodes the peptide sequence at SEQ ID NO. 41409
gaacagacggggtagggttccttgcggccgaagcggccgcgcgcctctacgccttccattacacagcccaccctccacctcgcgcctccaaaacccttccccctcctcaccccgtcctagggttcgcgccgccgcgtctcgccgcgccgcccccgccgcagccatggggtcgtcgctcccgcccaaggaggccaacctcttcaaagtcatcgtcaaatcctatgagactaagcaatataagaaagggcttaaggctgcagattctatattaaaaaaattcccagagcatggcgaaacactatcaatgaagggtttgacactaaactgcatggaccgaaaatctgaagcatatgaacttgttcgacgtggtctgaagaatgatctgaagagtcatgtctgctggcatgtctatggattactttaccgatcagacagagaatacagagaagctataaaatgttacagaaatgctttgaggattgatccagataacatagaaattcttcgtgacttgtcacttctccaggcacaaatgagggacttatctggttttgttgagactaggcaacaacttttgtctttgaagccaaatcaccgcatgaactggattggttttgctgttgctcatcatttgaattccaattcctccaaggcaatagaagtattggaggcatatgaggggacactggaagatgattatcctccagacaacgagcgatatgaacacaatgaaatgctgctgtataagatatcattgtttgaggaatgtgggatgctagacagagcccttgaggaaatgcagaagaaggagagcaagattgttgacaagctatcgtttaaagaacaaatggcatccgttttgttcaaacttggccgctttgatgaatctgagagcatttacagatcactgcttttcatgaaccctgataactacaaatacttcatagctgtgcaaaagtgccttggcctatactctgataatggccaatattctgctggtgatgttgagcgcttaagcgcattatacaactcacttaaagaaaagtattcttggtcatctgctgttaagcgcatccctcttgatttcctggaaggtgagaagttccaggaggcagcagacagttatgtcagacctctattaactaagggtgtgccttcactgttttctgatttaagcccactgtacgagcatcctggcaaggcaaacatactggagcagttatttcttaaaatagaagattccattaggacttctggatgctttccaggaagcccacagaaggagcctccttccacactattgtggactttgtttttgatttcccagcactatgacagaagaggccagtatgagattgctttaaataaaattgatgcggctatatcacatacaccaactgtcatcgatttatattcagtcaagggaaagatattgcagcatgctggcaattttgctgcagcagctgcattagcagatgaagctaggtccatggatcttgctgatcgctatttaaacagcgagtgtgttatgcagatgcttcaggctgatcaggttgggctggcggagaagactgccgtcttgtttacaaaagatggtgatcaacacaataatcttcatgacatgcagtgcatgtggtatgagcttgcttctggtgagagttatttccgtcaaggtgatctcggcagggccctaaaaaatttcttagctgttgaaaagcattatgctgatatgactgaagatcaatttgacttccattcgtattgcttacgg

SEQ ID NO: 41409 - protein, 535 aa, Panicum virgatum
  misc_feature: Ceres CLONE 2007633
  misc_feature (77)..(110): Pfam Name: TPR_2 Pfam Description: Tetratricopeptide repeat
MGSSLPPKEANLFKVIVKSYETKQYKKGLKAADSILKKFPEHGETLSMKGLTLNCMDRKSEAYELVRRGLKNDLKSHVCWHVYGLLYRSDREYREAIKCYRNALRIDPDNIEILRDLSLLQAQMRDLSGFVETRQQLLSLKPNHRMNWIGFAVAHHLNSNSSKAIEVLEAYEGTLEDDYPPDNERYEHNEMLLYKISLFEECGMLDRALEEMQKKESKIVDKLSFKEQMASVLFKLGRFDESESIYRSLLFMNPDNYKYFIAVQKCLGLYSDNGQYSAGDVERLSALYNSLKEKYSWSSAVKRIPLDFLEGEKFQEAADSYVRPLLTKGVPSLFSDLSPLYEHPGKANILEQLFLKIEDSIRTSGCFPGSPQKEPPSTLLWTLFLISQHYDRRGQYEIALNKIDAAISHTPTVIDLYSVKGKILQHAGNFAAAAALADEARSMDLADRYLNSECVMQMLQADQVGLAEKTAVLFTKDGDQHNNLHDMQCMWYELASGESYFRQGDLGRALKNFLAVEKHYADMTEDQFDFHSYCL

SEQ ID NO: 41410 - DNA, 1294 bp, Panicum virgatum
  misc_feature: Ceres CLONE 2007639
  misc_feature: Encodes the peptide sequence at SEQ ID NO. 41411
aaaatcgccgcagcacaaacgcaaaccaaaccccgaaaccccaccgaggcggagggcggcgaacgcgagcgcgagcgcgagcgcgaaaccccacctctcggcggcggtctcggagacgacaagggcgggcacgacggcggcgccggcgacgacgctgatggagtccctggaggccctagtggcgcacatccaggggctctcgggcagccccgacgaggtggcgcacctccacaacctcctcaagcaggcggacggcgactccctgcgcgcccacgccgccgcgctcgttcccttcctcgggcacctcagccccggggcccactccctcggctatctctacctcctggaggcgtgcgcgacttcgggtgccaatctgagggaattcggcggcggggacttcctcgtcaccatggcggatttcctcaccgcgtgctcggcggaccagatacgcctggcgcccgacaaattcctgaatgtgtgtagggtgctcaaggatcaggtcatgcagctcaacgcccccatcagagggatcgccccactccgtgcggcagtccgtaagatccaggcttcacccgagcagctgaccccggtccatgccgactaccttctcctctgcctgctggcgaagcagtacaaggctggattgagcgtcctggaagacgacatatttgaagtcgaccagccaaaggacttgttcctctactgctactatggagggatgatatacatcgggctcaagaagtttcctaaagctttggagcttcttcacaatgctgttactgctccaatgccatcattgaatgcgattgctgtggaagcttacaagaagtacatccttgtgtcgctcattcagaatggacaggtcccatcatttccgaagtatacatctgcagctgctcaaagaaatctgaaaaatcatgcccagatttatgttgatctttgtacaagctatggcaatggtcgctacagtgacttggagacattcgttgaatcaaatgcagctgcgtttcaatcagacaacaacctagggctggtgaagcaagtgctctcctcaatgtacaaacgaaacatccaaaggctgacccaaacttacttaacgctgtcacttgaagatattgctagatctgttcaacttgaaacaccaagggattctgaaatgcatgtacttcgcatgattgaagatggagagatccatgcaaccataaaccagaaggatggcatggtcagctttcacgaagatcctgaacaatataaaagtgttgagatggtggagcatatcgactcttctattcag

SEQ ID NO: 41411 - protein, 378 aa, Panicum virgatum
  misc_feature: Ceres CLONE 2007639
  misc_feature (256)..(360): Pfam Name: PCI Pfam Description: PCI domain
  misc_feature: Functional homolog of the protein sequence given in SEQ ID NO 50753
  misc_feature: Useful for making plants with modulated light quality sensitivity
  misc_feature: Useful for making plants with modulated low light sensitivity
MESLEALVAHIQGLSGSPDEVAHLHNLLKQADGDSLRAHAAALVPFLGHLSPGAHSLGYLYLLEACATSGANLREFGGGDFLVTMADFLTACSADQIRLAPDKFLNVCRVLKDQVMQLNAPIRGIAPLRAAVRKIQASPEQLTPVHADYLLLCLLAKQYKAGLSVLEDDIFEVDQPKDLFLYCYYGGMIYIGLKKFPKALELLHNAVTAPMPSLNAIAVEAYKKYILVSLIQNGQVPSFPKYTSAAAQRNLKNHAQIYVDLCTSYGNGRYSDLETFVESNAAAFQSDNNLGLVKQVLSSMYKRNIQRLTQTYLTLSLEDIARSVQLETPRDSEMHVLRMIEDGEIHATINQKDGMVSFHEDPEQYKSVEMVEHIDSSI

SEQ ID NO: 41412 - DNA, 1332 bp, Panicum virgatum
  misc_feature: Ceres CLONE 2007641
  misc_feature: Encodes the peptide sequence at SEQ ID NO. 41413
aaacgtgaacgaaaaagaagctgctcgcctgctctgcctccgcatcgtgtcaagccccgagtcccacctcgtcgtctcccacctcgtcctcgcccgctccgccgcgcccgtacgacggcgccatggccgagtaccgcctcggcgcccagctccacgggcacgccgacgacgttcgtggcatttgtgtatgtggtgatgctgggattgcaacatcatcaagagatgggactgtgaaattctggagacagaacccagaaaagaagagtgaatatattctctctaagacgcttgcaggacattcaagttttgtgggcccattggcttggatccctccttcggaccgcttttctgaaggaggaattgtttctggtggaatggatacatttgttttcctctgggatctgcataaaggagaagttgttgagagaatgaaagggcacaattcacaagtcactggacttgctgtagacactaacagtgacatcatctcttcttccatggattgtactgtaagacggtggagaaacggcaatgctgtagaggtttgggaagcgcacaaggttgcagtgcaaacagttctaaagctgcccacaggagaactctttactggctcaagtgattccaccattaagctgtggaaaggaaggacctgtatacagacattctccggacatgcagatactgttagatgtttagcagcaatgccaggtctaggaattctttctgcctcgcatgacagcactatcaagttatgggcgttgacaggtcagcccctgctggagatgattgggcattcttctcttgtatattctgtggatgcacattcttcaggtctgattgctagtggcagtgaggatcgctctttgaagatatggaaagatggagtttgtgttcaaagcattgaacacccgggctgcatatgggatgctaaattcttggaaaatggagatgttgtaactgcttgttctgatggtactgtgaggatatggacgaccgatactaacaggttctgcagtgatgaggaacttgcagcttatacagatcttatttctcaatacacgcttagcagaaagaccgttggtggactcaagttgacagatctaccaggggttgaggcactgcaagttccagggaattctaatggccagacattgattgttagagaaggggacaatggtgttgcttattcatggaattcagcagagttcaaatgggacaaaattggtgaagtagtggacggacctggggacgctgcacaaggccaggttcatgatggtgttcggtatgattttgttttttatgttgatattggagatggagaacctatacgaa

SEQ ID NO: 41413 - protein, 403 aa, Panicum virgatum
  misc_feature: Ceres CLONE 2007641
  misc_feature (215)..(252): Pfam Name: WD40 Pfam Description: WD domain, G-beta repeat
  misc_feature (175)..(212): Pfam Name: WD40 Pfam Description: WD domain, G-beta repeat
  misc_feature (4)..(41): Pfam Name: WD40 Pfam Description: WD domain, G-beta repeat
  misc_feature (97)..(134): Pfam Name: WD40 Pfam Description: WD domain, G-beta repeat
  misc_feature (50)..(93): Pfam Name: WD40 Pfam Description: WD domain, G-beta repeat
  misc_feature (334)..(403): Pfam Name: PFU Pfam Description: PFU (PLAA family ubiquitin binding)
  misc_feature: SWISSPROT Homolog: EC 2.7.11.7 [Myosin heavy-chain] kinase
MAEYRLGAQLHGHADDVRGICVCGDAGIATSSRDGTVKFWRQNPEKKSEYILSKTLAGHSSFVGPLAWIPPSDRFSEGGIVSGGMDTFVFLWDLHKGEVVERMKGHNSQVTGLAVDTNSDIISSSMDCTVRRWRNGNAVEVWEAHKVAVQTVLKLPTGELFTGSSDSTIKLWKGRTCIQTFSGHADTVRCLAAMPGLGILSASHDSTIKLWALTGQPLLEMIGHSSLVYSVDAHSSGLIASGSEDRSLKIWKDGVCVQSIEHPGCIWDAKFLENGDVVTACSDGTVRIWTTDTNRFCSDEELAAYTDLISQYTLSRKTVGGLKLTDLPGVEALQVPGNSNGQTLIVREGDNGVAYSWNSAEFKWDKIGEVVDGPGDAAQGQVHDGVRYDFVFYVDIGDGEPIR

SEQ ID NO: 41414 - DNA, 675 bp, Panicum virgatum
  misc_feature: Ceres CLONE 2007641-R
ttagcaagaatgcacacttggcgtatgccacacttttgctgaactatgctgtcttttcgattgaatcaaaggatgaacagagtcaggcgcaaattctttctgctgcccttgaaatcgcagaagatgaggctcaagattttgactccaaataccgggcactcgttgcaattggttcccttatgcaaaagggccttgtgaagtcccttgctctcgaccttgatgttaagagcgttgcaagcagcgcaaaggcttcaatggactcgaagattgctgaagtcggagctgacatcgaactgttaacacgatgagatgagaagagggctgaatgcagtttgggggaaattcctcctctcactggaggcgccgttgtgcgtgatttagccatggaactggggctcgcgtggcaagccaattcagatgcactcctggagctacattttcctcccgaagaccatggggttgtgattattgtttcaccttgtaaccataacgggactatatgagtgtggattttgggtggttacgcttagcttttgtaaattgtaatgaccttatagttgcctcgatcaaaagctttatgcaggaatgtttacgtggacggtgatagcccaatcggcatacttcaacagtttaattaactgttgaattttttttatcaaaacaagtacatagtcc

SEQ ID NO: 41415 - DNA, 675 bp, Panicum virgatum
  misc_feature: Ceres CLONE 2007646
  misc_feature: Encodes the peptide sequence at SEQ ID NO. 41416
gaccaccgcctcgccgcctcggacccgtcgccctccactgctcgaatccgactcaccgccgcctggctgccgggcccattcgccgacccgttgccggcgaaggcgcgccgcctcctcccgctgagagcgaagcgcgccacctcggaggaattgtagccgccgtcctcctcctgtagacggcgcggggcggagatcccgccggaggtggggctgaccccccccccccccccttctctcgattcaaggcgctggtagtttattggagaagctcctggggggagggacatggacatggcattgccagttgtgaatgccacagcggcggtgctcgctcgtgtctcggctgcgttcaatgccccttttgcccgtgccgtcgtcttcggggtacatattgatgggcacttggtcgtggaagggcttcttattgcagtcatagtgttccagctcaccaggaagagctacaaacccccaaagaagccactcactgaaaaggagattgatgagctatgtgatgaatgggagccagagctgctatgtcctccgatcaaggagggggccaggattgacactccaatgttggaaagtgctgccggaccgcatacaatcgttgatggtaaagaagttgtcaactttgcgtcggcaaactacctcggtttaattggcaatgagaagatt

SEQ ID NO: 41416 - protein, 129 aa, Panicum virgatum
  misc_feature: Ceres CLONE 2007646
  misc_feature: SWISSPROT Homolog: EC 2.3.1.50 Serine C-palmitoyltransferase
  misc_feature: Functional homolog of the protein sequence given in SEQ ID NO 50804
  misc_feature: Useful for making plants with modulated nitrogen use efficiency
MDMALPVVNATAAVLARVSAAFNAPFARAVVFGVHIDGHLVVEGLLIAVIVFQLTRKSYKPPKKPLTEKEIDELCDEWEPELLCPPIKEGARIDTPMLESAAGPHTIVDGKEVVNFASANYLGLIGNEK

SEQ ID NO: 41417 - DNA, 1342 bp, Panicum virgatum
  misc_feature: Ceres CLONE 2007658
  misc_feature: Encodes the peptide sequence at SEQ ID NO. 41418
atcctcctcatcaccacagataccagggattgtgtcagggctccagtcagcaacgacctcacccccgccgcaacaacatccaccaaatcgacgtctccgtcaggttaagatggcctcagaaaaggtcagagtgaatgctgccatgaacccccctatacttctcgttgactacattcacagagcaaggttaaatgggacggcagtggtgcgttccaagcaccctcgtctatgaagagcaatgggtccattgacatagttacattgcttgatgttagccacagcattagctggatggcatcatcgtcagaagagacgccatcaaagatggatttgctgaaaaatgccctgaagtttataataagtcagcttgatgacaatgaccgccttgccatcgtagcattcaacgatcaggtcatcaaagagcatactactggcattttagaaatttctggcggtggtcggatggctattgagaaaaaagtggatgggctcgtgactcagggcgacactgcctttaaaccaagcttggagcatgctgtgaagctcctggatgaccgtgctgataagacgcgtgcaggctgcatcgtcctcatttcggatggtgtagacaagagccaattcatgtggagccatgagagtcttgccctcactgaccccatccgaggcctcctccgaaagtacccagtccacaccttgggcttgttcaaggctgacccaaaggcactgcactacatcgccaaagaatcctatggaacctattcctcaatcacagacaacaaagacctcgacaagaacattatggaggcgctggctgtctgcctagccgggttaaagaccatcgtcgcctttgacacctgcgtcgacatcacgtcaagcagcttggagataacaagggtcgactccgggggctacacacgccgggctgctccaggatcaggcatctcaattggcatgctgtgtgctggggaggtgaaggacttggtcgtctacttcagttacactactgggtcttgggagcgtggctactataccactttgagtgggatcactgctagggtcacgtacaaggatatgctgggtgggaagtcatcaacctcaactaacaattgctccgtgtccgtcgcggttcacacgacccaggatccatcgcttcctgcaaacccatgccctccattccccttggtcctgcagcagatggtccggttcaaggtggtggacctgctcctaggcgtcctacaggaattgaaggccttgaagaaggatgctggtggtgccaaggagaaagatggtgttgatgacccagtgttgcagtccattgcagccaacatgctgcagaggaagt

SEQ ID NO: 41418 - protein, 371 aa, Panicum virgatum
  misc_feature: Ceres CLONE 2007658
  misc_feature (8)..(190): Pfam Name: VWA Pfam Description: von Willebrand factor type A domain
MKSNGSIDIVTLLDVSHSISWMASSSEETPSKMDLLKNALKFIISQLDDNDRLAIVAFNDQVIKEHTTGILEISGGGRMAIEKKVDGLVTQGDTAFKPSLEHAVKLLDDRADKTRAGCIVLISDGVDKSQFMWSHESLALTDPIRGLLRKYPVHTLGLFKADPKALHYIAKESYGTYSSITDNKDLDKNIMEALAVCLAGLKTIVAFDTCVDITSSSLEITRVDSGGYTRRAAPGSGISIGMLCAGEVKDLVVYFSYTTGSWERGYYTTLSGITARVTYKDMLGGKSSTSTNNCSVSVAVHTTQDPSLPANPCPPFPLVLQQMVRFKVVDLLLGVLQELKALKKDAGGAKEKDGVDDPVLQSIAANMLQRK

SEQ ID NO: 41419 - DNA, 786 bp, Panicum virgatum
  misc_feature: Ceres CLONE 2007658-R
gatgaatcctggaaagcagccaccccgaagtccttgcttgacctgggcagcattgacgtggacgtcaatgcaatggtgggcatcctcaggaagggcttgggtgttggatgcatttactcatggctgtcgagccatgagatgcagcgcgcaacggttacaggcttaccggcggaggccatgttccgcacgccagtgatggagatgatggtgcagaaggtccacaggaagttgctgctcaaggaagcatatgaacaaggagcggaagaccgagctgtctacgacggcgccattgggctcttggacggtatcaacaagcgattccaactgtggtgcaagctggacgccgaggtgccaccagctttccagctggcccatcagcatcaagacgacgagtcccgcaatctcactgacgtcctgcatggggggataagccgagcaaggcagcatgacatttacctggccgctattcatgcgatcaagcagtggcagagctcctccacccccggagagaagacgcatggccacgggccggaccagtaggcgcatgcatgcatgacgcaccgccaaaagcagaggaatcttgtgagtggccacagtacaaataaaaataagccaggccatagtagtgcctccggctccctcccgagaataatatgcatgcgggcagcacccgcccattagtacttactaattgttcttgttattagtccccatatatcagttcccaattaagttgtactatcgtcctttaataaagatgtcatcagcagaaagctgaagctaatg

SEQ ID NO: 41420 - DNA, 1970 bp, Panicum virgatum
  misc_feature: Ceres CLONE 2007662
  misc_feature: Encodes the peptide sequence at SEQ ID NO. 41421
  misc_feature (1392)..(1392): n is a, c, t, g, unknown, or other
gtcgagctcatcggctcctcgcaagcaccaccagatcacctggccagccgccgcgtcactccggcctccgctgtcaatggatgctgccatcgcgttcacttccgctcggaaccctagccccacgcgcttctcctcctcctcctcccccgcttcgccgtcctcgcacttcccccaacgcctctgcgtctgcagcccatggcgcgggcgcgagcgccggctccgcgcgctccgccctcaatcccagatccaggcccccggggccacgtccgccgacacctccaaccacgatgtggtggtcgtgggggccggaatcgtcggactcacgatcgcgcgccacctcctcctccacactccgctctccgtcgccgtcgctgacgccgccgtcccctgctccggcgccactggcgcagggcagggatacatatggatgtcgcaccggatgcccggcagtgacatgtgggagctagcggcgcggagcaagcagctgtgggaggagctcgcggccgaggttgacggccagggcggcggcggtgcgcgggagaagctgggctggatgaggacaggaagcttgctagttggcagaacttcggaagaactggccacattggaggaaaggaccaaggttctgtccgaggcaggcatacatgcggaattcttgtctgcctcttcactacatgcattagaaccagcactcagtgttgagaaagatggtggtgctatgttcttgcctcaagactgccagattgatgcgttccaggctgtctctttgatcgaaaagaccaataactcatattcctcagaaggaaggtatatggagatctataatgatcctgccatgtcattaataagatcggaggttactggaacagttgaagctgtccaaacttccagaaacatattgtatggcagaaaagctattgtaattgcttctggtgcctggactcgatccttattacatagttttctcgaaccagctttgacattggatattcctgtcaagccccgaaagggccatcttcttgtggtggagaattttgacaaggttaagctaaatcatgccctaatggaggtaggatatgttgaccatcaggttgctaagtcaaatcacacacacatggcttcagagtctagtgaagatgagcatggtgctttatctatatcaatgactgcaaccgtagatgcaaagggaaatttggttctaggaagcagtcgggagttcaaagggttttcaagggaggttgataaatcagttgttaagtgtatatgggaacgtgcaggagagttctttcctgcaatgaagaatgttcctcttgatattgatcacaatacacagatcagaatcgggcatcgcccatacatgcctgatggaaagccagttattggctttattcntgatctgccaaatgttttgattgcaacaggacatgaaggaaatgggcttactatggcactcggcactgctgaaatggtcactgatatgattcttgggaatcctggaaaagtggactgctcacctttctccatcaaacacagattttcaggttgaccgtttatccggaagccctccttcagctcctcaagtgacaaattaccgtcattgtccttgtccatcgtattgaacatctgagtgtatttgtcaatcttttccactggtagattcatggcgacaacctccattcataattagaaatcgcttcacatttagtgtgtcgcacttgaaggaaataagggtacaaacagctagttatctgcaacttactccaagtgccttcttcttgaacttgttcatggacgagaactgcttcagactggaccgaacaacctccccgagtgacacatttgaagccttatcagcatttttgagccaaggatgctctgtgtttttaggagggaaacttgagtcacagttcagtatgcagcattgttgggccgcgctttccaataatgccaataataaaccagaagttacc

SEQ ID NO: 41421 - protein, 489 aa, Panicum virgatum
  misc_feature: Ceres CLONE 2007662
  misc_feature (71)..(468): Pfam Name: DAO Pfam Description: FAD dependent oxidoreductase
  misc_feature (351)..(487): SWISSPROT Homolog: EC 1.4.99.1 D-amino-acid dehydrogenase
  misc_feature (58)..(288): SWISSPROT Homolog: EC 1.5.99.1 Sarcosine dehydrogenase
  misc_feature (439)..(439): Xaa is any aa, unknown, or other
MDAAIAFTSARNPSPTRFSSSSSPASPSSHFPQRLCVCSPWRGRERRLRALRPQSQIQAPGATSADTSNHDVVVVGAGIVGLTIARHLLLHTPLSVAVADAAVPCSGATGAGQGYIWMSHRMPGSDMWELAARSKQLWEELAAEVDGQGGGGAREKLGWMRTGSLLVGRTSEELATLEERTKVLSEAGIHAEFLSASSLHALEPALSVEKDGGAMFLPQDCQIDAFQAVSLIEKTNNSYSSEGRYMEIYNDPAMSLIRSEVTGTVEAVQTSRNILYGRKAIVIASGAWTRSLLHSFLEPALTLDIPVKPRKGHLLVVENFDKVKLNHALMEVGYVDHQVAKSNHTHMASESSEDEHGALSISMTATVDAKGNLVLGSSREFKGFSREVDKSVVKCIWERAGEFFPAMKNVPLDIDHNTQIRIGHRPYMPDGKPVIGFIXDLPNVLIATGHEGNGLTMALGTAEMVTDMILGNPGKVDCSPFSIKHRFSG

SEQ ID NO: 41422 - DNA, 718 bp, Panicum virgatum
  misc_feature: Ceres CLONE 2007666
  misc_feature: Encodes the peptide sequence at SEQ ID NO. 41423
gagcgagccactgtcacaaggctgcataattgtgcccgcccgccggcccccgggggcgtgacacatcgcgcgcacgaagctcgcctgcctgccgcttttggctccgcccgccgtgccgcccgtgaggccggcagctttgcatgaggaggcggaggatgggggcactgcacgtcgtcggtgagcctagggtcagcttccagcaccaccagcagcccgccgtcgccgccgccggcaagagcgtcggccacggccccgtcgtcgaggagatccacggcctcatacgcgtctacaaggacggccacgtcgaacggcccccggcgatccccgacgtgccctgcacgtggggcgccacggcgcccggcgcgccgggcggcgtcgcggcgagggacgtggtggtcgaccgcgccacgggggtgtgggcgcggctctacgcgccggtggctggaggcgggctccccgtcgtggtgtacttccacggcggcgggttctgcgtcggctccgcggcctggagctgctaccacgagttcctcgcgcagctcgccgcgcgggcgggctgcgccgtcatgtccgtggactaccgcctcgcgcccgagcaccgcctgcccgccgcgttcgacgacgggctcgcggcggtgcgctggctgcggcaccaggcgtccctggccaccggccgcggcgcgtcccccgacgaggtctcctggtggcgggcccgctgccg

SEQ ID NO: 41423 - protein, 187 aa, Panicum virgatum
  misc_feature: Ceres CLONE 2007666
  misc_feature (103)..(187): Pfam Name: Abhydrolase_3 Pfam Description: alpha/beta hydrolase fold
  misc_feature: SWISSPROT Homolog: EC 3.1.1.3 Triacylglycerol lipase
MGALHVVGEPRVSFQHHQQPAVAAAGKSVGHGPVVEEIHGLIRVYKDGHVERPPAIPDVPCTWGATAPGAPGGVAARDVVVDRATGVWARLYAPVAGGGLPVVVYFHGGGFCVGSAAWSCYHEFLAQLAARAGCAVMSVDYRLAPEHRLPAAFDDGLAAVRWLRHQASLATGRGASPDEVSWWRARC

SEQ ID NO: 41424 - DNA, 1331 bp, Panicum virgatum
  misc_feature: Ceres CLONE 2007668
  misc_feature: Encodes the peptide sequence at SEQ ID NO. 41425
gtggaagctttcgcctcttcctcttcctcgccctccgtcgtcttccttcccagtaggcccctctctccagtcgccaaagcttaacacacccgcgcacgccgccccatcgcccccaccccccgcctcgccgcccttccatctctctctctctctctcgcgccgtctcgccgccctcgccccccgccgcgatccagggagccagcgagcggccggccatggccgcgggggcgatccgggtcaccatggaggtgggcgccgacggcgtcgcgctcatcaccatcgccaacccgcccgtcaacgcgctccaccccatcatcatcgccgggctcaaggacaagtacgcggaggccgcgcgccgcgacgacgtcaaggccatcgtgctcaccggtgctggaggcaagttctgcggaggatttgatatcaatgttttcacgaaggttcatcagactggggatgtgtcgcttatgccagatgtatctgttgagcttgtgtcaaacatgatggaagagggcaaaaaaccttctgttgcagctattcaaggccttgctctgggtggtggcctagaattggctatgggttgtcatgctcggatatctacccctgaagctcagcttggattaccagagctgacgctgggcatcatccctggatttggaggaacccagcgtctgccaaggcttgtaggtctgcccaaagcaattgaaatgatgctgcaaagtaggttcattactgcaaaggaagggaaggaacgtggtctgattgatgcgctctgcactcctgatgaattgataaagatgtcacgtctctgggctctggagattgctaattgccaaaagccttggataagatctcttggcagaactgataagcttggatcattgtctgaagctcgtgctgtattaagtgcagcaagacagcaagcgaagaaggttgcaccaaacatgccacagcaccaggcctgccttgatgtaattgaagaaggcgtatcatatggaggccatgccggtgttttgaaggaagccaaggtgttcaaggagttggttgtagcaccaacatcaagggctcttgtccatgttttctttgctcaacgttccaccacaaaggtgccaggtgtaacagatggtcaactgaaacccaggcaaattagaaaagtcgctgttattggtggtggtctgatgggctctggaatagcaacagcacttcttgttagcaacatttctgttgtactcaaggaagtaaaccctcagtttctgcaaaggggagagaaaatgatagcaggtaatcttgagggcctggtgaaaagaggctcattaacaaaggataagatgaac

SEQ ID NO: 41425 - protein, 371 aa, Panicum virgatum
  misc_feature: Ceres CLONE 2007668
  misc_feature (18)..(187): Pfam Name: ECH Pfam Description: Enoyl-CoA hydratase/isomerase family
  misc_feature (17)..(204): SWISSPROT Homolog: EC 4.2.1.55 3-hydroxybutyryl-CoA dehydratase
  misc_feature (310)..(366): SWISSPROT Homolog: EC 1.1.1.157 3-hydroxybutyryl-CoA dehydrogenase
MAAGAIRVTMEVGADGVALITIANPPVNALHPIIIAGLKDKYAEAARRDDVKAIVLTGAGGKFCGGFDINVFTKVHQTGDVSLMPDVSVELVSNMMEEGKKPSVAAIQGLALGGGLELAMGCHARISTPEAQLGLPELTLGIIPGFGGTQRLPRLVGLPKAIEMMLQSRFITAKEGKERGLIDALCTPDELIKMSRLWALEIANCQKPWIRSLGRTDKLGSLSEARAVLSAARQQAKKVAPNMPQHQACLDVIEEGVSYGGHAGVLKEAKVFKELVVAPTSRALVHVFFAQRSTTKVPGVTDGQLKPRQIRKVAVIGGGLMGSGIATALLVSNISVVLKEVNPQFLQRGEKMIAGNLEGLVKRGSLTKDKM

SEQ ID NO: 41426 - DNA, 665 bp, Panicum virgatum
  misc_feature: Ceres CLONE 2007668-R
agaaaaggtgcaaagacaatgcccggtagaaagcctgttactttaacggatcaagatattttggagatgattttcttcccagttgtgaatgaggcgtgcagggttatggatgaaaatgttgtaattcgggcttctgatcttgatattgcttctgttctcgggatgggctttcccaagtacaggggtggtcttgtcttctgggctgacactgttggggcaccttacatatattcaaagctaagcaagtgggctgaactttacggtccctacttcaaaccgtcatcgtacttggaacaaagagctaagagtggtgtaccactgagcgcaccaagcgcatcaccgcaaggttcggcgaggtcgcgcatgtgaggtgctgctcagctgttggtagaagaattaatgagcaccgtctgccctgttcatcagtccacctctgctaacacgagaggcggccagaaaaggatggcagaataaatggttttgcatagccgtttatatggtacaaattttgctgccttggactggaactatgacagggtttctttggacacagtggcaaatccagtgtggcaagcattcttgtatctgcccaatgtatgtattacatattgtatgtcacgatcattcgtaccaagctcaataataaagaaggaaatgtgcagccg

SEQ ID NO: 41427 - DNA, 1844 bp, Panicum virgatum
  misc_feature: Ceres CLONE 2007674
  misc_feature: Encodes the peptide sequence at SEQ ID NO. 41428
aaccagttcctaagtcacctttttcatgcgttccatcgtgatcgtggttgtggctctctgcttgagccttcaagtgagcgaggctcacaagctcgccccaaatacgttcgataatttgactatcgaaactgaatatggtccagtcaccggatttttggaaacggtaagcacgtttcaagcccgcgcgttctacggtatcccgtatgcggctccacccgttggaaatctccgctggactgacccgcaaccacctgctcaatggaacacaccgctcatggccaatcactttggtcccggatgccctcagttctgcaatttgcccaactacacctgccccaccagcttcgatgaggattgcctgtacctcaacgtctgggctcctgtcactatttcagagccggcgcctgtgatgttttggatccacggtggtcactacgagcaaggctcaggcgcgggtccgctctacgagggcgtagtgctcgccagcaagggcgctgtcattgtcaccatcaactatcgtctcgcggctcttggcttcttgtggtttgattcggctcctggtaacttcggtatcaaggatcaactgtttgctctgcagtgggtgcaaaagaacattgctgccttcggcggtgatcccaatcgcgtgacgttgttcggtcagtcagcaggaggcacgtcagtcagcgtgttattaacggctccatcggtggtgaacgcagtgccgccactgtatcactccgccatcgtgcactcgaaccccatcggcctgcccatgatgaccccagaggcgggcaaagaactcaccctccgcctccaagctctcgttaattgcagctcaaccgagacggatatcgcttgtatgcgcaatgttggcatgctgccgctcatcgtggcgcaggctgaagccgccgctcatgtcgacatcaagcacattctcgatgtcttttatccttgggctcctgcattgggtgatttcttgcccgatgagccgttgactttgttccaaaatggcaaaggtgctgttgttcccaccgtctggggcactgtggaagaggagggtcgtatcttcgtgtatgaagccgtcagctctgcgctgaatacgctggaatacgatgcctttatcgcagtctcctttggcattacccatcttggcactattgcatctgcttatccgtcccagtccggtgataatcgtgatatcgcgtgcgccatgatcacagatcgtcttttcacttgccctcagcgtgctgccatgcgaggacaagccaagttgaacaccaccttccaatatcgcttcaatcacagtttcgacaacagcggtatctggcagatgctctccatgtgtgagggtcacgtgtgccacgctatcgagctgccttatgtgttcaatgacctccacgccaacgtcatcccagtttcacctcgcgaggttgacttggcggatcgtatttctactgcttgggcgaactttgccatcactagcaaccctcaggttgccaactgggcgcccttcgatgccaacaacgataacacctacgtatgggatgttgacaatcaaagcggagccattactggtttgcgtggctccttctgtgatatgtgggacaaggtgggctatcaattctaagccaagagatgccacatggtggatgaaaaagaagtgtttttacggtttcgcaagcaaaaatcccatttttcgtttgtgtgttttgaaattacgctttcctttctttgtttgtcgttttgtctcgtcactttctgtctgcaatcccttcatccgacttttgtgttgttgatgtgagcttgcattatgtaagaattttcatacacaacgtgtgatacac

SEQ ID NO: 41428 - protein, 533 aa, Panicum virgatum
  misc_feature: Ceres CLONE 2007674
  misc_feature (1)..(526): Pfam Name: COesterase Pfam Description: Carboxylesterase
  misc_feature: SWISSPROT Homolog: EC 3.1.1.8 Cholinesterase
MRSIVIVVVALCLSLQVSEAHKLAPNTFDNLTIETEYGPVTGFLETVSTFQARAFYGIPYAAPPVGNLRWTDPQPPAQWNTPLMANHFGPGCPQFCNLPNYTCPTSFDEDCLYLNVWAPVTISEPAPVMFWIHGGHYEQGSGAGPLYEGVVLASKGAVIVTINYRLAALGFLWFDSAPGNFGIKDQLFALQWVQKNIAAFGGDPNRVTLFGQSAGGTSVSVLLTAPSVVNAVPPLYHSAIVHSNPIGLPMMTPEAGKELTLRLQALVNCSSTETDIACMRNVGMLPLIVAQAEAAAHVDIKHILDVFYPWAPALGDFLPDEPLTLFQNGKGAVVPTVWGTVEEEGRIFVYEAVSSALNTLEYDAFIAVSFGITHLGTIASAYPSQSGDNRDIACAMITDRLFTCPQRAAMRGQAKLNTTFQYRFNHSFDNSGIWQMLSMCEGHVCHAIELPYVFNDLHANVIPVSPREVDLADRISTAWANFAITSNPQVANWAPFDANNDNTYVWDVDNQSGAITGLRGSFCDMWDKVGYQF

SEQ ID NO: 41429 - DNA, 1388 bp, Panicum virgatum
  misc_feature: Ceres CLONE 2007692
  misc_feature: Encodes the peptide sequence at SEQ ID NO. 41430
  misc_feature (1291)..(1291): n is a, c, t, g, unknown, or other
tagcggagctgatcgacacattctattcctcagtgtctcattccagtgagaaggggaaagcagaatggcgctctccctctcgaatttccttgtcgcaagcgtgctgctcttgacgtccttcgtcgccgcagaaacgcgtacttacgacttttccatcggctgggtgattcgaaatcctgatggacagaaagaccgaccagtgattggcatcaacggcgaatggccaattccaatgatcgaggtggacattggcgaccgactcgtggtaaatgtgaagaacgacctgggaaatcagtcgacttcgcttcactggcatggcttatttcagaatggcacaaaccacatggatggagtcgcacatgttacccagtgcgagattgctcctggagcttctttcacttataacttcacggttaaccaaccgggcacatattggtaccactctcacgtcggcggacagtatccggatggacttcgaggtccactcattgttcatgatcctaagaatccatatgccgaccttatcgatgaagaattggttttgtccttgtcagactggtaccacgagcagatgccacctctaatcgccaaattccttagcgtcaccaacccaaccggcgcagagccagtacctcaatctgccttgatgaatgagacccaaggtctacaaattcccgtcaagcctggcaagacctatttcatccgtattgtaaatatggctgctttcgcagcacagtacttctggatcgaaggacatactttccgtatcatcgaggtagatggtgtctatcacgagcctgcagaggctagcctgatctacctcacagctgcacagcgctatggtatccttctgaccactaagaatgagaccgatgccaactttgctattatgggctctatggaccaagatctattcgatgtgatcccagatggccttaatccaaatgtcacatccttcttggtctacgatgactcattgccgatgccagaaccatctgagattgaagagtttgagccattcgacgacatggaactcgttcctacggatggcgaggagatattccctgacccagctcttgtcgtccagctagatgtcgtgatggacaacttaggcgatggcgccaactacgctttcttcagtggcatcacttatgtcgctcccaaagttccttcactatacactgcacttacagcaggagaattcgctacaaatgcaagtgtctacggaacaaataccaactcttttgtccttgaacacaacagtgtcgttgagattgtcttgaaacatcangatcccggtaaacatccgttccatttgcatggccacgctttccagacaattcttcgtggcgagggagagtcaggcgacttcgatccggaatccgtcg

SEQ ID NO: 41430 - protein, 441 aa, Panicum virgatum
  misc_feature: Ceres CLONE 2007692
  misc_feature (30)..(148): Pfam Name: Cu-oxidase_3 Pfam Description: Multicopper oxidase
  misc_feature (156)..(304): Pfam Name: Cu-oxidase Pfam Description: Multicopper oxidase
  misc_feature (363)..(438): Pfam Name: Cu-oxidase_2 Pfam Description: Multicopper oxidase
  misc_feature: SWISSPROT Homolog: EC 1.10.3.2 Laccase
  misc_feature (409)..(409): Xaa is any aa, unknown, or other
MALSLSNFLVASVLLLTSFVAAETRTYDFSIGWVIRNPDGQKDRPVIGINGEWPIPMIEVDIGDRLVVNVKNDLGNQSTSLHWHGLFQNGTNHMDGVAHVTQCEIAPGASFTYNFTVNQPGTYWYHSHVGGQYPDGLRGPLIVHDPKNPYADLIDEELVLSLSDWYHEQMPPLIAKFLSVTNPTGAEPVPQSALMNETQGLQIPVKPGKTYFIRIVNMAAFAAQYFWIEGHTFRIIEVDGVYHEPAEASLIYLTAAQRYGILLTTKNETDANFAIMGSMDQDLFDVIPDGLNPNVTSFLVYDDSLPMPEPSEIEEFEPFDDMELVPTDGEEIFPDPALVVQLDVVMDNLGDGANYAFFSGITYVAPKVPSLYTALTAGEFATNASVYGTNTNSFVLEHNSVVEIVLKHXDPGKHPFHLHGHAFQTILRGEGESGDFDPESV

SEQ ID NO: 41431 - DNA, 652 bp, Panicum virgatum
  misc_feature: Ceres CLONE 2007692-R
tccattgccacattgagtggcatgttgattctggattgattatgacatttgtcgaggctccccttgttctacaagaaaccctcaccatccccgaagaccacttcgcggcctgcgcagcggtatcaccaccggtacccacggtcggcaacgcagccgctaacacgaaggactatctggacctgacgggccagaacctcccgccgggaccactgcccgacggattccaggccaagggcatcgtggcgctgaccttcagcattatcgctggcttgctcggtgtcgccgtcatcgcctggtacggcctcggcgagatgagccagatcgagaaggacaagcaggttgcccgcgtccaacgtaccgctgccgagaggggtgttcttagcagagccaataccgacgtcgcaggtgcgggtactgctggtactgctggtactgccggtgagaatgcgcctgcgggcgatacaataaccacggtcgctaaatgagacgcaaacgcatttagaccccgacactttcttgtaaagttgggtgaaatgagagaatttcactctgttcttagaagagcagaatgaaagaaagacaaaagagtcggggcccgtgatgagggggaaatgctacggcgtgacatgcatgcaatacactgatcttacct

SEQ ID NO: 41432 - DNA, 677 bp, Panicum virgatum
  misc_feature: Ceres CLONE 2007695
  misc_feature: Encodes the peptide sequence at SEQ ID NO. 41433
gccccaccaacacttcccactcgtccccccatcttcccactcgtccacagccaaatccgcctcctcccccccccatccagcgacggccacccaccaccgttccagtgagttcgagcgaggtaagctttagatctgagcgagttctcgcgcgtcgcaggtaaagttcgcactcccgacccctcctcctcttcctccccgcttccttttgtttgttctcttggttcttggtttcgtctccatcgagcagacagcgagggacccggggccttttcgatcccgggcttcagatctgctgtttcttcttcggtttggttttgagtagcaagtctgggttgctagtagttcggtagccaagaggggttctttttccacacctcccttgtgccagttcgtgtgcagatctaccaccagaggccacctgtttttactgcggctgctgggttctgcctgatctgttcttggtttgcttgctagagagaaaaaaaacaaaaaaaagagtttgtttttgtttcttcagatctgctacagtagtctagatggctgccgctatagatctgtccggggaggagctgatgagagcactcgagccttttatccgggatgcctcagctcctcacgagtccagtccgctttctcagcacccccacccgctgagccccacttcgccccttctcttt

SEQ ID NO: 41433 - protein, 46 aa, Panicum virgatum
  misc_feature: Ceres CLONE 2007695
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
MAAAIDLSGEELMRALEPFIRDASAPHESSPLSQHPHPLSPTSPLL

SEQ ID NO: 41434 - DNA, 747 bp, Panicum virgatum
  misc_feature: Ceres CLONE 2007702
  misc_feature: Encodes the peptide sequence at SEQ ID NO. 41435
agcaccgtcgtgcacgttgccgctggcttgtcccgggcgggccgcagctaccagaagcatcctcgaaggcgaaggcgaaggccaaggccaaggccaagctcctctccggcctcctccaccactctccacacccagaatccgaatccgccactcagtttgcattgacttcctccgctcttcctgccgcccgtcgtctgtcccgtcctcgccgctgctcagctcacgagcaccgccgcagccaatcccagccgcgtcgtttcttaaatcgccagatcatttattataatgtggggtgagagaactcatcacaagcactggcatcaagggcatggtccacctggaagttccaaggacaaaaaacatgacaaacggcagcccaaatttataccagacaattatagctcggtggatgaggtcaccactgcactgagagaagctggtctcgaatcatcaaatctaattcttggtattgacttcaccaaaagcaatgaatggtcaggtaggcattcctttggaagaaaatctctgcatgccattaatggcaacccaaatccatatgagcaagctatctctataatcgggcgaacactgtcaccttttgatgatgataacttaataccatgttttggatttggtgatggttctacgcatgatcactccgtcttcagcttctaccaggatagtcgtccctgtcgtggcttcgaggaggttctttgtaggtatcgacaaattgttccacattttgat

SEQ ID NO: 41435 - protein, 153 aa, Panicum virgatum
  misc_feature: Ceres CLONE 2007702
  misc_feature (80)..(152): Pfam Name: Copine Pfam Description: Copine
MWGERTHHKHWHQGHGPPGSSKDKKHDKRQPKFIPDNYSSVDEVTTALREAGLESSNLILGIDFTKSNEWSGRHSFGRKSLHAINGNPNPYEQAISIIGRTLSPFDDDNLIPCFGFGDGSTHDHSVFSFYQDSRPCRGFEEVLCRYRQIVPHF

SEQ ID NO: 41436 - DNA, 1224 bp, Panicum virgatum
  misc_feature: Ceres CLONE 2007730
  misc_feature: Encodes the peptide sequence at SEQ ID NO. 41437
atcactaaccatcggctccgcattctgccaagtcctccgctccgtcacgagtgaggtgccgagaggacatggccactcgggcgcccacggccagcgcctgcatcgctgctcccggcggcgaggacggccgcagcggctactgtgaggcgaccaggacgttccgcagcctgcggccgccggtgccactgccaccgaaggacgccccactctcgttcacggcgttcgcgttctccctcctgccgccgtccccgtcccccgagcacccggccttcctcgacgccgccaccggcgaggccgtgtcgttcccggcgttccggagccaggtgcgcgcgctagcgggggccctgcgctcgcggctcgggctccgccgcggcgacgtcgcgttcgtgctcgcgccggcgcggctggatgtcccggtgctctacttcgcgctgctctcgttcggcgccgtcgtgtcgccggcaaacccagcgctcaccgcctccgaggtcgcccgcctcgtcccgctgtccgaggcgtccgtcgccttcgccgtgtcgtcgaccgccgccaaggtgccggctgacctccccaccgtcctcctcgattccgatcaattccgttccttcctgcgcctggaaggtggggaggggctggcgccggaaacgatggcggtgcgccaatcggacacggccgcgatccagtactcgtcaggcacgacagggcgggtgaaggcggcggcgctgtcgcaccggaacttcatcgccatggcggcggggtcccacgccctgtccccaaagccgaggcatggttgcgacaggatgctcctgagcgcgcccatgttccactccctggggttctacttcgcgctgaaggccgtggcgctggggcagacgacggtgctggtgaccgacgcggtggcgcggcgcggcgtgaaaggggtggtggaggcggcggagaggtgggcggtcaccgagatgacagcgtcgccgccggtggtgatggccatggcgaaggagccgtgcgtcctgcaggccctggagcgggtggtgtgcggcggcgcgccgctgccgacatcggcagcggagaggttccggcgaaggttccccaacgtggatctctgcatggtacaataagccacctctggtcaagatgagagcaaagtatatagctatcgcggttggcatgggctacctactcgtgcctcattcgctgcaagttgatttcacgtgtccttttcaagca

SEQ ID NO: 41437 - protein, 348 aa, Panicum virgatum
  misc_feature: Ceres CLONE 2007730
  misc_feature (78)..(347): Pfam Name: AMP-binding Pfam Description: AMP-binding enzyme
  misc_feature: SWISSPROT Homolog: EC 6.2.1.12 4-coumarate--CoA ligase
MATRAPTASACIAAPGGEDGRSGYCEATRTFRSLRPPVPLPPKDAPLSFTAFAFSLLPPSPSPEHPAFLDAATGEAVSFPAFRSQVRALAGALRSRLGLRRGDVAFVLAPARLDVPVLYFALLSFGAVVSPANPALTASEVARLVPLSEASVAFAVSSTAAKVPADLPTVLLDSDQFRSFLRLEGGEGLAPETMAVRQSDTAAIQYSSGTTGRVKAAALSHRNFIAMAAGSHALSPKPRHGCDRMLLSAPMFHSLGFYFALKAVALGQTTVLVTDAVARRGVKGVVEAAERWAVTEMTASPPVVMAMAKEPCVLQALERVVCGGAPLPTSAAERFRRRFPNVDLCMVQ

SEQ ID NO: 41438 - DNA, 625 bp, Panicum virgatum
  misc_feature: Ceres CLONE 2007730-R
  misc_feature: Encodes the peptide sequence at SEQ ID NO. 41439
gaagatcgtggaccccgtaaccggcaagcccctgtctgtgggtaagaaaggggaactattggtgaaagggcctgccgtcatgacaggatacgttggagacgatgaggcgaacgccagcacattcgactctgaaggctggcttaagacaggggacctttgcttcatcgatcaggacgggttcctgttcgtggtggataggctgaaggagcttatcaagtacaagggctatcaggttcctcctgcggagctggagctcgtcctgcaaacgttgccagaagtcatcgatgcagcagtcatgccgtatccgcacgaggaggcagggcagataccggtagcgcttgtcgtgaagcaaccaggaagcaaggtcaccgaggctcagatcatggaccatgttgcgaagcgggtagccccgtataagaagatccgcaaggtcctgtttgtcgactccataccaaaatctccagctggaaagatactgagaaggcagttggcgaaccatgtacagtttaccgctgtttctaggctgtgaattttttttttttacctgtgtgcgtacgtgtgcatgcatggacgggggacaaagatgcggtacagcattgcgtgtaaaaataaattagtgcgattg

SEQ ID NO: 41439 - protein, 175 aa, Panicum virgatum
  misc_feature: Ceres CLONE 2007730-R
  misc_feature: SWISSPROT Homolog: EC 6.2.1.12 4-coumarate--CoA ligase
  misc_feature: Functional homolog of the protein sequence given in SEQ ID NO 51631
  misc_feature: Useful for making plants with altered cell wall content and/or composition
  misc_feature: Functional homolog of the protein sequence given in SEQ ID NO 50966
  misc_feature: Useful for making plants with altered carbohydrate content
  misc_feature: Functional homolog of the protein sequence given in SEQ ID NO 50496
  misc_feature: Useful for making plants with altered lignin content
KIVDPVTGKPLSVGKKGELLVKGPAVMTGYVGDDEANASTFDSEGWLKTGDLCFIDQDGFLFVVDRLKELIKYKGYQVPPAELELVLQTLPEVIDAAVMPYPHEEAGQIPVALVVKQPGSKVTEAQIMDHVAKRVAPYKKIRKVLFVDSIPKSPAGKILRRQLANHVQFTAVSRL

SEQ ID NO: 41440 - DNA, 1928 bp, Panicum virgatum
  misc_feature: Ceres CLONE 2007734
  misc_feature: Encodes the peptide sequence at SEQ ID NO. 41441
gtaagcatcccaatccgtcgccgggaagagcaggtcccccaaaacaatggcgaccgccgcggccacggccaccgttcccgccggcggtcgcccgtaccgccgctcccgtcctcgctgcggtccaccgcgcctgcaccgcctgcgcctccgtgccaccgccgccgcagccacagccgcttcttcttccccgctcgcaccgtccacgtcggcgcccccgccggagggcggcgggcggctggtggcggagctggtggccgcgttcaacgagctgacggagcggatgggggaggaactggcgacttcctcctcgtcgcgccttctcttccgtgcgctgaagctggcgctccctgccctccgtgacggggacggcggtagggcgctcgcacgcgcgctcgccgttgccgcctcccttgctgatctccagatggatgctgaagtcatatcggccggcatactgagagaagcactagatgcaggagctgtaagcatgagggatgtgaaaactcagattgggatcagtacagctcatttgctgcacgagagcttaaggctcaagcatgctccttcgaagcttgacatattggatgatgaaagtgcaagcgctttgagaaagttttgtctcacatactatgacatcagggcagtgatattggagcttgcactgaagcttgatatgatgagacacctggatgacctccctaagtatctgcagcggataaagtctcttgaagtcatgaagatatatgccccacttgcacatgctgttggagcgggtaatctatcactagaattagaagatctttcatttcattacttgtttcctcattcatatgaccatgttgatcagtggttgagaagccaagaaagtgactgcaaggccttgataaatttgtataaggagcagttacttcaagctctgaaagctgatgacgagttgaataggattgtacaggacatttcagttcaggggcgctataaaagccgtttcagtactatgaagaaactagtaaaagatggccggaaaccagaagaagttaaagacatactaggtgtgcgagtaatcttggagcctcgatgtgatggcaattcatcaggttggggccctagggcttgtcacaggacgcatgaaattattcagtctctgtggaaggaagtccctggtagaacaaaagattatatcagtcagccaaaagaaaatggttaccagagcttgcatgtggccatcgatgtaagtgaacctgggaggatgaggcccctaatggagatacagatacgcaccaaagagatgcataggtttgctgttggtggagacgcttctcactccctctacaaaggtggtcttactgatcctggagaggctaaacgactcaaggctattatgttagctgcagcagagctagcagctctgcgcctacgtgatctaccagatagtgatcggggagttggcaacagcaacaaccctgctttccatcaacttgacaaaaatggggacgggagaatcagcatcgaggagctcactgaggtgatggaggatctaggtgccgggggtgaagacgcaacggagctcatgcatcttcttgatgcaaatagtgatggctccttgagctctgatgaattcgagtcattccagagacagattgaactgatgagaagcttggaggatgaggacgatcactacaggaagatactgaaggagaagctgcacactattgatagcgcgggtctcatccatgtctaccgcaaggagctgggtgacaaactgcttgtgagctgatctggaacttgtgagaatctgcagaacccaaccaaaccaccatttgttgtatctgcacgcgtatactgtatcaagagacgactccaccacaaattgtaaatacttgaatgtacatggcgttgtatgcaattcagaaaagttggagctttttgtc

SEQ ID NO: 41441 - protein, 497 aa, Panicum virgatum
  misc_feature: Ceres CLONE 2007734
  misc_feature (230)..(354): Pfam Name: RelA_SpoT Pfam Description: Region found in RelA / SpoT proteins
  misc_feature: SWISSPROT Homolog: EC 3.1.7.2 Guanosine-3',5'-bis(diphosphate) 3'-diphosphatase
MGEELATSSSSRLLFRALKLALPALRDGDGGRALARALAVAASLADLQMDAEVISAGILREALDAGAVSMRDVKTQIGISTAHLLHESLRLKHAPSKLDILDDESASALRKFCLTYYDIRAVILELALKLDMMRHLDDLPKYLQRIKSLEVMKIYAPLAHAVGAGNLSLELEDLSFHYLFPHSYDHVDQWLRSQESDCKALINLYKEQLLQALKADDELNRIVQDISVQGRYKSRFSTMKKLVKDGRKPEEVKDILGVRVILEPRCDGNSSGWGPRACHRTHEIIQSLWKEVPGRTKDYISQPKENGYQSLHVAIDVSEPGRMRPLMEIQIRTKEMHRFAVGGDASHSLYKGGLTDPGEAKRLKAIMLAAAELAALRLRDLPDSDRGVGNSNNPAFHQLDKNGDGRISIEELTEVMEDLGAGGEDATELMHLLDANSDGSLSSDEFESFQRQIELMRSLEDEDDHYRKILKEKLHTIDSAGLIHVYRKELGDKLLVS

SEQ ID NO: 41442 - DNA, 669 bp, Panicum virgatum
  misc_feature: Ceres CLONE 2007758
  misc_feature: Encodes the peptide sequence at SEQ ID NO. 41443
atcaagcccaacggattcgacacagcccctgcaaggctctcgatcgaccagctccctccggcttggcttggcttgcctttgctctgctttgctcattaaacaactcatccccatcatcttcctcgatctactctctcgatctctctctccctctccaaattaaccccaaagctacctacctagcaatggggaggtcaccgtgctgcgaccaggacgccggcgtgaagaagggcccctggacgcccgaggaggacaagctgctggtcgactacatcaaggacaacggtcacggcagctggcgccgcctccccaagctcgccgggctcaaccgctgcggcaagagctgccgcctccgctggaccaactacctccgcccggacatcaagcgcggccgcttcaccgacgaggaggagaagctcatcatccacctccactccatcctcggcaacaagtggtcgtccatcgccaccaagctccccggcaggacggacaacgagatcaagaactactggaacacgcacctccgcaagaagctcctcagcatgggcatcgaccccgtcacgcaccgcccgcgcaccgacctcaacctcctggccggcatccccaacctgctcgccgccgcgcaggcgcagaccactgcctactgggacatcaacgccctccgcctcc

SEQ ID NO: 41443 - protein, 161 aa, Panicum virgatum
  misc_feature: Ceres CLONE 2007758
  misc_feature (68)..(113): Pfam Name: Myb_DNA-binding Pfam Description: Myb-like DNA-binding domain
  misc_feature (15)..(62): Pfam Name: Myb_DNA-binding Pfam Description: Myb-like DNA-binding domain
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: Functional homolog of the protein sequence given in SEQ ID NO 50784
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 824 in the 10/412,699 US patent application
  misc_feature: The sequence is a functional homolog of SEQ ID NO 296 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1002 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1010 in the 11/435,388 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1073 in the 10/374,780 US patent application
  misc_feature: The sequence is a functional homolog of SEQ ID NO 442 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 569 in the 10/374,780 US patent application
  misc_feature: The sequence is a functional homolog of SEQ ID NO 58 in the 10/666,642 US patent application
  misc_feature: The sequence is a functional homolog of SEQ ID NO 271 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 788 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 792 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 794 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 836 in the 10/412,699 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 790 in the 11/435,388 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 822 in the 10/412,699 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 743 in the 10/666,642 US patent application
  misc_feature: Functional homolog of the protein sequence given in SEQ ID NO 50235
  misc_feature: Useful for biocontainment applications
  misc_feature: The sequence is a functional homolog of SEQ ID NO 796 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1681 in the 10/374,780 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 1917 in the 10/374,780 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1572 in the 10/374,780 US patent application
  misc_feature: The sequence is a functional homolog of SEQ ID NO 1564 in the 10/374,780 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 126 in the 10/412,699 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 1563 in the 10/374,780 US patent application
  misc_feature: The sequence is a functional homolog of SEQ ID NO 1565 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1566 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
MGRSPCCDQDAGVKKGPWTPEEDKLLVDYIKDNGHGSWRRLPKLAGLNRCGKSCRLRWTNYLRPDIKRGRFTDEEEKLIIHLHSILGNKWSSIATKLPGRTDNEIKNYWNTHLRKKLLSMGIDPVTHRPRTDLNLLAGIPNLLAAAQAQTTAYWDINALRL

SEQ ID NO: 41444 - DNA, 730 bp, Panicum virgatum
  misc_feature: Ceres CLONE 2007766
  misc_feature: Encodes the peptide sequence at SEQ ID NO. 41445
gaagaggagcgtggaggcacctggtatgaaagaatcggaggagaccctaactccgctaccgcagcagctgcttccgccgccgtcgcagacgacgcgccccgtgtcggatctacgagaagcgagccgcaacgatcacacggcggagaaccaccgccccgcgcggaagagcgtggtgcgcgtgaggaagaggacggcgtcgaccgcctcagccacctccacgccgacatcctcggccacatcatctccttcctccccaccaaggacgccgcccgcacccaggcgctctcctcccggtggcgcggcatctggcgctccgccccgctcaacctcgaccaccgcgacctccagtggccccgctacgacgagcagcgcgtcgccgccctcacctccaacatcctcgcctcccacccgggcaccgccgcccgccgactctccgtcggcgtcgcccacctccgccgccggcccgccgtcgtcgacgcctggctgcgctccccggcgctcgacggcctccaggagctcgagttcgacatcggggggctctacgagctcccggcggacctcccgctgcaggcctccgccttcttccggttctcggccaccctccgcgtcgccaccatcgccaagtgccgcgtcccggacgacgacgacggcgcgctcttcttcccccggctccggcagctcggccttgaggacgtcgtcatctcgggaggctcgctgcacgggatcatcg

SEQ ID NO: 41445 - protein, 243 aa, Panicum virgatum
  misc_feature: Ceres CLONE 2007766
  misc_feature (67)..(114): Pfam Name: F-box Pfam Description: F-box domain
EEERGGTWYERIGGDPNSATAAAASAAVADDAPRVGSTRSEPQRSHGGEPPPRAEERGAREEEDGVDRLSHLHADILGHIISFLPTKDAARTQALSSRWRGIWRSAPLNLDHRDLQWPRYDEQRVAALTSNILASHPGTAARRLSVGVAHLRRRPAVVDAWLRSPALDGLQELEFDIGGLYELPADLPLQASAFFRFSATLRVATIAKCRVPDDDDGALFFPRLRQLGLEDVVISGGSLHGII

SEQ ID NO: 41446 - DNA, 567 bp, Panicum virgatum
  misc_feature: Ceres CLONE 2007785
  misc_feature: Encodes the peptide sequence at SEQ ID NO. 41447
agtagagctgcgcacgtctggagctctaccccctctctactgcatccgatactctgatcgctgccatgggaacccgcagtgttgccctggttctcctcgcggccgttctgctccaaaccctcctccccgcctcggcggcggagggtttggtgcgggacgcgctgaacaatcagcccatcgaccagaacagccgcgtcggggaccgactctccgccgaggagaagcagcgtcttctctgtggctgcaactcgatgggctcgagcgatgagggtgacatcatcgcgcttaagaactacatgaacgcacagtactttggggagattggcgtcggtacgccagcgcataagttaaccgtcatcttctacaccggaggctccaatcactgggtgccgtcctccaagtgctacttctcgatctcttgctacttgcactcgcgctacaagtcagggcagtcgagtacttacaagaagaacggaaaacctgctgacattcactatggaagtgggtcaattgctggttttttcagtgaggatagcgtcaccttaggtgatcttgtagtgaaagata

SEQ ID NO: 41447 - protein, 167 aa, Panicum virgatum
  misc_feature: Ceres CLONE 2007785
  misc_feature: SWISSPROT Homolog: EC 3.4.23.40 Phytepsin
MGTRSVALVLLAAVLLQTLLPASAAEGLVRDALNNQPIDQNSRVGDRLSAEEKQRLLCGCNSMGSSDEGDIIALKNYMNAQYFGEIGVGTPAHKLTVIFYTGGSNHWVPSSKCYFSISCYLHSRYKSGQSSTYKKNGKPADIHYGSGSIAGFFSEDSVTLGDLVVKD

SEQ ID NO: 41448 - DNA, 587 bp, Panicum virgatum
  misc_feature: Ceres CLONE 2007807
  misc_feature: Encodes the peptide sequence at SEQ ID NO. 41449
acgactggctctccccacgcaaagcgagccgcgcgcctcggtcgccaccgcattggcatcggatcgatcgctccgccacagcccacagagaggaggaggagggaggcaggagggggagccgcgcgcggccggccatgatgccgtcgtcgtccatgcccggcgcggcgggctcctcggagctgatccgccgctgccgtgggtgcggtacgtgctgggcgagcagcgcctggtgttcgcgctcctcggcatggcgctggcctcgctcgtcttcctcctgctggcgccctccggctcacctcctgcgggcgcggcgtcgagcggcggcagcgcggcgcacctcgcggcggtgggcctggcggcgtggcagtacagcagcagcaggacgttggagggcggcgtccgctccgccgcgcgcgttcctcttggcctgaagcgcaagggcctccgcgtggttgtgaccggcggcgccgggttcgtgggcagccacctggtggaccgcctgctggcgcgcggcgacagtgtgatcgtggtggacaacctgttcacggggcgcaaggagaacgtgctccaccacggcgggaacccgc

SEQ ID NO: 41449 - protein, 195 aa, Panicum virgatum
  misc_feature: Ceres CLONE 2007807
  misc_feature (149)..(194): SWISSPROT Homolog: EC 4.1.1.35 UDP-glucuronate decarboxylase
  misc_feature (130)..(179): SWISSPROT Homolog: EC 5.1.3.6 UDP-glucuronate 4-epimerase
RLALPTQSEPRASVATALASDRSLRHSPQRGGGGRQEGEPRAAGHDAVVVHARRGGLLGADPPLPWVRYVLGEQRLVFALLGMALASLVFLLLAPSGSPPAGAASSGGSAAHLAAVGLAAWQYSSSRTLEGGVRSAARVPLGLKRKGLRVVVTGGAGFVGSHLVDRLLARGDSVIVVDNLFTGRKENVLHHGGNP

SEQ ID NO: 41450 - DNA, 1332 bp, Panicum virgatum
  misc_feature: Ceres CLONE 2007810
  misc_feature: Encodes the peptide sequence at SEQ ID NO. 41451
gtttattaaccctcgctcgcgtcgcgtcctccgcatccggcttctgctgcccccggcgcccgcgtctgccccacccgtcggcgtgctggtcgccgttgccgccggagcgccgactcgccgccgatcctggtgttcgacgcgatgcagccgcctatggggaacgagaggccgccgctgccaggccgccctgtctcagctttcgtgcccggcgccgccgtcccgcctccaccttttgccgccggtggtccgttcgtcccgccgccacggcagggagcgctgctgcctcagcctggtgctgcggcaccccctttcggggcagcgcaacccgcggcaatgggtggctacaggggtccaccgccgtcccaggttccctttgctgccgcgccaccgcctcagcggcctttcacctccgcaccgctgcctcagggccctttcacctccgcgccgccatctcagggaccctttgcctctactccaccgcctcagggccccttcacctcggctcgaccatctcagggccccttcaccttggctccaccgtcacaggcccccttcgctgctggaccaccgcctcagggcccctttgctgcttctgcaccggcaccttttcggcccccaccatcgtcgtcccttgggcagccacaatctcccacaggaggttctttgcctgcactgaattatgtgaggccaccaccactacagtcgcaagggttttaccctggtgcacagcctgtgaaccaccaattcccaatgtcaaggccagcatttcaacagccagtgcataccatgccacccccgccgatgggactgactgcctcgtttggtaaccaggcagcatatccgagtgctgggcctccagttggaggcacactacagagcttagtggaggacttccagtcgttagcactgagttcagcgccagggtcgcttgaccctggcgttgatgtaaaagcgctgccaaggccattggatggtgatgaggagccagttaagcttttggaggcatacccattgaattgccacccgaggtacttccggctaacaacccatgcgattccggcatctcagtcattggtctccaggtggcatttgccccttggggctgtggtacaccctcttgcagaatcacctaatggggaggaagtgccagttatcaattttgggtcagcaggtgtcatccgttgtcgaagatgcaggacatatataaatccttatgcaacatttgcagatgctggaaggaaatggcgctgcaatctttgcaccttgctcaatgatgttcctggagagtacttttgtgctctggaatgctaatggcagaaggtatgatactga

SEQ ID NO: 41451 - protein, 389 aa, Panicum virgatum
  misc_feature: Ceres CLONE 2007810
  misc_feature (344)..(383): Pfam Name: zf-Sec23_Sec24 Pfam Description: Sec23/Sec24 zinc finger
MQPPMGNERPPLPGRPVSAFVPGAAVPPPPFAAGGPFVPPPRQGALLPQPGAAAPPFGAAQPAAMGGYRGPPPSQVPFAAAPPPQRPFTSAPLPQGPFTSAPPSQGPFASTPPPQGPFTSARPSQGPFTLAPPSQAPFAAGPPPQGPFAASAPAPFRPPPSSSLGQPQSPTGGSLPALNYVRPPPLQSQGFYPGAQPVNHQFPMSRPAFQQPVHTMPPPPMGLTASFGNQAAYPSAGPPVGGTLQSLVEDFQSLALSSAPGSLDPGVDVKALPRPLDGDEEPVKLLEAYPLNCHPRYFRLTTHAIPASQSLVSRWHLPLGAVVHPLAESPNGEEVPVINFGSAGVIRCRRCRTYINPYATFADAGRKWRCNLCTLLNDVPGEYFCALEC

SEQ ID NO: 41452 - DNA, 1304 bp, Panicum virgatum
  misc_feature: Ceres CLONE 2007844
  misc_feature: Encodes the peptide sequence at SEQ ID NO. 41453
tcctcgtcagctcagctccaaacacaagtgaggcacggccgactgagagggagaacccaggccggccagagcccagatggagcatgaggatcaagaagcgcagaagcctctcctggccacggccgccgggagcagcggtgatggccgccggggagctgcctcctcctcttcgattgcggtggtggtcgccagcaccgccgtcgccgtcaccggatccttcgagttcggcatctcggtgggctactcgtcgccttctcagccgggcatcatgcgtgatctcgacctctccttagccgagtactctgtctttggctcgatactaaccattggagcaatgctaggagctattgtcagtggtaccgtggcagactgtgtcggccgaagatgcacaatggcaatatcagatattctctgcattcttggatatctcctgataactttttcccagaacttttggtggcttgacatcggacgggtctcaattggatgtggaatcggccttctttcatatgtggttccagtctatatatcagagataacaccaaagaatctcagaggaggatttgcaactgtaaaccagtttatgatatgttgcggtgcatcgcttgcatatgttttggggacctttataacttggcgtaccttggcaatcattggcgtggcaccatgtttactgcagttggttggccttctcgtgactcctgaatcccctagatggctggcaaggtttggacaccctggtgcatttgaggcagagttgcagaagctaaggggaaagggggctgatatatctgaggaagcagaagaaattaaagatttcacagaaaagcttcagcacttaccaaagtcaaagattttggacctgtttcaaaaggattatattcatgctgttacagttggagttgggctaatggtccttcaacagtttgggggagtgaatgccatttgcttctatgccagtgaaatatttgtttcagctggtttttcgtcaggaaacacaggaatgcttgctatggttgctgtccagattccaatgacgggattaggggtacttctaatggagaaggctggaaggaggccacttttgatggtctctgctgctggaacatgcctgggttgcctgctagttggtttttcattcttagctaaggagcatcactggggaaaggacctgaacatattgctggctttggcaggaattctgactttcggtggatccttttcactaggcatgggagggataccatggggtataatgtcagagatcttttcccataaacatgaaagggagcaacaggaagcct

SEQ ID NO: 41453 - protein, 409 aa, Panicum virgatum
  misc_feature: Ceres CLONE 2007844
  misc_feature (38)..(409): Pfam Name: Sugar_tr Pfam Description: Sugar (and other) transporter
MEHEDQEAQKPLLATAAGSSGDGRRGAASSSSIAVVVASTAVAVTGSFEFGISVGYSSPSQPGIMRDLDLSLAEYSVFGSILTIGAMLGAIVSGTVADCVGRRCTMAISDILCILGYLLITFSQNFWWLDIGRVSIGCGIGLLSYVVPVYISEITPKNLRGGFATVNQFMICCGASLAYVLGTFITWRTLAIIGVAPCLLQLVGLLVTPESPRWLARFGHPGAFEAELQKLRGKGADISEEAEEIKDFTEKLQHLPKSKILDLFQKDYIHAVTVGVGLMVLQQFGGVNAICFYASEIFVSAGFSSGNTGMLAMVAVQIPMTGLGVLLMEKAGRRPLLMVSAAGTCLGCLLVGFSFLAKEHHWGKDLNILLALAGILTFGGSFSLGMGGIPWGIMSEIFSHKHEREQQEA

SEQ ID NO: 41454 - DNA, 1671 bp, Panicum virgatum
  misc_feature: Ceres CLONE 2007848
  misc_feature: Encodes the peptide sequence at SEQ ID NO. 41455
gcacgcacgcgccgaccgctcgctcgccttcgccggccacgctgcccgcccgtgcccgtgtgctgcctcggcgctcggcagccgtcaccctcgcttcgccaccgccgcgagcgacgcgcgagcaggccgcggtttcgctcgccctcggggctccgtgttctatgatcgccactattttcattcttgatgaagcctcgtgtgcgtcggtatcttctgctgcaaagcctgtgttccctttctgtcaaaacaagaatatctgaggcaggaaccttgctaataatagtggataaccatgtgccccccaaatcctgagctgaaactggcagcacttaacatcagtatcagggattcctggagtgaggaggaacttgtcagattcttggccgagaggaaagctgaggatccccttccgcaggacgtgcttgtgggtctggacttctccctcgttgatccacggatcttcactgtagacacatggtacttgagctggtcagatgatgaacaacctaataacagtgctgaaaacagtatcagaaaggcaaaaaatggatactggaaacatgcggagtcatgcaaagtaccaacaagtataggtatcatgggcgtgaaaattattttggagttttatgaaggtcaagaaccatgtggcaagagaactgggtgggtgatgcatgaatatcaagtggaacagaatgacgaagctaatctaccacaggactacaagtctttgtgtagagtattctttcagggtgacaaaaagctagatgcaaaaagtcaaaaaaattctatgaatgtagatgctcctaatgatagcttggagacttaccttcagtatcttgcaaaactagaagagccaaaggtgacagcagatgcaaatgaggatgtttgttctagcaaagtacagtttgagcaaaaacctcagaattctctagatgatattgatgttattgctactggggactacatagagctgaatgacctactaacctcagaagcctctgcatcaacttcagaaaactcaagcaagcgatctatggtttctgaggattattttgatagtgatgcattcctgcgtgaaatcttgaaaggtggtaacacaactgatggacaaaatcaagaccacaagtttagcatagctgcacctactaaatcagctaatgtggtactcagcccttcagaacaagggctagttcagttccatgataacaatggcatggtgcctggaacttcacatcagaagccagtgccagaaggtgatagaggtgaacattcaagccaagggtttcagcagcagagtccttctgtgtcttcctatttcccaagcagccatgtgaagggaagccattccaacagttctagcagctcgcagagcagcattaagtctcataaagagcagtctacccgtaaatttggaaagatacgaaagaagtactgctgctttggatccttctagtacaatgcatagcttctgttctatttttgtacaggatggagcatagggaaggatcagtttttccacttcatcattaggcacatgatactgtgcaaattgctatagtgacattggctgattgacgcaacaagtagttgccatatgttgtgaaattgaaactagatggtagctagtttgaagctacctgaaacaacaatacgagctgtggaaagttttcc

SEQ ID NO: 41455 - protein, 386 aa, Panicum virgatum; identical to SEQ ID NO: 31008
  misc_feature: Ceres CLONE 2007848
  misc_feature (22)..(132): Pfam Name: NAM Pfam Description: No apical meristem (NAM) protein

SEQ ID NO: 41456 - DNA, 1885 bp, Panicum virgatum
  misc_feature: Ceres CLONE 2007853
  misc_feature: Encodes the peptide sequence at SEQ ID NO. 41457
accatccctccctactccctagtcccccaccccacactcgctgaagtccaaggcagacgctgccacgaattcacgagcggcggcgaggagaggagatgcagaacgtggttgaggtcgagccaggccgcccggccgccgatgggcgcccctccgtggggcccacctaccggagcgccttcgcccgcgacgggttcccgcccccggtcccggggctggacagctgctacgacatcttccggatggcagtggaaaagtatccagacaacagaatgcttggccaccgtgagattgttgatggaaaggctggcacatacgtctggaagacatacagggaggtttttgacattgcaagcaaaattggtaactctattaggagctgtggacttgcaaagggcagtcattgcggtatctatggtgctaattgtcctgaatggattatcacaatggaggcttgcaatgcccatggaatctactgcgtcccattatatgacacactcggagctggtgctgtagagtttattctatgccacgcagaagttgagattgcttttgctgaggaaaagaaaattgagctgctcttgaagaccttacccaagtcaaatgagttcttgaaaacgattgtgagttttggcaaggtaactcaagaacaaaaggaagaagcttccaaatacgagctgtcaatctactcatgggatgaatttctgtccctggcagctgaccaagaatttgatcttccagacaaggagaagacagatatatgcactataatgtatactagtggaactactggtgacccaaaaggggtactgatatccaatgcaagcattatttgtctcatcgcaggtgtggaccggctacttaaccgtgtaaacgagaagctggcagaaagcgatgtttacatgtcttaccttcctcttgcgcacatctttgatcgtgttgtggaggagctgtttattttccatggtgcctctattggattctggcgtggggatgttaagctgctagtcgaagatattggtgtgctgaaaccaacaatcatgtgtgctgtcccacgtgttcttgatcggatattttctggactgcaagctaaaatttcctctggtggttttataaagagtacactattcaatcttgcttacaaattcaaaaaatttagaatgatgagaggagctaagcatgatgaagctgctgccatatgtgataaagtagtttttagtaaggtgaaagagggtctcggtggcaatgttagagttattttatctggagctgctccacttgctacccatgttgaagaatacttgcgagtggtgacatgcgcacatgtcttacaaggatacggtctcacggaaacttgtgctggatcttttgtctcattgccaaatcagatgtccatgataggaactgttggtcccccagtgccaaatattgatgttcgtttggagtctgtcccagaaatggattatgatgcacttgcgagcacagctcgtggagaaatctgcatcaagggagaaacactattctcaggatactacaagcgtgaagaccttacaaaggaggtcttgattgatgggtggttccatactggtgacattggtgagtggcaacctgatggaagtatgaaaatcatagatcgcaaaaagaatatattcaaactttcacagggagaatacgtggcagttgaaaatttggagaatatttatggccttgtttctgctatagactcgatatggatatatgggaacagctttgaatccttccttgtttctgtggtcaatcccaacaaggaggctcttgagagttgggctgcagcaaatggaataagtggtgattttgagtccttgtgccagaatccaaaagcaaaagaatacattttaggagaactgtc

SEQ ID NO: 41457 - protein, 596 aa, Panicum virgatum
  misc_feature: Ceres CLONE 2007853
  misc_feature (77)..(546): Pfam Name: AMP-binding Pfam Description: AMP-binding enzyme
  misc_feature: SWISSPROT Homolog: EC 6.2.1.3 Long-chain-fatty-acid--CoA ligase
MQNVVEVEPGRPAADGRPSVGPTYRSAFARDGFPPPVPGLDSCYDIFRMAVEKYPDNRMLGHREIVDGKAGTYVWKTYREVFDIASKIGNSIRSCGLAKGSHCGIYGANCPEWIITMEACNAHGIYCVPLYDTLGAGAVEFILCHAEVEIAFAEEKKIELLLKTLPKSNEFLKTIVSFGKVTQEQKEEASKYELSIYSWDEFLSLAADQEFDLPDKEKTDICTIMYTSGTTGDPKGVLISNASIICLIAGVDRLLNRVNEKLAESDVYMSYLPLAHIFDRVVEELFIFHGASIGFWRGDVKLLVEDIGVLKPTIMCAVPRVLDRIFSGLQAKISSGGFIKSTLFNLAYKFKKFRMMRGAKHDEAAAICDKVVFSKVKEGLGGNVRVILSGAAPLATHVEEYLRVVTCAHVLQGYGLTETCAGSFVSLPNQMSMIGTVGPPVPNIDVRLESVPEMDYDALASTARGEICIKGETLFSGYYKREDLTKEVLIDGWFHTGDIGEWQPDGSMKIIDRKKNIFKLSQGEYVAVENLENIYGLVSAIDSIWIYGNSFESFLVSVVNPNKEALESWAAANGISGDFESLCQNPKAKEYILGEL

SEQ ID NO: 41458 - DNA, 605 bp, Panicum virgatum
  misc_feature: Ceres CLONE 2007863
  misc_feature: Encodes the peptide sequence at SEQ ID NO. 41459
gttcgttctcgcttcgcagaccaaaacaccctgctagagttttgctgcttttgtgttcctcaccgcacagattgccccagcggcgattcagcgcatggttgttcgcccgcacctgcgcggccgttgatcgcgacagcctcgtcgcagcggtcggaggagcagcgccggcggcgtccatggcggcggggtcgtcgaggcaagcggcggagaaggtggacaagtggatggcgttcccgtcgggcgccgacggcggcagcttcaccttcccgccgccgcgttccgggtcgggcggcggcaaggagatcgtggaggagccagcgtcgtcctctccgggcgccgccgccgccggaggcggcagctaccggcagccgtcgttccagcgcgggcgcgacagcggcggcgcgggcagcaccaagtcgtcgctggacggcgcgcgcggctcgggggagtcgtcgctgccgcgggtgtcgcaggagctcaaggacgcgctgtccaacctgcagcagaccttcgtcgtctccgacgcgacgcgcccggactgcccaatcatctacgccagcgccggcttctacaccatgaccggctactcccccaaggaggtcatc

SEQ ID NO: 41459 - protein, 142 aa, Panicum virgatum
  misc_feature: Ceres CLONE 2007863
  misc_feature: SWISSPROT Homolog: EC 2.7.11.1 Non-specific serine/threonine protein kinase
MAAGSSRQAAEKVDKWMAFPSGADGGSFTFPPPRSGSGGGKEIVEEPASSSPGAAAAGGGSYRQPSFQRGRDSGGAGSTKSSLDGARGSGESSLPRVSQELKDALSNLQQTFVVSDATRPDCPIIYASAGFYTMTGYSPKEV

SEQ ID NO: 41460 - DNA, 1348 bp, Panicum virgatum
  misc_feature: Ceres CLONE 2007866
  misc_feature: Encodes the peptide sequence at SEQ ID NO. 41461
cctccattcctcctcgaggcaccagcgccaaaagcatccgcgcccgcctcctcccgccgctgcgctcagcccccctcgcgaagcaagcaggcgcgagcgcgacgctcctccgatcgtctctcttctcgacgccgcctcctcggcagccgctcccgcctctagtcgcggtctcccccgatccgatccgatcccaccggcaaggcaactcagcgaataagtgcgccccttaccccgctcgtctcctacctcgctcccgccagccggttcggccgcgaaatcccggccgcctccgctccgaggggaccgtgccgtgcgcaaggtgttcgacggaggggagtccgtgcggcttccgtctctagcaacaatcccctgaggtcaggtcgtccgaccgacgatgggatctctcgccgacccctacgcgctacgcggtgtctccgacctgcccccgccattccgccccgtgtttcagttcagatacttcaattccttgcagagcgagtgcttccatgtgtgcttcttctcggatgtgaatatggttatctccgcgcctactgggagtgggaagaccgtgctgtttgagctctgtatgctgaggctgctctcgaggytcctttcaccagactttaggttcaatttggttgaaggaactctgaaaacaatatacatggcaccctccaaggcgttggtgcaggagaagctgcgggactggaagacaaagctgggcccactggggattaattgcttggagatgactggtgacaatgaattctacaacaataaagccatacacgatgctgatataatcctcaccactcctgagaagtttgattccatgagccgacatggtataagagatggtgggttgggtttcttcagtgacattgcccttgtccttattgatgaagttcaccttctcaatgatccacgtggagctgcattggaagcagttgtcagtagattaaaaatgctctcacgacatgaaaatatgaaatcttctcctttggctagtgtccgattcgtagctgtttctgccactataccaaatattgaggacatagcggagtggctcctagcaccccctgaaggaatcaaaagatttggagaagaaatgaggccagtgaagttgacaaccaaggtctttggttatgctccagctaaaaatgacttcctttttgagaggaggctgcaaaattttatttacgatattctcatgcaacattcaagagggaaatctgcacttgttttctgttctacaagaaaaggggcacaagaagctgcgcagtgccttgcacaaacctggagcatcgcttggctattccaatccatttatgcaatcaatgcagcacta

SEQ ID NO: 41461 - protein, 317 aa, Panicum virgatum
  misc_feature: Ceres CLONE 2007866
  misc_feature (30)..(221): Pfam Name: DEAD Pfam Description: DEAD/DEAH box helicase
  misc_feature (72)..(72): Xaa is any aa, unknown, or other
MGSLADPYALRGVSDLPPPFRPVFQFRYFNSLQSECFHVCFFSDVNMVISAPTGSGKTVLFELCMLRLLSRXLSPDFRFNLVEGTLKTIYMAPSKALVQEKLRDWKTKLGPLGINCLEMTGDNEFYNNKAIHDADIILTTPEKFDSMSRHGIRDGGLGFFSDIALVLIDEVHLLNDPRGAALEAVVSRLKMLSRHENMKSSPLASVRFVAVSATIPNIEDIAEWLLAPPEGIKRFGEEMRPVKLTTKVFGYAPAKNDFLFERRLQNFIYDILMQHSRGKSALVFCSTRKGAQEAAQCLAQTWSIAWLFQSIYAINAA

SEQ ID NO: 41462 - DNA, 494 bp, Panicum virgatum
  misc_feature: Ceres CLONE 2007866-R
tccctggggacccataaaaccttaactttgcaacctccatttttttaagtgatatcttttaggtacccatattaggtgatacatttggcctaaaaactttaattgattgcttaacggatgctatcctattccattttcagttggttttcataatgctggtctttgctcaaaagatcggaatcttgttgagggtctttttctcaagggtgatcttcaagttctatgcacaacgaatactttggcacatggtgtcaacttaccaggacatacagttgtgataaagtcaacacagtttttcaacaaagagaaaggcctatatgcagagtatgagaggtccatggtgcttcaggtttactactaagccccaatatgtcatttaaactattattgttgatatataggaataaattttccaactcgcttcatatcttactgtgattttgtatggttgcaatgtagcttcaatgttatgtattcattgttatatttctacc

SEQ ID NO: 41463 - DNA, 1343 bp, Panicum virgatum
  misc_feature: Ceres CLONE 2007868
  misc_feature: Encodes the peptide sequence at SEQ ID NO. 41464
gacatcgccggcgtggcaaaggcgaggggccgaggggggaaaagagagcgtagaaagtgggggagagaaactgaagcgaccggggttgaaggtttttgctcccaatcccccctctctcctggactcctccgccgcatcctcccatccctcctcccccccaaacccttcttctcgccgccgccgcagcgttgcatccatccggatgggcagcgccggcggtagggttggggcgacagaccagatcccggaggttgaaatggacgtcgtcgagggcgctccggaggagccggggcgggtcgggtcgaagagggtcagggattcgcccagcgccctgggttcccacggtttttatggagtgactactgcagagaagaaaccaatgcttcaacctcataatgttgataaaagtttgagcaaagctggcaacagtaaccttctgcacatgaattctgatggtgcttctaaaatggggggtcgatacctgcgtggtgcagatggcttggggactccagattctattgctctgagattgaatatctcatctccttgtgaaaacctggagaatgaaaccaaatgggccaccaaaatatgtaccttttacactcaaggttggtgcaataaaggaaacagttgcgcatttcttcatgaaagagaggggggttttgcaaaggctggtctgcttgcaccacctggttttgaaaatcatagaggttccgaagaagggtctcaagtacaacatcaatccaacttgaaggtgctgcaattcaaagatgcagagggttcatcaaaagatgagcggtatcggagacttatacatgcatatggcgaagataatgtgaggctggcacatattgctgataaacgaaactctaccactccagggatttcacaagggctccatggcactggcagtatggagcacagtctagtagttcatgagaaaaccaacaaacctttcatgagacaccatactggtttgtcacctgaaacctatttggatggcagacatatcttgctagatggaggggactttgaatctggtatggacaggagaaacgacttcagtaatgcccatgttgcaagaacttatcttgacgtgaacaccttaaactcaggccatcagtttcgatcatctggcctttctatttcatctgatcctttccaactcagtgagaagttgtcagcttatggtgcaacaacagataatctttctaacacacatcagaaagaacatcattcaagccttgcctcatatagttcacatggcttaacaggatttagaaatccaggctatgctgcatctgaaacttctagacctgcattactctcaagcagttcatctg

SEQ ID NO: 41464 - protein, 380 aa, Panicum virgatum
  misc_feature: Ceres CLONE 2007868
  misc_feature (125)..(150): Pfam Name: zf-CCCH Pfam Description: Zinc finger C-x8-C-x5-C-x3-H type (and similar)
MGSAGGRVGATDQIPEVEMDVVEGAPEEPGRVGSKRVRDSPSALGSHGFYGVTTAEKKPMLQPHNVDKSLSKAGNSNLLHMNSDGASKMGGRYLRGADGLGTPDSIALRLNISSPCENLENETKWATKICTFYTQGWCNKGNSCAFLHEREGGFAKAGLLAPPGFENHRGSEEGSQVQHQSNLKVLQFKDAEGSSKDERYRRLIHAYGEDNVRLAHIADKRNSTTPGISQGLHGTGSMEHSLVVHEKTNKPFMRHHTGLSPETYLDGRHILLDGGDFESGMDRRNDFSNAHVARTYLDVNTLNSGHQFRSSGLSISSDPFQLSEKLSAYGATTDNLSNTHQKEHHSSLASYSSHGLTGFRNPGYAASETSRPALLSSSSS

SEQ ID NO: 41465 - DNA, 625 bp, Panicum virgatum
  misc_feature: Ceres CLONE 2007868-R
ccccccccccaccaaaaaaaaaaaaaactcaggcgagctgccagagcaaagaagagcgattgatataaagtgtaagaagtgactgattgtctcaatacccccttcaataatggtactcctgttcattttacctggcatacaaggctagaagaggatagcttgccaaagatttcattttcaatgtggcaatggaaagaacttcagaatcatgtgattcagatggatattgcatataaagtggttgctcccagaatgctcacctgaagatgttatttttgtcattgtgattgagctacactgatgaccctagaagcatatgttgctcgcagaattgaaaaggtcggaattctactattatttcaatctttttttagtaatttaatcagcttgtggcctggtggaaagtcaggtttaattactggaggtggtaattagccaattgcagattggagacaccagtaaagaactaggaagtctctggctgatttagggtcatcctctcttttggtcatttccttggctgttttgagtttgtcggattttgttttcggcttaggggggccttcgtgggtttggacttggaccaccttttttctcaatcatgaatacaaacatgtacatctct

SEQ ID NO: 41466 - DNA, 571 bp, Panicum virgatum
  misc_feature: Ceres CLONE 2007873
  misc_feature: Encodes the peptide sequence at SEQ ID NO. 41467
accacggcagcaaaccaccagaccagagcaaaccagcccagccattgccggagcgatggcggcgatggcgaggtccggtatcgtgaagctcctctgctcctccgctcttctcctgctctgctgcttcctgctcccgggcgccctcgccgaggagcgcttctacgagttcgttgtcaacgagacgctagtgaagaggctgtgcaaggcccagaagatcatcacggtgaacgggcagttcccggggccgacgatcgaggtgtacaacggcgacacggtggcgatcaaggccctgaacctggcgcggtacaacgtgaccctgcactggcacggcctccggcagctgcgcaacgggtgggcggacgggcccgagttcgtgacgcagtgccccatccgccccggcggcagctacacgtaccggttcaccatccaggaccaggagggcacgctgtggtggcacgcccacagctcctggctccgcgccaccgtgcacggcgcgctcatcatccaccccaggaggggcctgccctacccgttccccaagccccacagcgaggtccccgtcatcctttgc

SEQ ID NO: 41467 - protein, 168 aa, Panicum virgatum
  misc_feature: Ceres CLONE 2007873
  misc_feature (36)..(152): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 50535
  misc_feature: Useful for making plants with altered carbohydrate content
  misc_feature: Functional homolog of the protein sequence given in SEQ ID NO 51632
  misc_feature: Useful for making plants with altered cell wall content and/or composition
  misc_feature: Functional homolog of the protein sequence given in SEQ ID NO 50394
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
MARSGIVKLLCSSALLLLCCFLLPGALAEERFYEFVVNETLVKRLCKAQKIITVNGQFPGPTIEVYNGDTVAIKALNLARYNVTLHWHGLRQLRNGWADGPEFVTQCPIRPGGSYTYRFTIQDQEGTLWWHAHSSWLRATVHGALIIHPRRGLPYPFPKPHSEVPVIL

SEQ ID NO: 41468 - DNA, 465 bp, Panicum virgatum
  misc_feature: Ceres CLONE 2007884
  misc_feature: Encodes the peptide sequence at SEQ ID NO. 41469
acatacgcaacacactcagccccacgcagcacctcagctttgctctgctctcccctgctcctcttgcaccatggcggcggaagcccccacccacaccctcacggcgctgctcaacaaggcggccaccggcttcccggcccgccgcgacgtctccatcccgggcaagatagagctcacacacgccgatctccacgcgctcgtctacgccgcggccgcgcgcctcgccgcccacgccggggtccgaccgggacacgtcgtcgcgctctcattccccaacaccctcgagatggtgatcatgttcctgggggtgatccgcgcccgcgccgaggaggcgccgatcaacccagactacaagcaggaagagttcgagttctacctctccgactccgaggcccgcctcctcatcaccaacgccgagggcaaccccgccgcggaaggcgccgccgccaagctcggacagcccac

SEQ ID NO: 41469 - protein, 131 aa, Panicum virgatum
  misc_feature: Ceres CLONE 2007884
  misc_feature: SWISSPROT Homolog: EC 6.2.1.3 Long-chain-fatty-acid--CoA ligase
MAAEAPTHTLTALLNKAATGFPARRDVSIPGKIELTHADLHALVYAAAARLAAHAGVRPGHVVALSFPNTLEMVIMFLGVIRARAEEAPINPDYKQEEFEFYLSDSEARLLITNAEGNPAAEGAAAKLGQP

SEQ ID NO: 41470 - DNA, 716 bp, Panicum virgatum
  misc_feature: Ceres CLONE 2007890
  misc_feature: Encodes the peptide sequence at SEQ ID NO. 41471
atcccttccctctgtctcacctccaaccaacccgacagtcacatctccggctgttgattcaggatgaggacctccaccgcttctctcctcgctttcgccgtccccgccttggcaaccgccggcggcggacctggccacggacatgacggcccgaagggacccggctgcggcggacctggccccaagccgcccctcgtcaactcggagaagctccagtccctgatcaacatcgaggacctcgtcgctggctctcaagatctccaggacatcgccaacgcccacggcggcaaccgcgcttttggcggcggcggtcacaacgccacggttgactacctctacgaggcgctcacagccctcgactactacgacgtggtcaagcagccgttccccgagatctactcagagggcaagggctcgcttaccgtcgacggcgcggaggtccccgccgataccctgacctacacccccggcggcgaagccaccaagcccctcgtggccgtcgccaacctcggttgcgacgccgcggattaccccgccgaggtctcgggcaatatcgccttcatctcgcgtggcagctgcacctttagccaaaagtccatcaacgccaaggcggcaggcgctgtggcggctatcatctacaacaacgagcccggtgaattggcgggcaccctggggcgagccgttcaaggagtacgcccccgttgtgggcatcagcc

SEQ ID NO: 41471 - protein, 217 aa, Panicum virgatum
  misc_feature: Ceres CLONE 2007890
  misc_feature (134)..(211): Pfam Name: PA Pfam Description: PA domain
  misc_feature: SWISSPROT Homolog: EC 3.4.11.15 Aminopeptidase Y
MRTSTASLLAFAVPALATAGGGPGHGHDGPKGPGCGGPGPKPPLVNSEKLQSLINIEDLVAGSQDLQDIANAHGGNRAFGGGGHNATVDYLYEALTALDYYDVVKQPFPEIYSEGKGSLTVDGAEVPADTLTYTPGGEATKPLVAVANLGCDAADYPAEVSGNIAFISRGSCTFSQKSINAKAAGAVAAIIYNNEPGELAGTLGRAVQGVRPRCGHQ

SEQ ID NO: 41472 - DNA, 266 bp, Panicum virgatum
  misc_feature: Ceres CLONE 2007890-R
gccggcgtcgcgttcggcctcctcttccccccggccggcgtcgccctctccctcctggcgctggttgccttcctgctcctccccccggcctttgccgcctcggtggcctggtttgccctctgcttctgggccctgcccgccgtggcgcccccggcgtgttggtgggttgccgtccgcgcgcgcttgctcttgcgcggtggcgggtcgcctggccctgctgggcgttccccctcggggccttgcggtggtggtgcggctctcttggg

SEQ ID NO: 41473 - DNA, 388 bp, Panicum virgatum
  misc_feature: Ceres CLONE 2007891
  misc_feature: Encodes the peptide sequence at SEQ ID NO. 41474
tcttgttacttgggcaacaccaaggctcggtgaggacaaggtgaaacaatgtgttgatccaagattaaatggagagtaccctccaaagggtgttgccaagcttgcggcagtggcagctctctgcgttcaatatgaatctgagttcagaccaagcatgagcattgtagtcaaggcattgtctccccttcttgtaaatgcaccctatcaggtggcggctgctcctgatacaccttcagaagcctgacaaaacgttcaactcaaatcatgtaaagaaatagcatttgtttctcggtgtaccaattttatcaattatttgtcttttatacatctgaattatgtgtgtgtttactatagaggaagggaagaaaggagtaatgcattttttttt

SEQ ID NO: 41474 - protein, 80 aa, Panicum virgatum
  misc_feature: Ceres CLONE 2007891
  misc_feature: SWISSPROT Homolog: EC 2.7.11.1 Non-specific serine/threonine protein kinase
LVTWATPRLGEDKVKQCVDPRLNGEYPPKGVAKLAAVAALCVQYESEFRPSMSIVVKALSPLLVNAPYQVAAAPDTPSEA

SEQ ID NO: 41475 - DNA, 691 bp, Panicum virgatum
  misc_feature: Ceres CLONE 2007903
  misc_feature: Encodes the peptide sequence at SEQ ID NO. 41476
aagacacaaggcaagagcttgatcacacgcatatctaccacaagcatataaaaatcgtcaggccggcgggcagccatggacgctgctaaggtcgcagggtgtttcaaggacaggaccatcctcatcaccggctccaccggcttcctgggaaaactgctggtggagaagatcctgcgagttcagccgggcgtgaagaggctctacctgctggtgcgggcgcccgacgacgcggctgcccacaagcgtgtgctccaagagattgtagggaaagagctgttcagcgttctgcgggagaaacacggagctgccttccagtccttggtccaagagaaggtatcccctttggccggggacatgacacacgagggtcttgggcttgagagcacccgggccaagcaattggctgaggaggtcgacatcatcgtcaacggagctgcgatcactaatttctacgagagcaggtatgatgttgccatggcatccaacaccttcggagccgttcacgtatgcaacttcgcaaagcagtgctctaatctcaagttgctccttcatatttccaccgcttatgtagccggtaataagcagaaaggccggatactggagaaaccgctgcagatgggtcgagcgctggagaagggtcgccgcatcgacattgaagcagagctcgagttagctaacgaggtcaaagaga

SEQ ID NO: 41476 - protein, 205 aa, Panicum virgatum
  misc_feature: Ceres CLONE 2007903
  misc_feature (17)..(203): Pfam Name: NAD_binding_4 Pfam Description: Male sterility protein
  misc_feature: SWISSPROT Homolog: EC 1.2.1.31 L-aminoadipate-semialdehyde dehydrogenase
MDAAKVAGCFKDRTILITGSTGFLGKLLVEKILRVQPGVKRLYLLVRAPDDAAAHKRVLQEIVGKELFSVLREKHGAAFQSLVQEKVSPLAGDMTHEGLGLESTRAKQLAEEVDIIVNGAAITNFYESRYDVAMASNTFGAVHVCNFAKQCSNLKLLLHISTAYVAGNKQKGRILEKPLQMGRALEKGRRIDIEAELELANEVKE

SEQ ID NO: 41477 - DNA, 1339 bp, Panicum virgatum
  misc_feature: Ceres CLONE 2007904
  misc_feature: Encodes the peptide sequence at SEQ ID NO. 41478
atcccagtccacactccacacccacgcactcgcatccctctccctaaccgccgccgccgccatgtcgggttgggacgagggcgccgtgttctacagcgaccaggcgcaattcccccgcggcggccctggcggcgacccagccgccgacctcagccgccactccgctctccgcaagttcaaggagttcctccgcggcttcaccggccccaccggcgacttcccctaccgtgagagcctagtacacaaccgcgaccatgtcaccgtcgccatcgaggacctagatgccttcgacgccgagctctccgataggatccgcaagtcgcccgctgattatcttccgttgtttgagacggctgcagccgaggttctcgcaagcctccgttcgaaggtcgccggcgagaccggggagatggaggagcccgtcaccggagatgtccagatcttcctctcctccaaggagaagtgcctgtccatgagatcgattggggcagattacatgtcgaagctggttaagattgcgggaattgcaattgctgcatctagagtgaaagccaaggccacccatgtaactcttctctgcaagaactgccggagtgtcagaacagtatcttgcaggccaggccttggcggggctattgttccacgatcgtgtgatcatgttcctcagcctggagaagagccttgccccctggacccctggattcctgtcccagataagagcaagtatgtcgatctccagaccctcaaattgcaggagaatcctgaggatgttccaactggtgagcttcctagaaatatgcttctgtctgtagataggcaccttgttcagacaattgttccagggactagattaactgttgttggcatctacagcgtctaccaagcatccgcaaaccagaagtgcgctgttggtgttaaacagccttacattagagttgttggtttggagcaatctcgagacaataattcaaatggaccctccaatttcactcttgacgaggaaatggaattcaaagaatttgcacagaggccagatgcatatgccaagctttgctcaatgattggcccttcaatttatggtcattctgatgtcaagaaagctattgcatgcttgttatttggggggtctaagaagaggctacctgatggtgtacgtttgagaggggacattcatgtcttgcttctgggtgatccatccacagcaaaatcacagttcctcaaattcgtagagaagacagctcccattgcagtctatacgtccggaaaaggttcctctgctgctggtctcacggcatctgtaacgcgggatagtagctcgcgcgagttttatttggaagga

SEQ ID NO: 41478 - protein, 425 aa, Panicum virgatum
  misc_feature: Ceres CLONE 2007904
  misc_feature (313)..(425): Pfam Name: MCM Pfam Description: MCM2/3/5 family
MSGWDEGAVFYSDQAQFPRGGPGGDPAADLSRHSALRKFKEFLRGFTGPTGDFPYRESLVHNRDHVTVAIEDLDAFDAELSDRIRKSPADYLPLFETAAAEVLASLRSKVAGETGEMEEPVTGDVQIFLSSKEKCLSMRSIGADYMSKLVKIAGIAIAASRVKAKATHVTLLCKNCRSVRTVSCRPGLGGAIVPRSCDHVPQPGEEPCPLDPWIPVPDKSKYVDLQTLKLQENPEDVPTGELPRNMLLSVDRHLVQTIVPGTRLTVVGIYSVYQASANQKCAVGVKQPYIRVVGLEQSRDNNSNGPSNFTLDEEMEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDSSSREFYLE

SEQ ID NO: 41479 - DNA, 784 bp, Panicum virgatum
  misc_feature: Ceres CLONE 2007904-R
cacggctttcagaaaaagctgctgagatgctgcaaaacaaatatgttgagattagacagaaaatgagacagcaagctcacgagacagggagggccgcagcgatacccattactgtgcggcagcttgaagccatcatacgtttgagcgaatctcttgcaaagatgagattgacaagtgtggccacaccagagcatgttgaagaggcattcagactattcaacgtttccaccgttgatgctgcaagatctggaatcaacgagcatttgaacttgtcaccagaaattgcaaatgaaatcaagcaagcggaggcacaaataaaaagaagaatgggcattggaagccacatatctgagcgacggctgattgatgagctaactaggatgggaatgaatgaatccattatcagaagagcccttctgatcatgcatcaaagggatgaagtagagtacaagagggagcgccatgtgatcgtccgaaaggcttgatgacggtggatgggtggagaattcacatccatgacattgaaggcgtcctctctactgctgtgtgtataccgtcactgaaactgcctccccttcctgggaggaggacgaggcccacaggctccgcagaaggatggatgaatgaagttctggcctgtgaggagatggcaagatgtgtagccgtaccacaatagtgtgttgctgtgatcctaattttccagtgtgactgacaatgtaggcgcttagctttggagccaaggctccgaacctgtactacttactgtaacaccgttcatggttgc

SEQ ID NO: 41480 - DNA, 1494 bp, Panicum virgatum
  misc_feature: Ceres CLONE 2007908
  misc_feature: Encodes the peptide sequence at SEQ ID NO. 41481
agccgttccctgtattattattactccctcttttcccctgcttcgcggcatctactactcccctctcgtcgccggcgggcgatctctccgatcaggccccctccgccgagatcgagcgatgctccgtggcgacgggagggacgccttaattctgcgctgctgccatacgtgagatctcggggtggccatctcgcggcggcgacatgccgtctctgcagctgctgcagctgacggaccgcggacgggggcttctggcttccaggaggaggactctcgcggttgtttctggtgcgctgattgctggtggagctttggcctatgcccggtcaagccagagccagctgaagaggcgttcaggagcgggtgaagccagtgcattggccaccaatggggatgggttgagtcaaagtggtagattggctgtaacaaggcagaaaaagagtgggctcaaatctttgcatttcttaactgctatcctgctcaagaagattggtcccaatggcatgcgctaccttctaggcttgatattaacagcggtgctacgtactgctgttgggcatagattagcaagagttcaaggctttttgtttaaagcagcatttcttcggcgtgtcccaacatttacacgcttgattgtagaaaaccttatattaygtttcctccaatctacattatatcagacatcaaaatacttaacagggtctttaagtttgcgtttcaagaaaattttaacagatatcacccatgctgattactttgagaatatggtttactacaaaatgtcacatgtggatcatcgaatatcaaacccggagcaaaggattgctagtgatatcccaaagttctcttctgaactaagtgagcttgtacaggatgatctggctgcggttgcagaagggctaatatatacctggcgtctctgttcgtatgccagtccaaaatatgtgttctggattatggcatatgtactagttgctggtggggtaatcaggaaattctctccttcttttggaaagctgaaatccacggaacagcaacttgaaggagactatcgccaacttcattcgcgattaagaacacatgctgagagtgtagcattttatggtggtgagaatagagaagcatctcatatcatgcagaagtttgaggctcttgttgggcatctgaatcttgtgcgtcatgaaaactggtggttcggcatgattcaagatttctttctgaagtattttggtgccactgtggcagttgtccttattattgaaccattcttctctggcaaccttagacctgattcatctacccttggaagggctgacatgttgagcaatcttcgatatcacacaagtgtgatcatatcactgtttcagtcccttgggatcctttctatcagctccagacgttttaatatcctgagtggctatgcagaccggattcgtgagttattggatgtttcacgtggagctatctggggttcgtgataaatctttaacttac

SEQ ID NO: 41481 - protein, 424 aa, Panicum virgatum
  misc_feature: Ceres CLONE 2007908
  misc_feature (75)..(356): Pfam Name: ABC_membrane_2 Pfam Description: ABC transporter transmembrane region 2
  misc_feature (151)..(151): Xaa is any aa, unknown, or other
MPSLQLLQLTDRGRGLLASRRRTLAVVSGALIAGGALAYARSSQSQLKRRSGAGEASALATNGDGLSQSGRLAVTRQKKSGLKSLHFLTAILLKKIGPNGMRYLLGLILTAVLRTAVGHRLARVQGFLFKAAFLRRVPTFTRLIVENLILXFLQSTLYQTSKYLTGSLSLRFKKILTDITHADYFENMVYYKMSHVDHRISNPEQRIASDIPKFSSELSELVQDDLAAVAEGLIYTWRLCSYASPKYVFWIMAYVLVAGGVIRKFSPSFGKLKSTEQQLEGDYRQLHSRLRTHAESVAFYGGENREASHIMQKFEALVGHLNLVRHENWWFGMIQDFFLKYFGATVAVVLIIEPFFSGNLRPDSSTLGRADMLSNLRYHTSVIISLFQSLGILSISSRRFNILSGYADRIRELLDVSRGAIWGS

SEQ ID NO: 41482 - DNA, 557 bp, Panicum virgatum
  misc_feature: Ceres CLONE 2007908-R
  misc_feature: Encodes the peptide sequence at SEQ ID NO. 41483
ttaacttacaattcttctcctggaaattataccagcgaagcaaaaccatatagaattttctgatgttaaggtagtcacacctgcaggtaatatcttggttgatgatttgactctccgggtagaaactggttcgaatcttttgataactggtcccaatggtagcggaaaaagctctcttttccgggtccttgggggtctgtggccactggtatctggccacattgttaaacctggtgttggttcagatctaaataaggagatcttttatgtccctcaaagaccatacacggctgttggaacactacgtgaacaactaatctatcctcttacagaagatcaggagattgaaccacttacctttgatggcatggtggacctgctaaagaatgttgacctggaatacttgcttgaacgctatcctcttgataaggaagttaactggggtgacgagttgtcccttggtgagcaacaaagattgggaatggccaggttattctaccataagccaaaatttgccatccttgatgagtgcactagtgccgtgacaactgatatgg

SEQ ID NO: 41483 - protein, 63 aa, Panicum virgatum
  misc_feature: Ceres CLONE 2007908-R
  misc_feature: SWISSPROT Homolog: EC 3.6.3.28 Phosphonate-transporting ATPase
  misc_feature: Functional homolog of the protein sequence given in SEQ ID NO 50893
  misc_feature: Useful for making plants with modulated biomass
  misc_feature: Useful for making plants with modulated flowering time
MVDLLKNVDLEYLLERYPLDKEVNWGDELSLGEQQRLGMARLFYHKPKFAILDECTSAVTTDM

SEQ ID NO: 41484 - DNA, 580 bp, Panicum virgatum
  misc_feature: Ceres CLONE 2007924
  misc_feature: Encodes the peptide sequence at SEQ ID NO. 41485
atgcagctttggattccatcgaggccacaacaacgacgagttctcgtcacaagctaccttgactcaatcttctccacagccaacagccatggaggccatggaatcatcagcaaacctttttttctacgctgcgctgctttttctggcggtattgtatctcgccatcacccgacgccgcaccagccgcttgccgcccgggccgacgggcctcccactggtgggcagtctcccgttcatccacccgaacctacacgtctgcttcgctggcctcaccgcgaagcatggacctaacttctcgatccgtctgggctccaaagtggaaatcgaggtcacctccccggagttggcacacgaggtcctccgggagaaggaccctgtcttctccaaccacgtcattcccgaggcatgccacgctgactcttttgactgcgtgaaaaataacgcgggcgcacccgacggcccaaagtggcgcctgctccaacgcatctgcgcgcacgatatgctgagccccacatgtctcgaccacgtgtacggccttcacatgcgcgagttcatgtctactctgagcttcctatactct

SEQ ID NO: 41485 - protein, 163 aa, Panicum virgatum
  misc_feature: Ceres CLONE 2007924
  misc_feature: SWISSPROT Homolog: EC 1.14.13.88 Flavonoid 3',5'-hydroxylase
MEAMESSANLFFYAALLFLAVLYLAITRRRTSRLPPGPTGLPLVGSLPFIHPNLHVCFAGLTAKHGPNFSIRLGSKVEIEVTSPELAHEVLREKDPVFSNHVIPEACHADSFDCVKNNAGAPDGPKWRLLQRICAHDMLSPTCLDHVYGLHMREFMSTLSFLY

SEQ ID NO: 41486 - DNA, 1361 bp, Panicum virgatum
  misc_feature: Ceres CLONE 2007925
  misc_feature: Encodes the peptide sequence at SEQ ID NO. 41487
aatacttctttattgtcctctcttggaagccaactcaagttacccatctctcctcctcctcctctctctctctcctgttgcttgcttggtgtaaagaaaagatagcccgctttccacagcccatctctcacatcctgcttcccctccaccctacctccttttctgcccccacaaaagcaaaaacaagtttgctcgcctgcttgttagctacctccaagcagcagatcgagccaacctgcaccttcggcagatcactgtcctgccctagcccccttcttcttcgtcccaacgcatgcaaagctgaagctaccgcctgagcatcacgcggctctttgctagctagcagctagctagcccctggtgcaggttgattggaagggagagggagagaattattgagcagttggtagcagcagcagcttgcatccactatagaggccgccagggatcggcaaagggcgccctagctgccgctagaaccatgtgcgactactttcttcagaggatggagggcgaccaggccggcggggacctcaccgacatcgtccgcgccggcggcggagccatgctggccaacgccgagctgccgtccacggccgccgagtggcagctccagggggagccgatgctcttcccgccgccgccgtcgtcatcggacgcctgcgccgggggtgccgcctgcgccgacgtcttcggcgaccctttcgccgggcttggggacccgttcagcagcgactacgcatcaggcgccgacttcctggacgccatgcccgacgcgatggccaagatcggcttcgacgcggctgtcggcggcggcagcggctgcggaggtgggggaggaggcggaggaggaggcggaggcggaggccaactgctggacatgagccggaagcctctcttgccgcggggggtgcagatggcgccgtcggttggcgtgctggcgccgagggtgctgccgtcgccgctgtcgccgagggcgatacggccgtacccggcgttagccggcgacatggtcaagctcgggatcacggccgggcaggtggccgggtgcgccatcgacgccgccgtcgtgggcatgcagatgtcgtcgcctcgcgccgcgggcgggatcaagcgcaggaagaaccaagcaaggaaggtggtgtgcattccggcgccgacagcggcagggggaagacccaccggggaggtggttccttctgatctctgggcttggaggaagtacggccagaagcctatcaagggttctccctatccaagggggtactacagatgcagcagctcaaaaggatgctcagcacggaagcaagtggagcgcagtcggaccgaccccaacatgctggtcatcacctacacctctg

SEQ ID NO: 41487 - protein, 293 aa, Panicum virgatum
  misc_feature: Ceres CLONE 2007925
  misc_feature (239)..(293): Pfam Name: WRKY Pfam Description: WRKY DNA -binding domain
  misc_feature: The sequence is a functional homolog of SEQ ID NO 1026 in the 10/412,699 US patent application
  misc_feature: The sequence is a functional homolog of SEQ ID NO 534 in the 10/374,780 US patent application
MCDYFLQRMEGDQAGGDLTDIVRAGGGAMLANAELPSTAAEWQLQGEPMLFPPPPSSSDACAGGAACADVFGDPFAGLGDPFSSDYASGADFLDAMPDAMAKIGFDAAVGGGSGCGGGGGGGGGGGGGGQLLDMSRKPLLPRGVQMAPSVGVLAPRVLPSPLSPRAIRPYPALAGDMVKLGITAGQVAGCAIDAAVVGMQMSSPRAAGGIKRRKNQARKVVCIPAPTAAGGRPTGEVVPSDLWAWRKYGQKPIKGSPYPRGYYRCSSSKGCSARKQVERSRTDPNMLVITYTS

SEQ ID NO: 41488 - DNA, 777 bp, Panicum virgatum
  misc_feature: Ceres CLONE 2007925-R
  misc_feature: Encodes the peptide sequence at SEQ ID NO. 41489
cgagaggcaacagcagccgaacgtcaaggaggagcccaaggacccggcccagacgaccaccactagcacgatcaccaccacgactagtacttctccggcagcggctgtgaaagaggagacgctggcaggatcgtcagaagagctggggagagccatggatgcagcagtaggtgatgaccacagtatggaactcatggaccaagtgttcagtgagagctacaagccgatgataccggaggccggccagtccgacgacttcttctccgacctcgcggagttggagtcggatcccatgagcctaatcttctccaaggagtacatggaagcaaagccgccgagcggtggtggcgaccgtgcccaggagaaggcaataagcaaggacttggatccattcgacatgctggattggtccactactacttcttcggcagggagctcatttgagcgacaaggaaagagaggctaactgtactatataccattggcttatgtgtgcacacatacattggatcagcagcagctaataacctgaaattaagactatcacaaggtcagcggaaaaatgagagttttttttttcacttttctttttcctctttgggtccttcgcttcttattaattatcattgtatgagagagtttgggatttttggtttagatacgaaccttgtttttctaaggtttgtgtcagcttgatgttgtacctgtgcatgagatgatctactggtagcgctagctgatgaggccgggattctctctggcgtgcgcgcacgctcc

SEQ ID NO: 41489 - protein, 154 aa, Panicum virgatum
  misc_feature: Ceres CLONE 2007925-R
  misc_feature: The sequence is a functional homolog of SEQ ID NO 1026 in the 10/412,699 US patent application
  misc_feature: The sequence is a functional homolog of SEQ ID NO 534 in the 10/374,780 US patent application
ERQQQPNVKEEPKDPAQTTTTSTITTTTSTSPAAAVKEETLAGSSEELGRAMDAAVGDDHSMELMDQVFSESYKPMIPEAGQSDDFFSDLAELESDPMSLIFSKEYMEAKPPSGGGDRAQEKAISKDLDPFDMLDWSTTTSSAGSSFERQGKRG

SEQ ID NO: 41490 - DNA, 710 bp, Panicum virgatum
  misc_feature: Ceres CLONE 2007926
  misc_feature: Encodes the peptide sequence at SEQ ID NO. 41491
atcatcgcaagattagccagctcgattagctgatcgactagcttcttacagtaatcagcctgtaatggcgatcggcggcgacgcggcggggcttgtggtcgccggcgacggcgccggcgacgacaacatcatcctgaacccggagttcgacgacgggctggacagctgggcggggaacgggtgcaagatcgagctgcacgacgcgctggacgacggaaaggtgctccccgccagcggcaagtacttcgtggcggcgacggggcggaccgacacgtggaacggcgtgcagcaggacgtgaccgcgcggatgcagcgcaacctgctctacgaggccacggccaccgtgcggctccacgcgccggcgggcggcggcggcgccgccgtggcgccgtgcgaggtgcgcgccacgctcggcgtgcagacgaccgacggcaggcagcagtacctcggcgtcggcaaggcgcaggtgtcggacaaggagtgggtgcagctgcaggggaagatcctgctcaactccacgccggccaaggcgtccatctacatcgaaggcccgccggccggcgtcgacgtgctcctcgacagcttggtggtcaagcacgcgcagagggccccgccggcgccggcgccggacttcgaggtgaaccaccgtcgttcatccttgcatttggattgagttacgccactggagttgttcagtacggatgagtctt

SEQ ID NO: 41491 - protein, 202 aa, Panicum virgatum
  misc_feature: Ceres CLONE 2007926
  misc_feature (20)..(179): Pfam Name: CBM_4_9 Pfam Description: Carbohydrate binding domain
  misc_feature: SWISSPROT Homolog: EC 3.2.1.91 Cellulose 1,4-beta-cellobiosidase
MAIGGDAAGLVVAGDGAGDDNIILNPEFDDGLDSWAGNGCKIELHDALDDGKVLPASGKYFVAATGRTDTWNGVQQDVTARMQRNLLYEATATVRLHAPAGGGGAAVAPCEVRATLGVQTTDGRQQYLGVGKAQVSDKEWVQLQGKILLNSTPAKASIYIEGPPAGVDVLLDSLVVKHAQRAPPAPAPDFEVNHRRSSLHLD

SEQ ID NO: 41492 - DNA, 654 bp, Panicum virgatum
  misc_feature: Ceres CLONE 2007935
  misc_feature: Encodes the peptide sequence at SEQ ID NO. 41493
gggaacaaactcatttccccgtccccactggagaatccccctcttcctcctctcgccttcctccgggtcctccccccaaatccgcctctcccctacctcgatttcctgcccccacctcgccgtcgggtgcatccacgccgggggggtacgggccccgcaccgaacgaagaatccccctgaactgattccctcgtcgaaaggaatcgccgtctcctcctggctccgctgggggggccgggctgccgcggtctggaaggggaagaagaacggaaaaccgtccgcccgtgcttggattggtggcgtctttgggtgaaggtatgaacaatggactcaccaaaaccggaagttagttttggctcaactcataccaactcagttgcaaaccagcagcaaatggagttagctggaaacaacatgggtcctaataacggaacaaataataataacaacctaactgcaagggaacgcctacggtggaaaaatgaactggatgaaagaattggtgaaggtgttactcaacttggtggtcctgacagaacaactcctaaaggaattctgaaaattatgggtgtaccaagaataaccatataccatgtgaaaagtcacttgcagaaatacaagctaacaaagtacattcctgatgcttcagctgat

SEQ ID NO: 41493 - protein, 109 aa, Panicum virgatum
  misc_feature: Ceres CLONE 2007935
  misc_feature (48)..(99): Pfam Name: Myb_DNA-binding Pfam Description: Myb-like DNA-binding domain
  misc_feature: Functional homolog of the protein sequence given in SEQ ID NO 50243
  misc_feature: Useful for making plants with altered lignin content
  misc_feature: Useful for making plants with altered terpenoid content
  misc_feature: The sequence is a functional homolog of SEQ ID NO 384 in the 10/374,780 US patent application
  misc_feature: The sequence is a functional homolog of SEQ ID NO 426 in the 10/225,066 US patent application
MDSPKPEVSFGSTHTNSVANQQQMELAGNNMGPNNGTNNNNNLTARERLRWKNELDERIGEGVTQLGGPDRTTPKGILKIMGVPRITIYHVKSHLQKYKLTKYIPDASA

SEQ ID NO: 41494 - DNA, 722 bp, Panicum virgatum
  misc_feature: Ceres CLONE 2007938
  misc_feature: Encodes the peptide sequence at SEQ ID NO. 41495
attcacttcaactaaacatcagttgctgtacgtcatggcccaagtagtagtgttgcagctgcgccatgttctccatgagttgctgctgccacaagcatcagcagcagtctccatcctgctcatgatcatctgccctcttctggccctcctgatcgtccgccgcccattggcggcggccaccgcaagaagagctagagaacagctgctgagcaagctgccttcacccccctccaggctccccgtcatcggccacctccaccttgtcggctccctcccgcacgtcaccctccgtgacctcgccggcaagcacgccgccggcggcctcatgctcctccgcctcggcaccgtccccaacctcgtcgtgtcatccccgcgcgcagcacaggctatcatgcgcacccacgaccacgtcttcgcctcgcgccccacgaccgccatcactgacgcactcctgtatggctcgtctgacatcgccttgggcccctatagcgagcactggcgccaggccaagaagctcgtcaccacacacctcttcaccgtcaagaaggtgcactcctaccgccatgcccgggaagaagaggtgtgcctggtgatggccaagatacgggaggcggcggcagcgagcacagctgtggacatcggcgagatgatgaacacattcgccaacgacatcatcagccgcgccgtgtcgggcaagttcttcaggggcgaaggcaagaaac

SEQ ID NO: 41495 - protein, 229 aa, Panicum virgatum
  misc_feature: Ceres CLONE 2007938
  misc_feature: SWISSPROT Homolog: EC 1.14.13.68 4-hydroxyphenylacetaldehyde oxime monooxygenase
MAQVVVLQLRHVLHELLLPQASAAVSILLMIICPLLALLIVRRPLAAATARRAREQLLSKLPSPPSRLPVIGHLHLVGSLPHVTLRDLAGKHAAGGLMLLRLGTVPNLVVSSPRAAQAIMRTHDHVFASRPTTAITDALLYGSSDIALGPYSEHWRQAKKLVTTHLFTVKKVHSYRHAREEEVCLVMAKIREAAAASTAVDIGEMMNTFANDIISRAVSGKFFRGEGKK

SEQ ID NO: 41496 - DNA, 1018 bp, Panicum virgatum
  misc_feature: Ceres CLONE 2007943
  misc_feature: Encodes the peptide sequence at SEQ ID NO. 41497
attatgaatttaatcactaaccaaaattcgggttatgcattgcaaagccaatcaatacggcactcttgacaaatacctgataggtaaaaccctcggaaccggccacaactccaaagtgaagattgggttggatccaaatgtaaataagtattacgccataaagataatcaagaagagtcacccagcgtttaatctcaagaatttcaagaaagaagtagagattctctccactctcaaacatacaaacattgtaaatctcgtagagttttttgaatctgtcgagtacatcaaaaagaacaaaaaatcttatcaagtcactgccatcgtcatggatttggtcctcaacggcgatatctttaactatctcgccattgcaggtcgattccctgaagcacttgctcgcactttcttcatttctctcattcacacaatggaagatattcataaacaaggtatcacacatcgcgatttaaagctcgaaaacctcctttttgatgaagtctttaatgtgaaggttgcggactttgagcttgccactgaatataagaatgagaaaggattgattcctttgacagaacaatgtggaactccagaatattttgctccagaaattcattataaagttccttatgatggagctgctgtagatgttttcaactgtgggattattctctttttgatggtttgtggttttcaaccttttgaaagagctgatccaagaaaggataagaaatatttgtgttttgctcaaaagaattatggccctgtgtgggaatactatgagaaattaattggaaaattaagtgaagaatttaaagacttgatcaatggaatgtttgcttatcaaccagatgagagattgactctcgaacaagtgaagaaccacccttggttcaaaggacaagtggctgatgaagagaaaagaataaaaggaatgaataaaatgaagaacgtcgttgatgaagaattgagaaaagagaaagaaagagaaaacgaaaacaagataagaagagcaaat

SEQ ID NO: 41497 - protein, 327 aa, Panicum virgatum
  misc_feature: Ceres CLONE 2007943
  misc_feature (14)..(287): Pfam Name: Pkinase Pfam Description: Protein kinase domain
  misc_feature: SWISSPROT Homolog: EC 2.7.11.1 Non-specific serine/threonine protein kinase
MHCKANQYGTLDKYLIGKTLGTGHNSKVKIGLDPNVNKYYAIKIIKKSHPAFNLKNFKKEVEILSTLKHTNIVNLVEFFESVEYIKKNKKSYQVTAIVMDLVLNGDIFNYLAIAGRFPEALARTFFISLIHTMEDIHKQGITHRDLKLENLLFDEVFNVKVADFELATEYKNEKGLIPLTEQCGTPEYFAPEIHYKVPYDGAAVDVFNCGIILFLMVCGFQPFERADPRKDKKYLCFAQKNYGPVWEYYEKLIGKLSEEFKDLINGMFAYQPDERLTLEQVKNHPWFKGQVADEEKRIKGMNKMKNVVDEELRKEKERENENKIRRA

SEQ ID NO: 41498 - DNA, 626 bp, Panicum virgatum
  misc_feature: Ceres CLONE 2007947-R
  misc_feature: Encodes the peptide sequence at SEQ ID NO. 41499
acttgtttggagtacttcgctcatcgagagacgacatacttgatcagcggttccgaagatggaactgccaagatctgggactgcaagaaagggcattgtgtaaagacactgcaagtgttttcacctgttcgtacggtgtgctcccatccggttcttccagtgctaattataggttcttatgacgggtcagttcgcgtgtggaactccactaccttcaggcgtgagcgcagaattaaacttggtctcaaaggtctatcggctatagcatgtttgatgggatcaacaaggattgtgattggacattacaatggtttagcacttgcggaaattgggcgcgaggaaccaaaagcattgtaagcttattacaacggtttaacccttgcggaaatggtttagcaaaagagagaaatgaaacagttggtgccaaagctgctcgattggatgatgaaaggaaaataagattgctctgtttattactaccatttgtcataggtcattgctggagtccgaagcacaaaatgtttgctaatgagttaatgttagttggaggcttccagcactggatgttttgtcgatctgatgtcatattttatatgtgcactctaaaccatacattccataagtgc

SEQ ID NO: 41499 - protein, 118 aa, Panicum virgatum
  misc_feature: Ceres CLONE 2007947-R
  misc_feature (31)..(68): Pfam Name: WD40 Pfam Description: WD domain, G-beta repeat
  misc_feature: SWISSPROT Homolog: EC 2.7.11.7 [Myosin heavy-chain] kinase
TCLEYFAHRETTYLISGSEDGTAKIWDCKKGHCVKTLQVFSPVRTVCSHPVLPVLIIGSYDGSVRVWNSTTFRRERRIKLGLKGLSAIACLMGSTRIVIGHYNGLALAEIGREEPKAL

SEQ ID NO: 41500 - DNA, 1470 bp, Panicum virgatum
  misc_feature: Ceres CLONE 2007947
tacagatgactgggttgctttctatatagggatgaagcatgtgacagcaaagtatttttcttttgatggcaatggaattttgttaccacagacgaagttgaaaattgattacagaagggtaccacacaaggtggtaccagcaaacgtgcgggccaaggaatcagctattgtgtatagcaccatcgtgtgcccgggtttcaagagccacaacgtcacggcggatttgttcaaggatccaactaatggtagattagttcaaaaggtggagctgccaatgttctttgcagcacgacatggaattcagccttgggaagtcatgccatatgccattccatctgtgtctccagcaagcaaacaggatttttcaaagcccacggaaataaactctcagatacgcacgccttcatcgattaagctaatccatgtcgatcccatggaattcagcttgcccttggagccaaagagagtgaaattcttaatgaagatactaaacattacagataattatgttgctttccttataaggtacacccgcgataaggtggatcagtatgaatctactccgcaagaaggaattctgccaccacggtctatgttggtagttgaaaacacaagaatatcacaagagggagaacatgaggatgtgcaaggtcatgagttcgtctatgtggacagcactgtggtgaccaaaagtttccgcattagcgagatcacgtatgacctgttcgatgtaccgtcggccgatagattacaacatgaggtgaaactgccagtttttcttgtagcatcaggtgaatcgaagtcgtgggaggttacttcttcagcgtttccagtgagcaagcagaatattgagaaggaatttgataggctgcagttaactacagacgaccaagatgataaaaattctctgttgatggggtaagattgatttattggtggatttattgaagtgtgatgcttatctacaattgatattgcaacaactaggctacacacctctgcacgccgtacattggagtgcaaatctgggttgacgtggctgaataccatagatgtgcatccaacagagccatggattattacgacccaggatgacctttatgttcgaatctggaactacgaaacgcagatacgcacgtctaccacgattaagctaatcgaggtctttcccttggagttcagatggcccttggagaaaaaagaagtgagattcctgatgagcatagaaaacattacagatgactacgtcgcattcctttttcggtacaccataaacaaggtgcatcactatgaagcatgtccgcaaaaaggacttctgttaccacggtcgaagttcatagttgttcacacaataatatcacaagaggggcaacctgaagacttgcatgataaggggttcatctatgtggacagcaccgtcgtgaacaaaagtttcaagaccagcgagatcaaaccagatctgttcgatgt

SEQ ID NO: 41501 - DNA, 677 bp, Panicum virgatum
  misc_feature: Ceres CLONE 2007948
  misc_feature: Encodes the peptide sequence at SEQ ID NO. 41502
agcagtagaggacaaccctttccacctgcaccggcacttgcagcgagcccatccagcaacccacgccgatggcctcgccagcgatggtcccgctgcggcagctcttcgtcgacggcgagtggcgcgcgcccgcgcagggccggcgcctccccgtcgtcaaccccgccacggaggcccacatcggcgagatcccggcgggcacggcggaggacgtggaggccgcggtggccgccgcgcgggcggcgctcaagaggaaccgcggccgcgactgggcgcgcgcgccgggggccgtccgggccaagtacctgcgtgccatcgccgccaagataattgagaggaaagctgagctggctaagctagaggcacttgattgtgggaagccttatgacgaagcagcatgggacatggatgatgttgctgggtgctttgagtactttgcggatcaggcagaagccttggacaaaaggcaaaattccccagtttctcttccaatggagacttttaaatgccatcttcggagagagcctatcggagttgttgggcttatcagcccttggaactatcctctcctgatggctacatggaaggtagctcctgctctggctgctggttgtacagctgtgctgaaaccatctgaattggcatctgtgacttgcttagagcttgctgatgtctgt

SEQ ID NO: 41502 - protein, 202 aa, Panicum virgatum
  misc_feature: Ceres CLONE 2007948
  misc_feature (18)..(202): Pfam Name: Aldedh Pfam Description: Aldehyde dehydrogenase family
  misc_feature: SWISSPROT Homolog: EC 1.2.1.8 Betaine-aldehyde dehydrogenase
MASPAMVPLRQLFVDGEWRAPAQGRRLPVVNPATEAHIGEIPAGTAEDVEAAVAAARAALKRNRGRDWARAPGAVRAKYLRAIAAKIIERKAELAKLEALDCGKPYDEAAWDMDDVAGCFEYFADQAEALDKRQNSPVSLPMETFKCHLRREPIGVVGLISPWNYPLLMATWKVAPALAAGCTAVLKPSELASVTCLELADV

SEQ ID NO: 41503 - DNA, 740 bp, Panicum virgatum
  misc_feature: Ceres CLONE 2007957
  misc_feature: Encodes the peptide sequence at SEQ ID NO. 41504
atcaatcacccactcccagcagcctctgtctcttcacctgacccggccatggactccactgccgcgctcgcgctcctcctggccgcagcggcgtacctctacctcgccgccctgcgccgccgcggcaccaacaacaacctcccgccggggcccaggggtctgccgctcgtgggcagcctgccgtcgctggacccgcagctgcacgcctacttcgcgcgcctcgccgcccggtacggccccatcttctccatccgcctcggctccaagctcggcgtcgtcgtcacctcccccgccctcgcgcgggaggtgctccgcgaccaagacctgctcttctccggccgcgacgtccccgacgccgcgcgctccatctcctacggcggcggccagaacatcgtgtggaaccccgtcggccccacctggcgcctcctccgccggatctgcgtccgggagatgctcagccccgcggggctcgacagcgtgcgcgcgctccgggaacgggagttccgggccacgctccgtcacctccacgcgcaggccgccgccgccgcccccgtcgacgtcggcgcgcagatgttcctcaccaccatgaacgtcatcaccggcacgctctgggggagcaccgtcggcagcgacgccgagcgcgccgccgtcggcaaggagttcgggcacctcgtcgccgagatcaccgagatgctcggcgcgcccaacgtgtccgacttcttcccggcgctcgcgcgctt

SEQ ID NO: 41504 - protein, 230 aa, Panicum virgatum
  misc_feature: Ceres CLONE 2007957
  misc_feature: SWISSPROT Homolog: EC 1.14.13.88 Flavonoid 3',5'-hydroxylase
MDSTAALALLLAAAAYLYLAALRRRGTNNNLPPGPRGLPLVGSLPSLDPQLHAYFARLAARYGPIFSIRLGSKLGVVVTSPALAREVLRDQDLLFSGRDVPDAARSISYGGGQNIVWNPVGPTWRLLRRICVREMLSPAGLDSVRALREREFRATLRHLHAQAAAAAPVDVGAQMFLTTMNVITGTLWGSTVGSDAERAAVGKEFGHLVAEITEMLGAPNVSDFFPALAR

SEQ ID NO: 41505 - DNA, 664 bp, Panicum virgatum
  misc_feature: Ceres CLONE 2007962
  misc_feature: Encodes the peptide sequence at SEQ ID NO. 41506
agtacccggaggagtagccgccgccgcgaacacaggagcagcgggaacatacaggaccggcaagatgcagatcttcgtgaagacgcttactgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaatatccagaaggagtccacgctccacctcgtgctcaggctccgtggtggaattattgagccctcgctgcaggcgctcgcgcgcaagtacaatcaggacaagatgatctgccgcaaatgctacgcacgcctgcaccccagggccgtcaactgccgcaagaagaagtgtggtcacagcaaccagctgaggcccaagaagaagatcaagaactgaggtgtgttgctgctaatcagtttcatcgaccgtttaaatcaactgttgtagtggtgtatcgtatgctatgttgtgttgtgttgttgtccggatgttgaaccgtgtttttttagccaaacttttcggcctgccgtgatgtttcaccttgttgtcgatgatgacacttatatatggcaatacatgcaactatgctcttgcaattttgtggtc

SEQ ID NO: 41506 - protein, 129 aa, Panicum virgatum
  misc_feature: Ceres CLONE 2007962
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRPKKKIKN

SEQ ID NO: 41507 - DNA, 779 bp, Panicum virgatum
  misc_feature: Ceres CLONE 2007973
  misc_feature: Encodes the peptide sequence at SEQ ID NO. 41508
ctccgtctgtccctctcgcttcctcccagttccaacttccaagaacccgtgaagtgaagtggaagaggtgggcggaactccggcgagatgatcgcccgcggcctcctcagatccagtgccgccgcctcgcagtttagcaggctggtgaaatatgtagctactgctggaagcttgcaaggaacacacaattttgcagaggaacctgccagatactacagctctgaaccttcacttcaggaaatagaggaaaatgggtttaaggggcatagcatgctggctccattcacagctggatggcagagcaccgatttgcatccgcttgttatagagagatctgagggctcttacgtttatgacatcaatgggaagaagtatatagatgctcttgcaggactgtggtgtacagctttaggtggtaatgagcctcgattggtcaaagctgcaactgagcaactaaacaaattaccattctaccattccttttggaaccgtacaaccaaaccctcattggatcttgcaaatgaaattctcagcatgttcactgcaagggaaatgggcaaagtattcttcacaaatagtggttcagaagcaaatgactctcaggttaaattagtgtggtattataacaatgcactaggcagggcaaacaagaagaaatttattgctcggtcaaaatcatatcatggatcaacgttaatagcagctagtctatcaggtttgcctgcacttcatcagaggtttgatctaccaagcaccttttggtctgcacacagactgcc

SEQ ID NO: 41508 - protein, 230 aa, Panicum virgatum
  misc_feature: Ceres CLONE 2007973
  misc_feature (79)..(230): Pfam Name: Aminotran_3 Pfam Description: Aminotransferase class-III
  misc_feature: SWISSPROT Homolog: EC 2.6.1.62 Adenosylmethionine--8-amino-7-oxononanoate transaminase
MIARGLLRSSAAASQFSRLVKYVATAGSLQGTHNFAEEPARYYSSEPSLQEIEENGFKGHSMLAPFTAGWQSTDLHPLVIERSEGSYVYDINGKKYIDALAGLWCTALGGNEPRLVKAATEQLNKLPFYHSFWNRTTKPSLDLANEILSMFTAREMGKVFFTNSGSEANDSQVKLVWYYNNALGRANKKKFIARSKSYHGSTLIAASLSGLPALHQRFDLPSTFWSAHRL

SEQ ID NO: 41509 - DNA, 666 bp, Panicum virgatum
  misc_feature: Ceres CLONE 2007974
  misc_feature: Encodes the peptide sequence at SEQ ID NO. 41510
ctagcctccattccccaccccgccgctcccaaaccctacccagccgccgccgtcgccgccgccctgcgcggaggcgaccccccaccgccgccaagatgcagatcttcgtgaagaccctgacggggaagaccatcacgttggaggtggagtcctcggacaccatcgacaacgtgaaggccaagatccaggacaaggagggcatcccgccggaccagcagcggctcatcttcgccggcaagcagctcgaggacggccgcacccttgccgactacaacatccagaaggagtccaccctccacctggtgctccgcctccgcggtggcgccaagaagcgcaagaagaagacgtacaccaagcccaagaagatcaagcacaagcacaagaaggtgaagctcgccgtcctgcagttctacaaggtcgacgacgccaccggcaaggtcacccgcctccgcaaggagtgccccaacgccgactgcggcgcgggcaccttcatggccaaccacttcgaccgccactactgcggcaagtgcggtcttacctacgtctacaaccagaaggcgtaatcgcttgcatcgctttgcttagatttacccgtctacctatcatgaatcgagctgttggttactcgaattgaatatcatttagatctgtctgaggttgaaactc

SEQ ID NO: 41510 - protein, 155 aa, Panicum virgatum; identical to SEQ ID NO: 14149
  misc_feature: Ceres CLONE 2007974
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency

SEQ ID NO: 41511 - DNA, 685 bp, Panicum virgatum
  misc_feature: Ceres CLONE 2007977
  misc_feature: Encodes the peptide sequence at SEQ ID NO. 41512
actattcgtctttggtcgtcgccttcttggagttccccaagcctccaaatccgccgagaaggaagccaggagcagcaagtcgccgagaagaggagagatggcccgtacgaagcagaccgcccgcaagtccaccggagggaaggccccccgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcaccatcatgcccaaggacatccagctcgcccgccgcatccgcggcgagcgcgcctaagccgccgccgccgccgtaccagtaggggagagggggtcaagatggaatcggcttgttgatctgccccccgccgcgcgtagtggatctcggtttggttagtgtaaaaacaggtttacaagtcttactttgtgctccgctcctattttggcttcgcttcgagatgaagctagcttgtta

SEQ ID NO: 41512 - protein, 136 aa, Panicum virgatum; identical to SEQ ID NO: 9871
  misc_feature: Ceres CLONE 2007977
  misc_feature (58)..(132): Pfam Name: Histone Pfam Description: Core histone H2A/H2B/H3/H4

SEQ ID NO: 41513 - DNA, 1247 bp, Panicum virgatum
  misc_feature: Ceres CLONE 2008001
  misc_feature: Encodes the peptide sequence at SEQ ID NO. 41514
atcccggcgggctccaagctgttagcttcaccattcaccaaacagtggttcctccaatggatctcgctctcctcctagcgctcatggccatcgtcatcccagtgctcctccatctcctgacgagagccagcaagccacggccgggcacggccaagctgccccccggctccctgggcctgccggtgatcggccagagcctcgacctcctccgtgccatgcgcgccaacaccgccgagcagtggattcaggcccgcgtcgaccggtacggcccggtgtccaagctgtcgctcttcggcatccccacggtgctgctcacggggtccaagggcaacaagttcctcttcttcaacccctcgctggcgtcgcagcagccccagtccgcgcagcggataatcggggagaggaacatcctcgagctcatgggcgccgaccacaagcgcgtccgcggcgcgctcctcgagttcctcaagccggacatgctcaggctgtacgtgggcaagatcgacgacgaggtgcgccgccacctcgacgagaactgggccggccgccggaccgtcacggtcatgcccctcatgaagaagctcaccttcgacatcatctccctgctgctcttcggcctcgagggaggcgccgtccgggacggcctcaaccgcgacttcgaccacgtcatggatggcatgtggtccgtccccgtggacctgccgttcacggcgttccgccggagcctcaaggccagcgccagtgctcgccgggtgctcgccgggatcacgcgggagaccaaggccaagctgcagcggggcgaggcctcccggaacagcgacctcatcgcgtgcctgctcagcttgaccgacgacagcggcgcgccgctgctgagcgaggaggagatcgtggacaacgccatgctctccctcatcgccggccacgacacgtcctccatccttctcaccttcctgatccgccacctcgccaacgatcctgacacgctcgccgccatggtccacgagcacgaggaggtcgccaagagcaagggcgacggcgaggccctgacctgggaggacctgatgaagttgaagctcacgtggcgcgccgcgcaggagatgctccgcctggtgcccccggtcctcggaaccttcaggagagccaccgaagacctcgagttcgacggctacctcatccccaaagggtggcaggtgatgtggatggcgcccacgacgcacaaggacgggagcatcttccccgagccggac

SEQ ID NO: 41514 - protein, 396 aa, Panicum virgatum
  misc_feature: Ceres CLONE 2008001
  misc_feature (35)..(396): Pfam Name: p450 Pfam Description: Cytochrome P450
  misc_feature: SWISSPROT Homolog: EC 1.14.13.77 Taxane 13-alpha-hydroxylase
MDLALLLALMAIVIPVLLHLLTRASKPRPGTAKLPPGSLGLPVIGQSLDLLRAMRANTAEQWIQARVDRYGPVSKLSLFGIPTVLLTGSKGNKFLFFNPSLASQQPQSAQRIIGERNILELMGADHKRVRGALLEFLKPDMLRLYVGKIDDEVRRHLDENWAGRRTVTVMPLMKKLTFDIISLLLFGLEGGAVRDGLNRDFDHVMDGMWSVPVDLPFTAFRRSLKASASARRVLAGITRETKAKLQRGEASRNSDLIACLLSLTDDSGAPLLSEEEIVDNAMLSLIAGHDTSSILLTFLIRHLANDPDTLAAMVHEHEEVAKSKGDGEALTWEDLMKLKLTWRAAQEMLRLVPPVLGTFRRATEDLEFDGYLIPKGWQVMWMAPTTHKDGSIFPEP

SEQ ID NO: 41515 - DNA, 626 bp, Panicum virgatum
  misc_feature: Ceres CLONE 2008010
  misc_feature: Encodes the peptide sequence at SEQ ID NO. 41516
ctggtgactagggaccgcggcgataagctcgccgagcacaagaagtactttgcccggaccgacaacagcggccaccagttccgcactctcgaggaggttattgagtatgtcaagccgactgccctcgtcggcctgactgccacccatggcgtcttcaccgagtccgttgtgcgcgccctcaaggcgtcggttgacgctggcggtctcggccgtagacccatcctgttccctctcagcaaccccctcaccaaggctgagtgcaccttcgagcaggccgtgacgtggaccgacggcaccgtcatcttcgcctccgggtcgcctttctcgtcgttcaccgtcaagtctagcgagcagcccgtgacgtactaccccaaccagggcaacaacgtctacgtcttccccggcatcggcctcggcgccatcctctccaagtctagccgtgtgaccgacaacatgatctacacctcggccgcggctcttgctggctcgctcaacgccgaggaggtccagaagggtctcatctaccctcggatcgagcgtgtccgcgatgctagcttgatcgtggctcgtgaggtcatgaaggcctcgcgccgcgacggcgtcagccagctgcccgaagagcaatg

SEQ ID NO: 41516 - protein, 208 aa, Panicum virgatum
  misc_feature: Ceres CLONE 2008010
  misc_feature (1)..(197): Pfam Name: Malic_M Pfam Description: Malic enzyme, NAD binding domain
  misc_feature: SWISSPROT Homolog: EC 1.1.1.40 Malate dehydrogenase (oxaloacetate-decarboxylating) (NADP(+))
LVTRDRGDKLAEHKKYFARTDNSGHQFRTLEEVIEYVKPTALVGLTATHGVFTESVVRALKASVDAGGLGRRPILFPLSNPLTKAECTFEQAVTWTDGTVIFASGSPFSSFTVKSSEQPVTYYPNQGNNVYVFPGIGLGAILSKSSRVTDNMIYTSAAALAGSLNAEEVQKGLIYPRIERVRDASLIVAREVMKASRRDGVSQLPEEQ

SEQ ID NO: 41517 - DNA, 1310 bp, Panicum virgatum
  misc_feature: Ceres CLONE 2008013
  misc_feature: Encodes the peptide sequence at SEQ ID NO. 41518
ccttccatttcaagcccaagccccccgtagcttccaccaggttgaccagctccaagggcttggagagaagccggcacaagcaagccgtgtcaacacacggatcaaacgagagcttagaagaggcagccgaggggatcaacaggggagcggagccggaggcctgtggagaagagggcctagatggacgtgaagcggtcgcggagcccgcgggctccggccgaaggcgaggacgacaagaagcgcgccggctggcgcggcggcggcggcgtccgcccggagatggtgctggtcggcttcctcctcacgctgcccctcctcttcctcgtcttcggcggccgctggggcagcggctccttcccctcgtcctccccgtctacgcccaccgtcgccgcccgcaacgtcgccgccggcggccgcggcgccacgccgcaaagcaaaaaagaaccagaagctgttactccgaagaacatctcggcaccaaccacatcatctccgtccccggacaagcttctgggaggattgctctcggcggcattcgacgaatcctcctgccagagccgctacagatcgaacctctaccggaagccatccccgttcccgctctccccctacctcgcgcagaagctgcgcaagtacgaggcctaccacaagaagtgcgggccggggaccgagcgctaccggcgcgccgtcaagcagctcaagtccggtcgcaacgccgaccactccgagtgcaagtacgtggtgtggttcccctgcaacggcctcggcaaccgcatgctcaccatcgcctccacctacctgtacgcgctgctcaccgaccgggtgctcctcacccacgtcgcgccggagcaggagggtctcttctgcgagccgttcccgggcagctcgtgggtgctcccgggggacttcccggagaacaacccgcacaagctccacatcggcgcgccggagagctacgccaacatgctcaagagcggcgccgtccgcaacgacggcgaccccagcggcgtgccggcgtcgtcgctgccgccctacgtgtacctccacgtcgagcagttccagctcaagctctccgacaacgtcttctgcgacgaggaccaggcggtgctcgccaagttcaactggatggtgctcaagtccgacagctacttcgcgccggcgctgttcctgacgcccatgttcgaagcggagctcgcgaggatgttcccgcggaaggaggccgtgttcaccaccctggacggtacctcttcacccgaccaacagggtgtggggcatcatctcgagatactacgaggcgtacctgaacaggg

SEQ ID NO: 41518 - protein, 376 aa, Panicum virgatum
  misc_feature: Ceres CLONE 2008013
  misc_feature (68)..(375): Pfam Name: XG_FTase Pfam Description: Xyloglucan fucosyltransferase
  misc_feature: SWISSPROT Homolog: EC 2.4.1.69 Galactoside 2-alpha-L-fucosyltransferase
MDVKRSRSPRAPAEGEDDKKRAGWRGGGGVRPEMVLVGFLLTLPLLFLVFGGRWGSGSFPSSSPSTPTVAARNVAAGGRGATPQSKKEPEAVTPKNISAPTTSSPSPDKLLGGLLSAAFDESSCQSRYRSNLYRKPSPFPLSPYLAQKLRKYEAYHKKCGPGTERYRRAVKQLKSGRNADHSECKYVVWFPCNGLGNRMLTIASTYLYALLTDRVLLTHVAPEQEGLFCEPFPGSSWVLPGDFPENNPHKLHIGAPESYANMLKSGAVRNDGDPSGVPASSLPPYVYLHVEQFQLKLSDNVFCDEDQAVLAKFNWMVLKSDSYFAPALFLTPMFEAELARMFPRKEAVFTTLDGTSSPDQQGVGHHLEILRGVPEQ

SEQ ID NO: 41519 - DNA, 629 bp, Panicum virgatum
  misc_feature: Ceres CLONE 2008013-R
  misc_feature: Encodes the peptide sequence at SEQ ID NO. 41520
agaaggcgctggcggagatctacttgctgagctactgcgacaagatcgccatgagcgcgtggtccaccttcgggtacgtggcctacagcttcgccggcgtgaagccgtggatcctgctccgtccggactgggacaaggaggtctccgcggtggcgtgcgtccggtcggcgtccgtggagccgtgcctgcactcgccgccccagctcgggtgccgggccaggagggacgtcgacgcggccgccgtcaagccctacgcccggcactgcgaggacgtccagttcggcctcaagctgttcgacacctaactctctgagtggcggctgcttgatccgaatccgattcctctttcagaatcagaactgcgtcgtcccctgtggtgtgtggagtacgagtaattaggcaggccttttggagaattcgttgtattcgtttccggtaccgtaccgacctgtacaagtggaagttgcagagatgggtttctacaacgtattcaaattcgttcgtcataaaacaatttgcaaatagccaaatacttctatgtacaaacagagcctggtagaaatttactccggctttcatcatcaattcatcatcgtgcatttaccaactcaaatataaaattgttcctt

SEQ ID NO: 41520 - protein, 100 aa, Panicum virgatum
  misc_feature: Ceres CLONE 2008013-R
  misc_feature: SWISSPROT Homolog: EC 2.4.1.69 Galactoside 2-alpha-L-fucosyltransferase
  misc_feature: Functional homolog of the protein sequence given in SEQ ID NO 51485
  misc_feature: Useful for making plants with altered cell wall content and/or composition
  misc_feature: Functional homolog of the protein sequence given in SEQ ID NO 51633
  misc_feature: Useful for making plants with altered carbohydrate content
KALAEIYLLSYCDKIAMSAWSTFGYVAYSFAGVKPWILLRPDWDKEVSAVACVRSASVEPCLHSPPQLGCRARRDVDAAAVKPYARHCEDVQFGLKLFDT

SEQ ID NO: 41521 - DNA, 1423 bp, Panicum virgatum
  misc_feature: Ceres CLONE 2008015
  misc_feature: Encodes the peptide sequence at SEQ ID NO. 41522
gagcactagtactagctcatcagcgccggcgacctcaccgcccgcgacgggacgcttcttgccgtcggcccaccttccttcggagacatctcatcgagcggttgatccgacgcccgcgccatctctgctctatgctagcaccgggccggcgctggagagggggtatttggacctagcttcacttgtccggattgtgcttctggtttagttccgactcttcctcctcgccgcacgaggcgaaatccacctgaggtgcggtcgcagtttatttcccaagaatttgtggggttcaactgaacctctatgccccacgttgagtccgccgctgcttcggacgggccgccgccacaggacgcatggcacgccgagtttcaacgcctcgtcccgctgtgggagtcgctgcgcgagacatccaaggtcattataccaatttcaatatctagggtgaaccagtttgatgctgcaaggctagatgttgagatgtctgccatgttgaaagagcagctagtcaaagtgttctccttaatgaagccaggactcttattccaatatgagcctgagctcgatgctttcctcgaattcctcatctggaggttctcaatttgggttgacaagccaaccccaggcaatgcactgatgaacctaaggtatagagatgagcaggctgcacccatcactggaaaagaagtaagaacaggtttggaaggacctgggctttctgtttctcaaaagatactttattgtattagctttgtcggtggccaatatatatggtcaagattgcagtctttttctgctttccgtcgatggggtgattctgaacagagaccactagcacgccgcgcctggggtttagtgcagaatgctgaaggattgtacagagccgcttcattctgtaacctgttattgttcctttatggtggaaggtacaaaactattgtagaaagaattctgaaagcaagacttgtttacgagagtcccaacatgaatagagctgttagctttgagtacatgaatcggcagctagtttggaatgagttttcggaaatgttgcttttgcttcttccactcttaaactcatcctcagtaaagaagttccttctccccttctccaaagataactcggcaggttcttctagtgatgaagcagattgccctatatgtcggtccagtcctagcattccttttgtagctcttccatgtcaacacaggtactgctattattgtctgcgcacacggtgttcagctacgagttcttatagatgcccacgttgtaacgaggtggttcttgcaattcaaagacagggatcagtttagttaacttagtcgggttcaagaattcttgcccatgtacacagactagcccattgatattcgtactaagaagtttagatggccccatcgagaatatgcatcatgacat

SEQ ID NO: 41522 - protein, 337 aa, Panicum virgatum
  misc_feature: Ceres CLONE 2008015
  misc_feature (53)..(272): Pfam Name: Pex2_Pex12 Pfam Description: Pex2 / Pex12 amino terminal region
  misc_feature (284)..(324): Pfam Name: zf-C3HC4 Pfam Description: Zinc finger, C3HC4 type (RING finger)
  misc_feature: Functional homolog of the protein sequence given in SEQ ID NO 51634
  misc_feature: Useful for making plants with modulated flowering time
  misc_feature: Useful for making plants with modulated low light sensitivity
MPHVESAAASDGPPPQDAWHAEFQRLVPLWESLRETSKVIIPISISRVNQFDAARLDVEMSAMLKEQLVKVFSLMKPGLLFQYEPELDAFLEFLIWRFSIWVDKPTPGNALMNLRYRDEQAAPITGKEVRTGLEGPGLSVSQKILYCISFVGGQYIWSRLQSFSAFRRWGDSEQRPLARRAWGLVQNAEGLYRAASFCNLLLFLYGGRYKTIVERILKARLVYESPNMNRAVSFEYMNRQLVWNEFSEMLLLLLPLLNSSSVKKFLLPFSKDNSAGSSSDEADCPICRSSPSIPFVALPCQHRYCYYCLRTRCSATSSYRCPRCNEVVLAIQRQGSV

SEQ ID NO: 41523 - DNA, 173 bp, Panicum virgatum
  misc_feature: Ceres CLONE 2008015-R
agtaaactctgcaaattgttaggcagctgtcggccaaggatcaagagtttttctttggataaggaatttctagtattccttagtgcttataccctggtcttcggaaaaagaaaagtagggtgtctcatgcacgtgtgtaaaaaacattttgatataaaaatcataattgtggt

SEQ ID NO: 41524 - DNA, 683 bp, Panicum virgatum
  misc_feature: Ceres CLONE 2008018
  misc_feature: Encodes the peptide sequence at SEQ ID NO. 41525
cccctagcccctgttcctccccccccccacccccccacaagcgccaccgccgaatcgaatccgagacgccgatctcggattcgccgccgccgcacccagagtttgctcctcgccgtcgccgcgctctcctcctccccgccgctcgtcagccatggcaggactagcaccagagggttcccagtttgatgccaagcagtatgacaacaagatgcaggagctactgactgaagacttctttacctcgtatgatgaggtctgtgaaagttttgataacatggggctccaagagaaccttctgagaggcatctatgcttatggttttgagaagccatcagccattcagcaaaggggaattgttcctttctgcaaggggcttgatgtgattcagcaagctcagtctggaacagggaaaacagcaaccttctgttctggaattttgcagcagcttgattatggattggttgagtgccaggcattggttcttgctccaacccgtgagcttgcgcagcagattgagaaggtcatgcgtgctcttggggactatttgggtgtcaaagtgcatgcctgtgttggtggaacatctgtccgtgaggaccagaggattcttgctagtggagtgcatgttgttgtgggcacaccagggcgtgtgtttgatatgttgcgtaggcagtctctacgcccgg

SEQ ID NO: 41525 - protein, 177 aa, Panicum virgatum
  misc_feature: Ceres CLONE 2008018
  misc_feature (61)..(177): Pfam Name: DEAD Pfam Description: DEAD/DEAH box helicase
  misc_feature: Functional homolog of the protein sequence given in SEQ ID NO 51085
  misc_feature: Useful for making plants with altered alkaloid content
  misc_feature: Useful for making plants with altered lignin content
MAGLAPEGSQFDAKQYDNKMQELLTEDFFTSYDEVCESFDNMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRP

SEQ ID NO: 41526 - DNA, 719 bp, Panicum virgatum
  misc_feature: Ceres CLONE 2008035
  misc_feature: Encodes the peptide sequence at SEQ ID NO. 41527
acgtcagtgagggaccgtactgcagagcaactgcttcctccgtctccgcggtccgcccgcaagcctccaacagccagcaccaccaccagcgccattcgccacgcaacgtttgtccccaaaaattcgaaagcaatcgaagccaagccacacctgcacgtggacgacacagctctccatctccctcccgtcttctccaccgatctgctcggctcctcccgcccgacgcgcttcgtcgggaaccctagcgccggatctccgcggcggctgcggcggccgcggaaatggcgaaccccctagcggggctgcaggaccacctcaagctcgcgcgcgactacgcgctcgagggcctctacgacacctccgtcatcttcttcgacggcgccatcgcccagatcaacaagcatctaactactctggacgatgctctggttcgtacgaaatggatgaactgcaagaaagcaatctctgaagaagtggaaattgtaaaacagttagatgcccaattaaagtcccttaaagaagctcctggggtgaggcggtcctcatcacctcctattcgctccaacaaatcatttcatttccaaccgttggatgaatatccaacttcatcgccagcaccctttgatgatcctgatgtgtgggctccaccaagagatacaccaaaccgaaggtcaacaagaggtcaatctagtgcaagaaaatcctcccaagatggagct

SEQ ID NO: 41527 - protein, 145 aa, Panicum virgatum
  misc_feature: Ceres CLONE 2008035
  misc_feature: SWISSPROT Homolog: EC 3.6.4.3 Microtubule-severing ATPase
MANPLAGLQDHLKLARDYALEGLYDTSVIFFDGAIAQINKHLTTLDDALVRTKWMNCKKAISEEVEIVKQLDAQLKSLKEAPGVRRSSSPPIRSNKSFHFQPLDEYPTSSPAPFDDPDVWAPPRDTPNRRSTRGQSSARKSSQDG

SEQ ID NO: 41528 - DNA, 577 bp, Panicum virgatum
  misc_feature: Ceres CLONE 2008037-R
  misc_feature: Encodes the peptide sequence at SEQ ID NO. 41529
catcaagagggaagttggaattgaagattgcttgcacattgaatttgagtacagcaaaagcaagtaccatctcaaggatgtcattgtaggaaagatctattttcttctagtcagaataaagataaagaacatggagcttgagattcgtcggcgtgaatctacaggatctggtcctaacacatatgttgagactgagacactagcaaaatttgagctgatggatggtgccccagttagaggagaatctattccggtaagactattcttgactccttatgagctgaccccaacttaccgcaatataaataataagttcagcgtcaagtactacctgaatctagtccttgttgatgaggaagacagaaggtattttaagcagcaagagatcaccatgtatcgccttgtagaaactccagaatcttcatagatttgtgtcactgagacttgaaagcagcaagaggcacactgtgtgtttgttgcaaaagagcaccagagaaactttgaccctttcttctgcttgtacataattttcctcaagggtaatgcagtcctatgcgccatgtgatgttgctttgcc

SEQ ID NO: 41529 - protein, 141 aa, Panicum virgatum
  misc_feature: Ceres CLONE 2008037-R
  misc_feature (1)..(120): Pfam Name: Vps26 Pfam Description: Vacuolar protein sorting-associated protein 26
IKREVGIEDCLHIEFEYSKSKYHLKDVIVGKIYFLLVRIKIKNMELEIRRRESTGSGPNTYVETETLAKFELMDGAPVRGESIPVRLFLTPYELTPTYRNINNKFSVKYYLNLVLVDEEDRRYFKQQEITMYRLVETPESS

SEQ ID NO: 41530 - DNA, 741 bp, Panicum virgatum
  misc_feature: Ceres CLONE 2008037
ggagctgaaaaaaatcagccaccagaaacatccgtgaactctcattcgcgcgagaaaaatccccatccgcgctgttcctccgcccgatccccaattccaccggcggcgctcgtttggtttctagggtggccatgctagatcccgcaaatccaatccatccccaacctccaccacccagcctatgactcatggagatccttctggtcatggattgcccgtcgcccgggggtacgcccctctagcactggcgccctatctcctctgtgattggattcatggcgagccacggcaacgacgaatcgaggtggcggactggtgccacatccctgaacaggcgcgcaccatggccaaccttgctcctacggcagatccttgtggtggaagaggatcctggggtctgcatctatgacgatggtacatgcgaacaatagactctgattaaagatgccgtgggccacatcctcgacattatgggccacaaataatttgggcttctgagacagttatgggcctcagcccatccgcctcctccacagttatgccagccagaagattggatgcgccaaggcccatggactccaatttgtcaacaactaccagctctactactacggcagcaggcagcaggagggcggcagcccaccgatcccctgactgagaccagcgagcaagcgatctcctccccctcctcttccccgacgccggcgaacctgctccgacgcctcatccgggatcaccgct

SEQ ID NO: 41531 - DNA, 661 bp, Panicum virgatum
  misc_feature: Ceres CLONE 2008046
  misc_feature: Encodes the peptide sequence at SEQ ID NO. 41532
atagcgcagcaggattattagcagctcgctctcacaccagtctctcagagcctgctgcgctgctgccatggagaacggcggcgaggaaggaggcggcggcggcggggacgactacaccaaggacggctccgtcgacctccgtggcaaccccgctcgccgctccaagcgcggcggctggaccgcctgcaccttcatcgtcgtgtacgagctgttcgagcggatggcctactacggggtggcgtcgaacctggtgatgtacctgacggagcggctgcaccagggcaccgtcgaggccgccaacaacgtcaccaactggtccggcaccgtcttcctcacgccgctcctcggggccttcgtcgccgacgcctacctcggccgctactggaccttcgtcgccggatccgccgtctacctcatggggatgctgctgctgacgctggcggtttccgtgccggcgctgaagccgccgccctgcgacgtcggcggcgtcggcgccggcgccacctgcccgcgcgcctccgcgctgcagctcggcgtctacttcggcgggctgtacaccatcgcgctgggccacggcggcaccaagcccaacatctccaccatcggcgccgaccagttcgacgacttccacccgcgggagcgccgccacaagctctccttc

SEQ ID NO: 41532 - protein, 197 aa, Panicum virgatum
  misc_feature: Ceres CLONE 2008046
  misc_feature: Functional homolog of the protein sequence given in SEQ ID NO 50283
  misc_feature: Useful for making plants with altered carbon content
  misc_feature: Useful for making plants with altered nitrogen content
MENGGEEGGGGGGDDYTKDGSVDLRGNPARRSKRGGWTACTFIVVYELFERMAYYGVASNLVMYLTERLHQGTVEAANNVTNWSGTVFLTPLLGAFVADAYLGRYWTFVAGSAVYLMGMLLLTLAVSVPALKPPPCDVGGVGAGATCPRASALQLGVYFGGLYTIALGHGGTKPNISTIGADQFDDFHPRERRHKLS

SEQ ID NO: 41533 - DNA, 1424 bp, Panicum virgatum
  misc_feature: Ceres CLONE 2008049
  misc_feature: Encodes the peptide sequence at SEQ ID NO. 41534
ctcattctcaaaaaaacaaacctctcttctcctcctgctcgtgtgttcgtctaaccgcgtgccgccgctgccgccgaagacatggcgacgctcctacgccgatccgccgcgcccgcgctccagctcgtccgcgcctcgcgccacctcgccgccgcctcccccgcctcgtcccgctccttcacccgctactcccgcgacgacaccaacgctcggtacgacccgccggccacgccgatcaactggggcgtgagcatcgtcccggagaagaacgcgttcgtggtggagcggttcggcaagtacatcaagacgctcggcgccgggatccacctgctcatccccggggtcgaccgcgtctcctacgtgcactcgctcaaggaggaggccatccccatcgccaaccagtccgccatcaccaaggacaacgtcctcatacagatcgacggcgtcatctacgtcaagatagttgacccctaccttgcttcctatggtgcggcgaatccaattttcgcagtcatacaacttgcacagacaacaatgaggagtgagcttgggaaaatgacattggacaagacctttgaggagagagatgcattaaacgagaacattgtgagggccatcaatgaggccgcaacagattggggcctgaagtgtctccgttatgaaatcaaggacatatctcctccaaatggtgttaaggcggctatggagatgcaggttgaagcagaaaggaaaaaacgtgcccaaatccttgaatcggaagggaaaaaacgtgcccaaattcttgaatcagaaggtgaggctggagcggttcttgccttagctgaagcttcagctcgtggaattagattggtttcagaggctatgacaactaaaggcagtgctgaggctgcgaccctgagagtggcagagcaatacgtcagagccttctctcaagtggccaaaaagggcaacactattctgcttccaggtgacggtggcaacccttcatcttttgtggccacggctttcaagatctaccagcgactccaggccaacagctcccaggtagaagagctggaggaatcaggaggagagactgagacaagtgagatgccaccactcatcccggatatagatcctgagaagtcgctgcatagtggcaagaacaaggcttagttgtgctcgagtgcctgaaggaagtccccttttttgtttttgctgtctccattgttctgcaaacatgggagcgtcactgataatataccagtagcattttagttttctgagtcagagagttgtgcattggtttcagagtcagactgtcagagagtttagcgagcagggagaaagattttgattctgagatgaggtacagggtttgttaatctgatggtagtttgtaaaaatgcaaggttggggttaatgtgatggcaacgttttcgttc

SEQ ID NO: 41534 - protein, 357 aa, Panicum virgatum
  misc_feature: Ceres CLONE 2008049
  misc_feature (57)..(229): Pfam Name: Band_7 Pfam Description: SPFH domain / Band 7 family
MATLLRRSAAPALQLVRASRHLAAASPASSRSFTRYSRDDTNARYDPPATPINWGVSIVPEKNAFVVERFGKYIKTLGAGIHLLIPGVDRVSYVHSLKEEAIPIANQSAITKDNVLIQIDGVIYVKIVDPYLASYGAANPIFAVIQLAQTTMRSELGKMTLDKTFEERDALNENIVRAINEAATDWGLKCLRYEIKDISPPNGVKAAMEMQVEAERKKRAQILESEGKKRAQILESEGEAGAVLALAEASARGIRLVSEAMTTKGSAEAATLRVAEQYVRAFSQVAKKGNTILLPGDGGNPSSFVATAFKIYQRLQANSSQVEELEESGGETETSEMPPLIPDIDPEKSLHSGKNKA

SEQ ID NO: 41535 - DNA, 689 bp, Panicum virgatum
  misc_feature: Ceres CLONE 2008071
  misc_feature: Encodes the peptide sequence at SEQ ID NO. 41536
agcgcttgcccctcgtcacgcgccccctccacaacccccgatgcgatgggtgcccctgcccctcgatagccgcgccgctctcctgcccccgttccccatttgcctcctcgcccgcctccctgacctagcgccgccgccgccgcatcgaaggcctcgccgccgccctgcggcctccggaggtggtgccggcgcgcgatccgccgcggcgtccgttggtccggcttcgattcgtcggcgcggggagtatgcctctgatacaagtgcgctgaagatgaaggagaggagctctttatgtgatagcgcagcagatggaaactggggtttgaaatacaaaaggaaaagaagcaagctaacagttagtccatctaacgaaaatgaggctacctcaccaacatcagactctccaaggggctatggttccaccaaaaagaagctgaaacatgaccctaacatttctccatctgccaagaagataagagggaacgatgggtatttctatgagtgtgtagtatgtgatcttggtgggaatctgctctgttgtgatagctgtccgcgtgtttaccacttggaatgcctcaatcctcctcttaagcgtccaccccctgggaagtggcaatgtccaagatgccgtccaaaaaaaggtagcttgaagctgttaggtaatgcagaagctgacacttctaaacatg

SEQ ID NO: 41536 - protein, 139 aa, Panicum virgatum
  misc_feature: Ceres CLONE 2008071
  misc_feature (77)..(122): Pfam Name: PHD Pfam Description: PHD-finger
  misc_feature: SWISSPROT Homolog: EC 2.3.1.48 Histone acetyltransferase
MKERSSLCDSAADGNWGLKYKRKRSKLTVSPSNENEATSPTSDSPRGYGSTKKKLKHDPNISPSAKKIRGNDGYFYECVVCDLGGNLLCCDSCPRVYHLECLNPPLKRPPPGKWQCPRCRPKKGSLKLLGNAEADTSKH

SEQ ID NO: 41537 - DNA, 760 bp, Panicum virgatum
  misc_feature: Ceres CLONE 2008080
  misc_feature: Encodes the peptide sequence at SEQ ID NO. 41538
attcagagctctcgcttcgaaactgaaccagcacactcagctgccgttgccgtttctagaactccctgccgttcgagatcccgctcgccacgatgcctgccctcgccaagcccgcctcgcggcccgccaagaccgccgcggcgccgaagccgaagcccgccgccgccaagcccaaggccgcggccgccgctggcgcctcgcacccgccctacttcgagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcgtacaagctctccgacgccgccaagaaggaggcgcccaaggccaagcccgctgccgccaagaccgccgcggccaagccagccaaggccgccgcgaagccgaagaagagtgccgccgccgccgccgccgccaagcccaagaagaccgccgccgccgggaccaagcgcaaggcgccggagaagaaggtcgtcgcgaagacgaagaagtcccccgcggcgaaggccaaggccaagcccaagacggtcaagtcccccgcctccaagaaggcccggaaggttgccgcatgagatggttccgtaggtcgtagctctgatcgtgggggtgtgtccctaggagttggacaaatgaagtggggcgccccaagcgt

SEQ ID NO: 41538 - protein, 195 aa, Panicum virgatum
  misc_feature: Ceres CLONE 2008080
  misc_feature (36)..(106): Pfam Name: Linker_histone Pfam Description: linker histone H1 and H5 family
MPALAKPASRPAKTAAAPKPKPAAAKPKAAAAAGASHPPYFEMIKEAITALKERTGSSSHAIAKYMEDKHGPSLPANYKKMLSIQLRGFAAKGKLVKVKASYKLSDAAKKEAPKAKPAAAKTAAAKPAKAAAKPKKSAAAAAAAKPKKTAAAGTKRKAPEKKVVAKTKKSPAAKAKAKPKTVKSPASKKARKVAA

SEQ ID NO: 41539 - DNA, 729 bp, Panicum virgatum
  misc_feature: Ceres CLONE 2008097
  misc_feature: Encodes the peptide sequence at SEQ ID NO. 41540
ctcctcctcctgctgctccgccgccgccgcacgtccaaaccccaccccgtcgcactccctcccgaaccctaaattcgcgagccgtcgccgcccgtggcccgatggggttcgtggatccggcggcgccgctgctggcgacgtgcggcggtgacacggtgaagctcttcgacgtcacggtggagtccggtgacccctgcgtcctcgcctacacccccgcgcccggcaaccccgtcaacgccgtcaagtggaaccacaccaatctaattgtagcaagcgctggggatgataagaagatctcattgtggcataaaaaaggtcaaaatgtaggacagctaccaacatccactgttgatcgtggtgatgacatagaggagtgcatttattctatcagttttagcaacaaaggttctcgatatctttgctctggtgggagtggccatattgtcagaatatgggatttgcagcggaagagatgtatcaaatggctaagcggtcacactgacacaattactggtgtaatgtataactgcaaagatgaacatttggcatcgatcagcatgaagggggatctcattcttcacaatcttgcttctggagcacgtgctgctgaacttagtgatccaaatggacaggtgttgagagtgctgggatattcacgaaacagtagacatttattggtgacagcaggagatgatggttctgtgcatctttgggatacaactgcaaagt

SEQ ID NO: 41540 - protein, 209 aa, Panicum virgatum
  misc_feature: Ceres CLONE 2008097
  misc_feature (123)..(205): Pfam Name: WD40 Pfam Description: WD domain, G-beta repeat
  misc_feature (31)..(69): Pfam Name: WD40 Pfam Description: WD domain, G-beta repeat
  misc_feature: SWISSPROT Homolog: EC 2.7.11.7 [Myosin heavy-chain] kinase
MGFVDPAAPLLATCGGDTVKLFDVTVESGDPCVLAYTPAPGNPVNAVKWNHTNLIVASAGDDKKISLWHKKGQNVGQLPTSTVDRGDDIEECIYSISFSNKGSRYLCSGGSGHIVRIWDLQRKRCIKWLSGHTDTITGVMYNCKDEHLASISMKGDLILHNLASGARAAELSDPNGQVLRVLGYSRNSRHLLVTAGDDGSVHLWDTTAK

SEQ ID NO: 41541 - DNA, 757 bp, Panicum virgatum
  misc_feature: Ceres CLONE 2008100
  misc_feature: Encodes the peptide sequence at SEQ ID NO. 41542
agagcaaaccaatcgcatgcatactatgccctaaggcggctctctcagcgagactctggtggatgccatattccaaatggctgcgagagccgccgccgccgccatgcccggcctcctcctgctcccgtttctccttgtagctgctgcttccggtgccgccaacgatgcagccagcacgccgccgatcagccggaaaagcttccctgagggcttcgtcttcgggacggcctcgtcggcctatcagtatgaaggtggttttaacgaggggggcagaggaccaagcatctgggacaccttcacccaccagcacaaagaaaaaatcgctgatggaagcaacggggatgtagcagttgactcctaccatctctacaaggaagatgtgcgcctcatgaaggacctcgggatggatgcgtacaggttctccatatcatggagcagaattcttccaaatggcagtctgagcggtggaattaacagagaaggtgtcaattactacaataatctcattaatgagctcctctccaaaggaatgcaaccctatgggacccttttccactgggacacacctcaggcattagaagataaatacgaaggatttcttagccccaatattacaatcgactacaaggactatgctgaagtctgcttcaaggagtttggtgatcgagtgaagcgctggatcaccttcaacgagccctggaccttcagctcattcggctacgcagtcggctttgcagccccaggtcggtgctcgcca

SEQ ID NO: 41542 - protein, 217 aa, Panicum virgatum
  misc_feature: Ceres CLONE 2008100
  misc_feature (29)..(216): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50483
  misc_feature: Useful for making plants with altered cell wall content and/or composition
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50360
  misc_feature: Useful for making plants with modulated biomass
  misc_feature: Useful for making plants with modulated flowering time
MPGLLLLPFLLVAAASGAANDAASTPPISRKSFPEGFVFGTASSAYQYEGGFNEGGRGPSIWDTFTHQHKEKIADGSNGDVAVDSYHLYKEDVRLMKDLGMDAYRFSISWSRILPNGSLSGGINREGVNYYNNLINELLSKGMQPYGTLFHWDTPQALEDKYEGFLSPNITIDYKDYAEVCFKEFGDRVKRWITFNEPWTFSSFGYAVGFAAPGRCS

SEQ ID NO: 41543 - DNA, 445 bp, Panicum virgatum
  misc_feature: Ceres CLONE 2008101
  misc_feature: Encodes the peptide sequence at SEQ ID NO. 41544
atgctgtacgcgctcctgctggtcgccttggcggccgtcgccgcccccgtggtgctccgccactacctcccgctgctccggggcggcctccccacgggcagcttcagctggcccttcctcggcgagagcaccggcttcctccacgcgcactcgtccaacaccggccgaggcttcctcaaggaggacgtcgccaagtacgggacggtgttgaagtcctacctgctcggctcgccggcggcggtctcatgcaacgaggagctcaaccacttcgggctgcacaccgaggagagcctgtatcgagagcagttacccctgggccatcagcactatcctcggctgagtcccttgcgttggtggtcagcggccagccccatcgccaaatccgaagcatgatcctcgccctcgttgcctccggggggctcgaggcctactacgttgccaagcg

SEQ ID NO: 41544 - protein, 130 aa, Panicum virgatum
  misc_feature: Ceres CLONE 2008101
  misc_feature: SWISSPROT Homolog: EC 1.14.13.77 Taxane 13-alpha-hydroxylase
MLYALLLVALAAVAAPVVLRHYLPLLRGGLPTGSFSWPFLGESTGFLHAHSSNTGRGFLKEDVAKYGTVLKSYLLGSPAAVSCNEELNHFGLHTEESLYREQLPLGHQHYPRLSPLRWWSAASPIAKSEA

SEQ ID NO: 41545 - DNA, 704 bp, Panicum virgatum
  misc_feature: Ceres CLONE 2008111
  misc_feature: Encodes the peptide sequence at SEQ ID NO. 41546
atcgccacccgcattcccctccctctccacgcacctctcgggctcggctccgacgagggaggaggacgccagctgccacggcacccgctcccgcgcaggccgccgccaccatgctgtccgcgcaggccggcggcggggtcgaggacccctacggcgaggacagggccaccgaggagctgcccgtcacgccctgggcctactccgtcgcgagcggttacacccttttgagggatccacatcacaacaagggtctttccttcactgagaaggagcgggatgcacactacttgcgtggccttctgcctccggcggttgtgtctcaggaactccaaattaagaagatcatgcacaacctgcggcagtaccagctccctttgcagcgctatatggccatgatggaccttcaggagagaaatgaaaggcttttctacaagcttttaattgatcatgtggaggagctgctccctgtggtttacacaccaactgttggtgaggcctgccagaagtatggttgcatctttagacaaccacagggtctgtatgtcaccctgagggacaaggggaaggtcctggaggttctaaggaactggccccagaggaacattcaagttattgttgttactgatggtgagcgaatcttgggacttggagatttgggttctcagggaatgggaattcctgtaggcaaacttgctctctacact

SEQ ID NO: 41546 - protein, 197 aa, Panicum virgatum
  misc_feature: Ceres CLONE 2008111
  misc_feature (99)..(197): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MLSAQAGGGVEDPYGEDRATEELPVTPWAYSVASGYTLLRDPHHNKGLSFTEKERDAHYLRGLLPPAVVSQELQIKKIMHNLRQYQLPLQRYMAMMDLQERNERLFYKLLIDHVEELLPVVYTPTVGEACQKYGCIFRQPQGLYVTLRDKGKVLEVLRNWPQRNIQVIVVTDGERILGLGDLGSQGMGIPVGKLALY

SEQ ID NO: 41547 - DNA, 1354 bp, Panicum virgatum
  misc_feature: Ceres CLONE 2008114
  misc_feature: Encodes the peptide sequence at SEQ ID NO. 41548
attatcctcacgtgcagtatcttcattctgatcgcgcgcacagaacatacagacacaacacactcacaccaacacacatcgcatcgcaaccatgggagagtgccccgtcgctcacaacatcgacgccaagcgcgtccccgccgccggtggcggtaccaagaacagcgactggtggcccaacgcccttcgcctcaacatcctccgtcagcaccagtccggttcgaacccctacaacgccgactttgactatgccgccgccttccagagcatcgactacgatgcgctcaagaaggacctcaccaaccttatgaccgattcccaggacttttggcccgccgatttcggccactacggtggtttcttcatccgtctcgcatggcacgccgccggtacctaccgtgttcaggacggccgcggtggcggaggtgagggccagcagcgtttcgctcccctcaactcgtggccagacaacggcaacctcgacaagggccgccgtctcctctggcccatcaagcagaagtacggcaacaagatctcctgggccgacctcttcctccttagcggtaacgtggcactcgagtcgatgggcttcaagaccttcggtttcgccggcggtcgccccgacacctgggaggccgacgagtccacctattggggtggcgagactacctggctcggcaacgatgtgcgttacgaggagggtaacaagggtggcaaccccaaggacctcaagaaccgcaacctcgaaggccatctcgccgcatcgcacatgggcctcatctacgtcaaccccgagggccccaacggcgagccagacccggtcgccgccgccaacgacatccgcaccaccttcggccgcatggccatgaacgacgaggagaccgtcgccctcatcgccggtggccacaccttcggcaagacccacggtgccggcaaccccgacctcgtcggccccgagcccaacggcgctcccatcgagaaccagggtctcggctggatcagcaagcacggctccggcaaggctggcgacgccatcacctccggcctcgaggtcatctggaccagcaagcccacccagtggtcgaacctctacctcgagtacctctacaagtttgagtgggagctcgagaagtcgcccgctggcgccaaccagtgggtcgccaagaactgcgacgccatcatccccgacccctttgacccgtccaagaagcgccgccccaccatgctcaccaccgatctgtcgctgcgctatgaccccgcttacgacaagatctcgcgtcgcttcctcgagaacccagaccagtttgccgacgcctttgctcgcgcctggttcaagctttctccaccgcgacat

SEQ ID NO: 41548 - protein, 420 aa, Panicum virgatum
  misc_feature: Ceres CLONE 2008114
  misc_feature (65)..(401): Pfam Name: peroxidase Pfam Description: Peroxidase
  misc_feature: SWISSPROT Homolog: EC 1.11.1.6 Catalase
MGECPVAHNIDAKRVPAAGGGTKNSDWWPNALRLNILRQHQSGSNPYNADFDYAAAFQSIDYDALKKDLTNLMTDSQDFWPADFGHYGGFFIRLAWHAAGTYRVQDGRGGGGEGQQRFAPLNSWPDNGNLDKGRRLLWPIKQKYGNKISWADLFLLSGNVALESMGFKTFGFAGGRPDTWEADESTYWGGETTWLGNDVRYEEGNKGGNPKDLKNRNLEGHLAASHMGLIYVNPEGPNGEPDPVAAANDIRTTFGRMAMNDEETVALIAGGHTFGKTHGAGNPDLVGPEPNGAPIENQGLGWISKHGSGKAGDAITSGLEVIWTSKPTQWSNLYLEYLYKFEWELEKSPAGANQWVAKNCDAIIPDPFDPSKKRRPTMLTTDLSLRYDPAYDKISRRFLENPDQFADAFARAWFKLSPPR

SEQ ID NO: 41549 - DNA, 567 bp, Panicum virgatum
  misc_feature: Ceres CLONE 2008114-R
acgttccagtggctcgagcccaccgccgatggcttccgcaactacggacagtcgaccgagcgcgtgcgtgcggagcagtacctggttgacaaggcgaacctgctcacgctctcgcctcccgagctcaccgtgctcattggtggtctgcgtgtgctcggcctcaactacgacggctcgtcgcacggtgtctttacgcaccgccgtggccagctgaccaacgacttctttgtcaacctgctcgacatgagcaccgagtggaaggtcgccgacggcggcaaggccgagctctttgacggcgtcgaccgcaagtcgggccagaagaagtggagcgccacgcgcgccgacctcatttttggctcgcaggccgagctgcgtgcgctcgccgagaactacgcccaggccgacaacgccgacaagttcgcaaaggactttgtccaggcttggaacaaggtcatgaacctcgaccgctacgacgtcaagaagagcaacattgcccgcgccaagttctgattcgtagatccttcgttgtggcccatgtgtaattccaagatgtgttttatctcgtgg

SEQ ID NO: 41550 - DNA, 763 bp, Panicum virgatum
  misc_feature: Ceres CLONE 2008119
  misc_feature: Encodes the peptide sequence at SEQ ID NO. 41551
gaaggggcaagagaagatgccacggctccagaagatactcaccgatctcggagacaagacagccattgtgttctgcaatactaagaagacagcggacatgcgtgctaaggatctggacaaggcaggcctccgtgtgacaaccctacatggaggaaagtcacaggaccagagagagatcagccttgatggtttcagaaaccggcggtttaatgttcttgtggctactgatgttgcagggcgtggtattgatattcctgatgttgcacatgtgattaactatgagatgcctagttcaattgacacgtacacacatcgcattggaagaacaggacgtgctggaaagaagggagtagcaacttcatttttaacgctggagaatactgacattttctttgatctgaaacagatgctcattcagagcaacagtcctgtgccacctgaacttgcaagacatgaggcatcaaaatttaagccaggctcaattcctgatagacctccaaggcgtaatgacacagtcttcgcaaatcattgaagcaacctaccccagtaggggctttgggctattatgagcacaatttctactggaaagagagggatctagattagtatttaagaggtacaaagaccatgattgttagagtcgttttaatttgtgttcggatactggctttatattgtcgtaactttagtatatcttggtgatgatgtagttatggacatgtgtatcctatcatgatctttgtgctattatgcaagttttgac

SEQ ID NO: 41551 - protein, 176 aa, Panicum virgatum
  misc_feature: Ceres CLONE 2008119
  misc_feature (37)..(113): Pfam Name: Helicase_C Pfam Description: Helicase conserved C-terminal domain
KGQEKMPRLQKILTDLGDKTAIVFCNTKKTADMRAKDLDKAGLRVTTLHGGKSQDQREISLDGFRNRRFNVLVATDVAGRGIDIPDVAHVINYEMPSSIDTYTHRIGRTGRAGKKGVATSFLTLENTDIFFDLKQMLIQSNSPVPPELARHEASKFKPGSIPDRPPRRNDTVFANH

SEQ ID NO: 41552 - DNA, 1792 bp, Panicum virgatum
  misc_feature: Ceres CLONE 2008123
  misc_feature: Encodes the peptide sequence at SEQ ID NO. 41553
gccccatctaccccttctccgcagacgacggcgagctgcgcctcggtctccagtccatcccctgcggctcaatcgagttgcaatcgccggcgtcaacggcgagctcgctacagctctccctaaggtgctgtcaacttggaggatggcagatgaggaactagctccaagctctaagaagagggttgcagatacccaaatcaacaaggataatcctgagcctgatgatgatggaccagagcaagagatgggtacattcaagaaagctagtgaggaagtaatggcaacccgaagaattgttaaggttcggcgccagcagccatcatcagcaccttcttctaatcctttctcggcaatcagatttacccccactgattctagtgcccaagaaagtgcccctgttcaagagcctcagccttcaaatgtcaaagctgatgggggcagcaatggtagtgggaaagatactttatctgtgctggacaagaatgcaggctctggtgaggtacctgagattcaaaaggatgaatcaaccgtaaatactggtgctgcaactgaagccgttgaaatcagtgatgaggcagaaggcacaaaggatggatctgttggagacaaagtggtagtaggagaacccaacaaagataacaacggatcatctgaaatcgagagcaaaacaaaaggaggagatgctgaagaaaaggaaggggcagatgaagctgagaataaagataaaattagcaaagatgataatggcaagaaagatggaggtgaatcagagaccaacaatgggttgtctgacgagcagaaagttgctgataacaaagggcagacatcatcagcaacacctcttttctccttcaagaatctgtccagtggtcaaaatgcattcacaggtctggctggaactggattttcaagctcatcattctcatttggttcagcctctaaagatgactctagtgctggtaccctatttggttcaaagactgatggttcttctttcccttcttttaatcttggtgctaacaactcagctcttgctacttcagcagaggcacccaagaaatttgctatgacagagggccctgttgaaactggtgaagaaaacgagaaggctgtatttactgctgattctgctctgtatgaatacttaaatgggggctggaaagaaagaggaaaaggtgaactgaagctgaacgtccctgtatctgttggtgagagggctcggcttgtcatgaggaccaagggcaactaccggttggtcctgaacgcaagcctctacggcgacatgtcgctcaaggacatggacaagaagggcacgacgtttgcctgcgtgaacagcatcagcgagtcgcagagcggccttgccacatttgcgctgaagttcaaggacaccgctatcagagaggagttcaaggatgcagtggaggctcacaagatgaggaaagcacatgaagcgccgctgaagacgactgagaactcgccgaaggcagcggaggtctgaagctgcacccaggttacacttgcatcctctatacgtatccaggaaggagctggagagatactatcagttaccgcgggagtgtttaagtaagaacattgtatcacgccatgatgtcctgagttgtggttcatacggttccctgttactgtttctggaacaggtggaagcctgtcgaactttcattgttacagccataatctagtaacctggagatgagactcttttggtctacatatgcttttgtattttgctactttatgctgtgtcagttaagctatgcgtgccgtgttatcc

SEQ ID NO: 41553 - protein, 451 aa, Panicum virgatum
  misc_feature: Ceres CLONE 2008123
  misc_feature (10)..(288): Pfam Name: NUP50 Pfam Description: NUP50 (Nucleoporin 50 kDa)
  misc_feature (313)..(432): Pfam Name: Ran_BP1 Pfam Description: RanBP1 domain
MADEELAPSSKKRVADTQINKDNPEPDDDGPEQEMGTFKKASEEVMATRRIVKVRRQQPSSAPSSNPFSAIRFTPTDSSAQESAPVQEPQPSNVKADGGSNGSGKDTLSVLDKNAGSGEVPEIQKDESTVNTGAATEAVEISDEAEGTKDGSVGDKVVVGEPNKDNNGSSEIESKTKGGDAEEKEGADEAENKDKISKDDNGKKDGGESETNNGLSDEQKVADNKGQTSSATPLFSFKNLSSGQNAFTGLAGTGFSSSSFSFGSASKDDSSAGTLFGSKTDGSSFPSFNLGANNSALATSAEAPKKFAMTEGPVETGEENEKAVFTADSALYEYLNGGWKERGKGELKLNVPVSVGERARLVMRTKGNYRLVLNASLYGDMSLKDMDKKGTTFACVNSISESQSGLATFALKFKDTAIREEFKDAVEAHKMRKAHEAPLKTTENSPKAAEV

SEQ ID NO: 41554 - DNA, 717 bp, Panicum virgatum
  misc_feature: Ceres CLONE 2008124
  misc_feature: Encodes the peptide sequence at SEQ ID NO. 41555
cgttattcttcctaaaccctagactagatagccgacacacaccaagagggagaagagggagagattccctgctcttgcgcgtgatttaacgactcaagcgatcgcggttgcagcagccaaagggaggtagcgactcaaaatggcgtcaccgttcgggacatctcgcctcaacaagccagcacctgctgcctttgcgaccaacaggaccctcctttcgccccccgttgtttccctcccacggcaaatgaaaatgaggccccagaggaagtgccgtttcacggtaaatgcagcaaaggagctccatttcaataaggatggctcggctatcaggaaacttcagaatggggtcaataagcttgcagatctcgttggggttactcttggaccaaaaggacgaaatgtagtccttgagagcaagtatggctcacctaaaatcgtcaatgatggagtcactgttgcaaaggaggttgagctagaggaccctgttgaaaacattggagctaaattggtccgccaagctgctgctaaaacaaacgatttggctggtgatgggacaaccacttcggtcgtccttgctcaagggatgattactgagggtgtaaagattgtagctgctggtgctaatccagtgcagatcacccggggtattgagaaaacagccaaaacactagtcaatgaactccaaaagatgtccaaggaggttgaagatagtgagct

SEQ ID NO: 41555 - protein, 192 aa, Panicum virgatum
  misc_feature: Ceres CLONE 2008124
  misc_feature: Functional homolog of the protein sequence given in SEQ ID NO 50704
  misc_feature: Useful for making plants with modulated nitrogen use efficiency
MASPFGTSRLNKPAPAAFATNRTLLSPPVVSLPRQMKMRPQRKCRFTVNAAKELHFNKDGSAIRKLQNGVNKLADLVGVTLGPKGRNVVLESKYGSPKIVNDGVTVAKEVELEDPVENIGAKLVRQAAAKTNDLAGDGTTTSVVLAQGMITEGVKIVAAGANPVQITRGIEKTAKTLVNELQKMSKEVEDSE

SEQ ID NO: 41556 - DNA, 716 bp, Panicum virgatum
  misc_feature: Ceres CLONE 2008134
  misc_feature: Encodes the peptide sequence at SEQ ID NO. 41557
ccggacgcgcgcagccaaaaagcacacggggccagagctcgactgctcgaggaggcgggaggcaggggaggcgatcgggatgaccgctcctcttgcgtagcagagtgttgcttgcctgcaggctgcagcgtccgctgcttccgtcacttgccattgccactgcgtgagcgagaggaaggcggcgtgaagggagcagctaggatcgaggaaatggcggcgcgcggccacgtgctcgcgctgctcgtgctgctcgcgctcgccggggcggccgcggcgggcggcgggaggcacccgcacagccacaggcaccggcacggcaggaagtcggcgcggctgaggctgatcccctccgcgccgggcgcgtccctcgccgaccgcgcccgggacgaccggcaccggcacgcgtacatccggtccacgctggcgtcgcgccgccgcgcggcggaggtgggcgcgtcggcgttcgccatgccgctctcgtcgggggcctacaccggcacgggccagtacttcgtgcggttccgcgtgggcacccccgcgcagccgttcgtgctggtggcggacaccggcagcgacctcacctgggtcaagtgccgcggcgccgccggatcgccgccggacgcgcagccgccggcgcgcgagttccggcccgccgcttccaagtcgtgggcgcccatcgcgtgctcctccgacacgtgcacgtcgtacgtgccctt

SEQ ID NO: 41557 - protein, 168 aa, Panicum virgatum
  misc_feature: Ceres CLONE 2008134
  misc_feature: SWISSPROT Homolog: EC 3.4.23.12 Nepenthesin
MAARGHVLALLVLLALAGAAAAGGGRHPHSHRHRHGRKSARLRLIPSAPGASLADRARDDRHRHAYIRSTLASRRRAAEVGASAFAMPLSSGAYTGTGQYFVRFRVGTPAQPFVLVADTGSDLTWVKCRGAAGSPPDAQPPAREFRPAASKSWAPIACSSDTCTSYVP

SEQ ID NO: 41558 - DNA, 709 bp, Panicum virgatum
  misc_feature: Ceres CLONE 2008136
  misc_feature: Encodes the peptide sequence at SEQ ID NO. 41559
ctgaactactgctgacagaagaaccagcgaaggcacgagcacgaccaccgccgccgcggccgggaagcaagctcaaaccctaaccgccggcgacgccagcacgatggcccgctacgaccgcgcgatcaccgtcttctcccccgacggccacctcttccaggtcgagtacgccctcgaggccgtccgcaaggggaacgccgccgtcggcgtccgcggcaccgacaccgtcgtcctcggcgtcgagaagaagtccaccccaaagctccaggactccaggtccgtgcgcaagatcgccagcctcgacacccacatcgcgctggcgtgcgcggggctcaaggcggacgcgcgcgtgctcatcaaccgcgcgcgggtcgagtgccagagccaccggctcaccgtcgaggaccccgtcaccgtcgagtacatcacctgctacatcgccagcctgcagcagaagtacacgcagagtggtggagtgcgccccttcgggctctccactctcatcgtcggcttcgacccctacaccgacaagccggccctgtaccagaccgacccatccggtaccttttctgcctggaaggccaacgccacggggaggaactccaactccatgagggagttcctcgagaagaactacaacgagacctctggcaaggagactatcaagctcgccatccgtgcacttctagaggttgttgaaagtggtggg

SEQ ID NO: 41559 - protein, 201 aa, Panicum virgatum
  misc_feature: Ceres CLONE 2008136
  misc_feature (27)..(198): Pfam Name: Proteasome Pfam Description: Proteasome A-type and B-type
  misc_feature: SWISSPROT Homolog: EC 3.4.25.1 Proteasome endopeptidase complex
MARYDRAITVFSPDGHLFQVEYALEAVRKGNAAVGVRGTDTVVLGVEKKSTPKLQDSRSVRKIASLDTHIALACAGLKADARVLINRARVECQSHRLTVEDPVTVEYITCYIASLQQKYTQSGGVRPFGLSTLIVGFDPYTDKPALYQTDPSGTFSAWKANATGRNSNSMREFLEKNYNETSGKETIKLAIRALLEVVESG

SEQ ID NO: 41560 - DNA, 1232 bp, Panicum virgatum
  misc_feature: Ceres CLONE 2008137
  misc_feature: Encodes the peptide sequence at SEQ ID NO. 41561
aactaacgctaaaaaagtaacagtttctgtactttattgttcacacacaacacaggaccgtgttgttgttgttgttctctcatctcgccaccttctcgcgatccattcccagaatcaggcaccaccaacaaccaccgcccattaccaccatcagcatcatgcgtgtcgttgcgactgtcttcttcgcgcttccgctggcgctgtgcgcggcgctcacggaggcgcgcgcgccgaagtggcacgagctggcgacgtacagcttcgagcagttcgtcgcggacttcgggcggcgctacgcgagcggtcgcgagcacgagcagcggcgcgcggtgttcgaggcgcggctgaagcgcgtgcgcgcgcacaacgcgcagccgggcgcgacgtaccgcaagggtgtgaaccagttcagcgactggacggaggaggagttccagcggctgaacacgcacaagggcgccaagtaccggacgccggcggcgatggcgaaggtgcagcagctggcgcgcaacccgcaggcgcagctgccgtacgcggtggactaccggcgcgcgaacccggcggtgctgacggcggtgaagaaccagggcgcgtgcgggtcgtgctgggcgcactcgacggtggaggccatggagtcgttcttcgcgatcaagtacgggcagctgccggtgctgtcggcgcagcaggtggcgtcgtgcgcgccgaccatggacgggtgcggcggcggcgactacttcgcggggtgggcgtacgtggcggaggcggcgcagggcttgaacgaggagtggacgtacccgtacacggacttcttcgcggtgaatgagagcaaggcggcgacgagcgtgtgctacgacgtgtcgtccaagttcctgccgaacttcgcgtgggtgccgaaggcgaacgtgtcgggcgcgtggtcggtggagccgaacagcggggcggcggcgatggaggcgctcgcgctgcacgggccgctgtcgatctcggtcgcggcgggcgagtggaacgagtacgagagcggcgtgttcaacccgagcggggcgaacgtgacgtgggccatcgaccacgcggtgcagctggtgggctacggcttcgatacggacctgcaggcggggtactggatcgtgcgcaactcgtggggcacgacgtggggcgaggacggctacatccggctgtaccgcccgccggcggggcaggagccgtgcggcacggacccgcagggcggcgccatg

SEQ ID NO: 41561 - protein, 357 aa, Panicum virgatum
  misc_feature: Ceres CLONE 2008137
  misc_feature (123)..(357): Pfam Name: Peptidase_C1 Pfam Description: Papain family cysteine protease
  misc_feature (35)..(92): Pfam Name: Inhibitor_I29 Pfam Description: Cathepsin propeptide inhibitor domain (I29)
  misc_feature: SWISSPROT Homolog: EC 3.4.22.14 Actinidain
MRVVATVFFALPLALCAALTEARAPKWHELATYSFEQFVADFGRRYASGREHEQRRAVFEARLKRVRAHNAQPGATYRKGVNQFSDWTEEEFQRLNTHKGAKYRTPAAMAKVQQLARNPQAQLPYAVDYRRANPAVLTAVKNQGACGSCWAHSTVEAMESFFAIKYGQLPVLSAQQVASCAPTMDGCGGGDYFAGWAYVAEAAQGLNEEWTYPYTDFFAVNESKAATSVCYDVSSKFLPNFAWVPKANVSGAWSVEPNSGAAAMEALALHGPLSISVAAGEWNEYESGVFNPSGANVTWAIDHAVQLVGYGFDTDLQAGYWIVRNSWGTTWGEDGYIRLYRPPAGQEPCGTDPQGGA

SEQ ID NO: 41562 - DNA, 717 bp, Panicum virgatum
  misc_feature: Ceres CLONE 2008151
  misc_feature: Encodes the peptide sequence at SEQ ID NO. 41563
aagaaggttctggaagttcacgttgagaaggggatgcagcacaaccagaagatcactttccctggcgaagctgatgaagcgcctgacactgtcaccggagacattgtattcgtccttcagcagaaggatcactccaaattcaagagaaagggcgatgatctcttttatgagcacaccttgtctctgactgaggctctctgtgggttccaatttgttcttacacatctggacaacaggcagcttctcatcaagtcaaaccctggtgaagttgttaagcctgaccaattcaaggcgataaatgacgaggggatgccaatgtaccagaggcctttcatgaaggggaagctctacattcacttcacagtagagttcccagactcgctggcaccagagcagtgcaaggcccttgaggcggtacttccaccaaagcttacacccaagctgacagacatggagatagatgagtgtgaggagaccactatgcatgatgtgaacaacatcgaggaagagatgcgcaggaagcaagctcatgccgcccaggaggcgtacgaggaggacgacgagatgcctggaggagcccaaagagtgcagtgtgcacaacagtaagctgagtgtatcatcaaggggcttcgcagcgctgcacacgtagtaatctgcaaggtttgcagtggacctttggacccagtgtgatctctctggttttatcgtcggagttaa

SEQ ID NO: 41563 - protein, 201 aa, Panicum virgatum
  misc_feature: Ceres CLONE 2008151
  misc_feature (16)..(140): Pfam Name: DnaJ_C Pfam Description: DnaJ C terminal region
KKVLEVHVEKGMQHNQKITFPGEADEAPDTVTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEAVLPPKLTPKLTDMEIDECEETTMHDVNNIEEEMRRKQAHAAQEAYEEDDEMPGGAQRVQCAQQ

SEQ ID NO: 41564 - DNA, 666 bp, Panicum virgatum
  misc_feature: Ceres CLONE 2008157
  misc_feature: Encodes the peptide sequence at SEQ ID NO. 41565
aaaaaaaaaaaaagcctccgccgcctcgcgcttcgccccccctcacttgcttccccacccggcggcgctccccgacgcgaagagatggcggtgccgctgctgacgaagaagatcgtgaagaagcgggtcaagcagttcaagaggccccacctcgaccgctacaagtgcctcaagccaagctggcgcaggcccaagggtattgactcccgtgtcaggaggaagttcaagggatgcaccttgatgcctaacattgggtacggctctgacaagtcaaccaggcactaccttcccaacaagttcaagaagtttctggtgcacaatgtctctgagctggagttgctcatgatgcacaacaggacatactgtgcggagatcgcccacaacgtctcaacaaagaagcgcaaggatattgttgagcgcgctgctcagctcgacattgttgtcaccaacaagctcgccaggctccgcagccaggaggatgagtaggctgggttgctcgtcagcacaactgttgggtcttgtctttcttgtctgtaggaaaactactctgtttctcgtcgtattgtattgctaccgaggataccttctatgcccgacctttttgctatcaatagcgactctaatatgtcaaaagctgctgttaccgtacgcctatctgaattatct

SEQ ID NO: 41565 - protein, 133 aa, Panicum virgatum; identical to SEQ ID NO: 31645
  misc_feature: Ceres CLONE 2008157
  misc_feature (14)..(123): Pfam Name: Ribosomal_L32e Pfam Description: Ribosomal protein L32

SEQ ID NO: 41566 - DNA, 1149 bp, Panicum virgatum
  misc_feature: Ceres CLONE 2008161
  misc_feature: Encodes the peptide sequence at SEQ ID NO. 41567
atggtccccttcgccggcgcctcgtacgcgcaccggcgaggagccaggacgagcccgtctgcgccaggctctggcgtgctcgtccgtctgctccgatctcggcgtgggttcgcgtccccgcacgccgttcttgtgccgagcccgccgcctgcgataagaaaatcaaaaccaccctcctataaacaacccaacgaccccccggcccgggccagccaccagattccttcctcctctgcaaagccgccgaaatcgatctcactggtcactgcatccctccgatcccagtcccactgcaatactgcatcactcccaagtctccaacgccgcaccgccgcgccagcatgggcggcggcctcgggctccggccgctggcggtgctcctggtcctcgtcgccgcggcggccggccgcgccgctcccgccgagggaaagggtagggggaggggggcgcacggtagtaccagcaccaggctgcggttccggcgcgacagcgggacgttcaaggtggtgcaggtggcggacatgcactacgccgacggcccggccacgggctgcgaggacgtgctcccgtcccaggtggccgggtgctccgacctcaacaccaccgccttcctctaccgcgtcttccgcgacgaggaccccgacctcgtcgtcttcaccggtgataacatctatggtgcggattcaagtgacgcggccaagtctatcgatgcagcgattgccccagccattgacatgaaacttccttgggcagctgtgattgggaaccatgaccaagagggtacgctgtcgcgtgagggtgtaatgcgtcaccttgtgagcatgaagaacagcttttcaggactcaaccccgaaggaattgaaattgatggctatggtaattataatttggaagtttccggggttgaaggaacatcactgggtgaaaaatcagtgctcaacctgtatttcctagacagtggtgactattctactgtaccgtcaatcaaaggttatggttggatcaaggcctcacagcaagtctggttccaacaaacatcttcaagcctacagagaaagtatatgaatgaaaacccgaagcagaaggagccagcacctggccttgtgttcttccatattccactgccggagttcagcagctttaccgcat

SEQ ID NO: 41567 - protein, 269 aa, Panicum virgatum
  misc_feature: Ceres CLONE 2008161
  misc_feature (53)..(264): Pfam Name: Metallophos Pfam Description: Calcineurin-like phosphoesterase
MGGGLGLRPLAVLLVLVAAAAGRAAPAEGKGRGRGAHGSTSTRLRFRRDSGTFKVVQVADMHYADGPATGCEDVLPSQVAGCSDLNTTAFLYRVFRDEDPDLVVFTGDNIYGADSSDAAKSIDAAIAPAIDMKLPWAAVIGNHDQEGTLSREGVMRHLVSMKNSFSGLNPEGIEIDGYGNYNLEVSGVEGTSLGEKSVLNLYFLDSGDYSTVPSIKGYGWIKASQQVWFQQTSSSLQRKYMNENPKQKEPAPGLVFFHIPLPEFSSFTA

SEQ ID NO: 41568 - DNA, 1785 bp, Panicum virgatum
  misc_feature: Ceres CLONE 2008164
  misc_feature: Encodes the peptide sequence at SEQ ID NO. 41569
aacaaatcaagtccactcgcataggatacaaactctttcttctcccaggccactctggtcgtcgtcagagcaatggttcttggagcgacgcttgccgctgcggcctcatcggtgccatggagcttcctgctcggcggtctcctgggcctggcgctcctgtggaaggccggccggctgctggaccagatgtggtggcagcctcggcggctcgagcgggcgctgcgcgcgcagggcatccccggcacgtcctaccgcttcctcgccggcgacctcaaggagtacggccggctggccaaggaggcctggtccaagcctttgccgctgcggtgccacgacatcgcgcaccgcgtcatgccgttcgtcgacaaccttgtccgggagcacggcaagatgagcatgtcctggttcggccccaaccccaaggtgaccatcgtcgatcctgagctgagcaaggacgtgctgtccaacaagttcggtcacttcgagaagctcaagttcccggcgctgtccaagatgctgggcggcggcgtggcgagccacgagggcgagaaatgggtcaagcacaggaggatcctcaaccctgcattccatcttgagaagctcaagcgcatgctgccagcgttttctgcgtgctgtgaagagctagtcagcaggtggtcggagtccctcggctcggaggcttcgctggagctggacgtttggcctgagctgcagaacctcactggagacgtcatttctcgcaccgcattcagcagcagctaccacgaaggaagaaggattttccagctgcaagccgagcaagctgtgcttgtcatgaccaacattcggaagattatgattcctggttacatgtccttgccaaccacaagcaacagaaagatgcgcaagaacaacaaagagatcgaatcaattctaagagaaataatcgggaaaagaattcgagcaatggaacaaggcgaaagcaccaaagatgacttgttgggcctactcttggagtcaaacatgagagaaacagaagagaatgaccaatcgagcatggggatgacaattgaagatgttatcgaggagtgcaaggtgttctattttgcaggaatggagaccacatcggtgctgctcacgtggacaatggttgtcctaagcatgcacccagagtggcaggaccgtgcgagggaggaggtgctaggtttgtttggcaaaaacaagcctgagtacgaaggcttaagccgcctcaaaactttgaccatgatcctttatgaggttctccggttgtaccctccagccatttcttttgtccggaaaacatacaaggagatggagattggaggcatcacctaccctgccggtgtgatcttggagctgcccgtgctcttcattcaccatgacccggatatctggggaagtgatgtgcacgagttcaggccagacagattttctgaagggatctccaaggcgtccaaggacccaggcgcattcctcccgttcggttggggcccacgcatttgcattggtcagaacttcgccttgctagaggccaagatggcgctgtccatgatccttcagcgatttgagttcgagctagcaccgtcatacactcatgcgccacataccgtgataacactacatcctatgcatggtgcccaaattaagctcaaagcagtatgatgaaagcatggtgttcatcggtagtggccttagcttgtttgtatagatgtaacatagaaatcaaataggcctttccgcgttgatgttggaaataaattaatttcaatggacttttgtgctttc

SEQ ID NO: 41569 - protein, 529 aa, Panicum virgatum
  misc_feature: Ceres CLONE 2008164
  misc_feature (81)..(526): Pfam Name: p450 Pfam Description: Cytochrome P450
  misc_feature: SWISSPROT Homolog: EC 1.3.3.9 Secologanin synthase
  misc_feature: Functional homolog of the protein sequence given in SEQ ID NO 50318
  misc_feature: Useful for making plants with modulated cold sensitivity
  misc_feature: Functional homolog of the protein sequence given in SEQ ID NO 50319
  misc_feature: Useful for making plants with modulated nitrogen use efficiency
  misc_feature: Functional homolog of the protein sequence given in SEQ ID NO 50320
  misc_feature: Useful for biocontainment applications
  misc_feature: Useful for making plants with modulated biomass
  misc_feature: Useful for making plants with modulated flowering time
MVLGATLAAAASSVPWSFLLGGLLGLALLWKAGRLLDQMWWQPRRLERALRAQGIPGTSYRFLAGDLKEYGRLAKEAWSKPLPLRCHDIAHRVMPFVDNLVREHGKMSMSWFGPNPKVTIVDPELSKDVLSNKFGHFEKLKFPALSKMLGGGVASHEGEKWVKHRRILNPAFHLEKLKRMLPAFSACCEELVSRWSESLGSEASLELDVWPELQNLTGDVISRTAFSSSYHEGRRIFQLQAEQAVLVMTNIRKIMIPGYMSLPTTSNRKMRKNNKEIESILREIIGKRIRAMEQGESTKDDLLGLLLESNMRETEENDQSSMGMTIEDVIEECKVFYFAGMETTSVLLTWTMVVLSMHPEWQDRAREEVLGLFGKNKPEYEGLSRLKTLTMILYEVLRLYPPAISFVRKTYKEMEIGGITYPAGVILELPVLFIHHDPDIWGSDVHEFRPDRFSEGISKASKDPGAFLPFGWGPRICIGQNFALLEAKMALSMILQRFEFELAPSYTHAPHTVITLHPMHGAQIKLKAV

SEQ ID NO: 41570 - DNA, 759 bp, Panicum virgatum
  misc_feature: Ceres CLONE 2008174
  misc_feature: Encodes the peptide sequence at SEQ ID NO. 41571
atttgcataccttcctgcgttgctcgtacgcaaccttccccttccccggtcggttagccccactttgcccgaccgttcagcattctaagtttctaacaggtgtaggggagatcggcagcattcgtgctccttgcgggctgcctgcaaatttgcttgctagggtttggtcggtggactgtgggctctgcaggatcccggaattgcatccgcgccgagggccatggtgggaaggcataccatcattctcatgcaaccatcgcagaacagagctacgaggacatttatggatttcgattcagttaaccatgcactggatggaatctgtggcctctatgaaaggaaaatcaggaacatcaacccgatggtcatgaacttgacttatgatatcagtgacctgtacaatttcattgatggcctgatcgacataagcgcactggtgttcgacgattccctccatgctttcctgccatatgaccgccagtggataaaacagaagctgtttcagcacctgaagaggctggctgaacagtagagcatggtcaccgctggttttcggcagcgcacacgtcgaggacgaaggtgccaggctggttcgaaattcctggcatgttgtgtaaaggtctatctggcactctggcagtgtagtgtttgacgtgaaccatgtggtttgcacggcgatcaggcactgtattgtgaaccgccgaacaaatgcaagcttccagatgatcatcttgttatttatgagttccgactgactgg

SEQ ID NO: 41571 - protein, 103 aa, Panicum virgatum; identical to SEQ ID NO: 39964
  misc_feature: Ceres CLONE 2008174
  misc_feature (3)..(103): Pfam Name: ER Pfam Description: Enhancer of rudimentary

SEQ ID NO: 41572 - DNA, 590 bp, Panicum virgatum
  misc_feature: Ceres CLONE 2008178
  misc_feature: Encodes the peptide sequence at SEQ ID NO. 41573
gctcgtgcccaccccccccaaaacaagagcactagtagtagcagcagcagcaggggaggagaggaggagtccaacaaggtgcccctgctccagccgagagcggcagacgaccaccatggaggcagcagaagcttcatcagcaaggatgatgatgaagagcaggtggaagaagagtcgtcgtcgctggggcggcgcgcgtgggaggagaacaagaagctgtgggtggtggcggggccctcaatcttcacccgcttctcctccttcggcctcaccgtcatcagccaggccttcgtcggccacatcggctccaccgagctcgctgcatacgccctcgtctcaaccgtcctcatgcgattcagcaacggcatcctgctgggcatggcgagcgcgctggagacgctgtgcggccagtcctacggcgccaagcagtaccacatgctcggcatctacctgcagcgctcctggatcatcctcttcgcctgctccgtcgtcctgctccccgtctacctcttcaccgagcccatgctcgtcgccctgggccaggaccccaagatctccgccgtcgccggcaccatctccctctggtacat

SEQ ID NO: 41573 - protein, 196 aa, Panicum virgatum
  misc_feature: Ceres CLONE 2008178
  misc_feature (79)..(196): Pfam Name: MatE Pfam Description: MatE
ARAHPPQNKSTSSSSSSRGGEEESNKVPLLQPRAADDHHGGSRSFISKDDDEEQVEEESSSLGRRAWEENKKLWVVAGPSIFTRFSSFGLTVISQAFVGHIGSTELAAYALVSTVLMRFSNGILLGMASALETLCGQSYGAKQYHMLGIYLQRSWIILFACSVVLLPVYLFTEPMLVALGQDPKISAVAGTISLWY

SEQ ID NO: 41574 - DNA, 718 bp, Panicum virgatum
  misc_feature: Ceres CLONE 2008184
  misc_feature: Encodes the peptide sequence at SEQ ID NO. 41575
acaaacaccaagtagcgatcaatcattcaggagctcgtcagtcaccaccgcttctcctgctccacagccatggataaggcctacgtggccgtcctcaccttcgccttcctcttcgtgctccactacctcgtgggccgtgttggagggggcggcggcggcaagggacatggcaacgggaagggcagtaaaggtgggcagcggctgccgccgagccctccggccgtccctttcctcggccacctccacctcgtcaagacgccgttccatgcggcgctggcgcggctcgccgcgcgccacggcccggtgttcctcctgcgcatgggctcccgccgcgccgtggtggtgtcctcgccggacgccgccagggagtgcttcacggagcacgacgtcgccttcgccaaccgcccgctgttcccctcgcagaagctcgcgtccttcggcggcgcctcgctctccatggccagctacgggccctactggcgcaacctccgccgcgtcgccgccgtgcagctcctctccgcgcaccgcgtcgcctgcatgtcccccgccatctccgccgaggtgcgcgccatggtgcgccgcatgagccgcgccgccgcggccgcgccgggaggcgccgcgcgcgtccagctgaagcggaggctgttcgagctctccctcagcgtcctcatggagaccatcgcgcgcaccaagacgtcccgcaccgaggctaacgccg

SEQ ID NO: 41575 - protein, 216 aa, Panicum virgatum
  misc_feature: Ceres CLONE 2008184
  misc_feature: SWISSPROT Homolog: EC 1.14.13.89 Isoflavone 2'-hydroxylase
MDKAYVAVLTFAFLFVLHYLVGRVGGGGGGKGHGNGKGSKGGQRLPPSPPAVPFLGHLHLVKTPFHAALARLAARHGPVFLLRMGSRRAVVVSSPDAARECFTEHDVAFANRPLFPSQKLASFGGASLSMASYGPYWRNLRRVAAVQLLSAHRVACMSPAISAEVRAMVRRMSRAAAAAPGGAARVQLKRRLFELSLSVLMETIARTKTSRTEANA

SEQ ID NO: 41576 - DNA, 1117 bp, Panicum virgatum
  misc_feature: Ceres CLONE 2008188
  misc_feature: Encodes the peptide sequence at SEQ ID NO. 41577
aatcagcctgcggaagacgacgccgagagcgagaggcgctgagcactgagcagcaaggcgcgggcacgatggccgccaggcgcacggagggcgccgccgccaggagccgggagaatgtgtgcgtgacgggtgccggcgggtacatcgcctcgtggctcgtcaagctcctcctcgcccgcggctacgccgtgcacgccaccgtccgcgacccgtctgatcccaagaacgcccacctgaggcagctggaaggggcgtcggagaacctccggctgttccgggccgacgtgctcgaccgcggcgcgctggccgccgcggtcgccgggtgccggggggtcttccatgtcgcctgcccggtgcccacggacaaggttgttgatccggagtcggaagtactggcccctgctgtgaaaggcaccttaaacattcttcaggcttgctcagctaatgacgtccagaaggttgttgtggtttcatccactgccgctgtccatttcaacccgaagtggcctcgggacatacccaaggacgagaattgctggtcggacataaacttttgtgaaaagaatgaggattggtatatggttgccaaggttgttgctgaaaagacagccttggattatgcmkagaaaagtggactaaatgttgttacagtttgccctactatggcattaggcccactcctacggcctgtggccaatgtcagccatgaattcctcatatacattataaaaggaggcccaacgctaatgaagaacattctgtggcacatagttgatgtccgtgatgtggctgatgctttatttctcatatacgagatagaggaatcagctggaagatacctctgtgcgccgcatcatattagcgcaaaggttatggtgaacttgctcaagaagactcaccccaattacaattacgtaaactgtgacagtgatctggaacctaactctatagttacaccacttgtgtcggagaaactgaagaatctagggtggaaaccaaggaagaaaatagaggaaactttgttggacagtattgagtactatgagaaggcaggccttttgcaggatgtggagggacgcccttgccgtcttcctcacctttttcattatggctatag

SEQ ID NO: 41577 - protein, 349 aa, Panicum virgatum
  misc_feature: Ceres CLONE 2008188
  misc_feature (17)..(260): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Functional homolog of the protein sequence given in SEQ ID NO 51635
  misc_feature: Useful for making plants with altered carbohydrate content
  misc_feature: Functional homolog of the protein sequence given in SEQ ID NO 50653
  misc_feature: Useful for making plants with altered cell wall content and/or composition
  misc_feature: Useful for making plants with altered lignin content
  misc_feature (186)..(186): Xaa is any aa, unknown, or other
MAARRTEGAAARSRENVCVTGAGGYIASWLVKLLLARGYAVHATVRDPSDPKNAHLRQLEGASENLRLFRADVLDRGALAAAVAGCRGVFHVACPVPTDKVVDPESEVLAPAVKGTLNILQACSANDVQKVVVVSSTAAVHFNPKWPRDIPKDENCWSDINFCEKNEDWYMVAKVVAEKTALDYAXKSGLNVVTVCPTMALGPLLRPVANVSHEFLIYIIKGGPTLMKNILWHIVDVRDVADALFLIYEIEESAGRYLCAPHHISAKVMVNLLKKTHPNYNYVNCDSDLEPNSIVTPLVSEKLKNLGWKPRKKIEETLLDSIEYYEKAGLLQDVEGRPCRLPHLFHYGY

SEQ ID NO: 41578 - DNA, 717 bp, Panicum virgatum
  misc_feature: Ceres CLONE 2008198
  misc_feature: Encodes the peptide sequence at SEQ ID NO. 41579
aaggccagccgagccgagcccggctcaacgcgagtccacacacacgcccccacccacccacgcacaccactcctccctcccccttcgccgccgcccgcccgatccggccgcggaggacgccgcgggtcgccccgccatggaccaggtgagcgctccccccgcctcccctctccgatcgctctaccgccgccgcctccctcctcagtccgccccggagcggcggcgatggcgcggggccgggtgtatataatgcggcggaatggtgtggcgtgggcgcagtacgagaaggtggagaagatcggggagggcacgtacggggtggtttacaagggcaaggacctccacaccaacgagacgatcgcgctcaagaagatccgcctcgagcaggaggacgagggcgtcccctccaccgccatccgcgagatctccctcctcaaggagatgcaccaccacaacatcgtcaggctgcacgacgtcgtgcacaacgacaagtgcatatacctcgtcttcgagtacctcgacctcgacctcaagaagcacatggactcctccccggacttcaagaaccaccgcatagtaaaggtcacattctccagctaattgtactgtcggacttgtaattgaactggcgcactagtagtgagttactcccaccaggcagcagtagccccgttgaggaggctgtgggtcatgatcgcgagatacgaaatggtaatg

SEQ ID NO: 41579 - protein, 124 aa, Panicum virgatum
  misc_feature: Ceres CLONE 2008198
  misc_feature: SWISSPROT Homolog: EC 2.7.11.22 Cyclin-dependent kinase
  misc_feature: Functional homolog of the protein sequence given in SEQ ID NO 51518
  misc_feature: Useful for making plants with modulated growth rate
MARGRVYIMRRNGVAWAQYEKVEKIGEGTYGVVYKGKDLHTNETIALKKIRLEQEDEGVPSTAIREISLLKEMHHHNIVRLHDVVHNDKCIYLVFEYLDLDLKKHMDSSPDFKNHRIVKVTFSS

SEQ ID NO: 41580 - DNA, 777 bp, Panicum virgatum
  misc_feature: Ceres CLONE 2008200
  misc_feature: Encodes the peptide sequence at SEQ ID NO. 41581
atcgtcccattgctcgcccagagttgttcttgttaggcaaggcaaaagcaggagcaaaaggtttcgttggtgatggcgagctcagggttctcgtggacgctgccggaccacccgaagctccccaaggggaagccggtggccgtcgtcgtgctggacggatggggcgaggccaacgccgaccagtacaattgcatccatgtcgctcagacgcccgtcatggattccctcaagaatggtgctccagagaggtggagactcgtgaaggctcatggaactgctgtgggtctcccatctgatgatgatatgggcaacagtgaagttggccacaatgctcttggagctggtcgcattttcgcccaaggcgctaagctcgtggaccaagctcttgcctccggaaaaatttatgagggtgatgggttcaactacatcaaagaatcttttgaaaatggtacacttcaccttattgggttgttgagtgatggtggcgtccactcccgtcttgaccaactgcagctacttctgaaaggtgccagtgagaggggagcaaaaagaatccgtgtacacatccttaccgatgggcgtgatgttttggatggcagcagtgttggttttgtagagacactagagaatgatctttcacagcttcgagagaagggtattgatgcacagattgcatctggtggtggaaggatgtatgttaccatggaccgttatgaagatgactgggatgtgggtaaaacgtgggtgggatgcccaggtgctttggaaaacaccccc

SEQ ID NO: 41581 - protein, 234 aa, Panicum virgatum
  misc_feature: Ceres CLONE 2008200
  misc_feature (18)..(232): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSGFSWTLPDHPKLPKGKPVAVVVLDGWGEANADQYNCIHVAQTPVMDSLKNGAPERWRLVKAHGTAVGLPSDDDMGNSEVGHNALGAGRIFAQGAKLVDQALASGKIYEGDGFNYIKESFENGTLHLIGLLSDGGVHSRLDQLQLLLKGASERGAKRIRVHILTDGRDVLDGSSVGFVETLENDLSQLREKGIDAQIASGGGRMYVTMDRYEDDWDVGKTWVGCPGALENT

SEQ ID NO: 41582 - DNA, 687 bp, Panicum virgatum
  misc_feature: Ceres CLONE 2008213
  misc_feature: Encodes the peptide sequence at SEQ ID NO. 41583
tgaagctgacatctttgtgaccaccactggtaacaaggacatcatcatggttgaccacatgaggaagatgaagaacaacgcaattgtctgcaacattggtcactttgacaatgagatcgacatgcacggtcttgagacctaccctggtgtcaagcggatcaccatcaagccccagactgatcgctgggtgttccctgagaccaacactggcatcattgtcctcgctgaggttcgtctgatgaaccttgggtgtgctactggccaccccagctttgtcatgtcctgctcattcactaaccaggtcattgctcagcttgagctgtggaaggagcggagctctggcaagtatgagaagaaggtgtatgtgctccccaagcaccttgatgagaaggttgccgccctccacttgggcaagcttggtgccaagctcaccaagctcaccaagtctcaggctgactacatcagtgtcccgatcgagggtccctacaagcccgcgcactaccggtactaggttgcccaggacgactagaagctcactcggctggccggttatattgtgtgcccttacgaagttcactacaccggctggtcaattatcatatgcgctgttgcgctggaggatttgttatgatcattgcttgagcctggttgagtggggagaggagggaagagctgtttgcttttgcg

SEQ ID NO: 41583 - protein, 169 aa, Panicum virgatum
  misc_feature: Ceres CLONE 2008213
  misc_feature (2)..(168): Pfam Name: AdoHcyase Pfam Description: S-adenosyl-L-homocysteine hydrolase
  misc_feature (1)..(87): Pfam Name: AdoHcyase_NAD Pfam Description: S-adenosyl-L-homocysteine hydrolase, NAD binding domain
  misc_feature: SWISSPROT Homolog: EC 3.3.1.1 Adenosylhomocysteinase
EADIFVTTTGNKDIIMVDHMRKMKNNAIVCNIGHFDNEIDMHGLETYPGVKRITIKPQTDRWVFPETNTGIIVLAEVRLMNLGCATGHPSFVMSCSFTNQVIAQLELWKERSSGKYEKKVYVLPKHLDEKVAALHLGKLGAKLTKLTKSQADYISVPIEGPYKPAHYRY

SEQ ID NO: 41584 - DNA, 1318 bp, Panicum virgatum
  misc_feature: Ceres CLONE 2008218
  misc_feature: Encodes the peptide sequence at SEQ ID NO. 41585
agtgcttattccaggttccactcccaattcgtccatcgctcgctcgctcgcacgcgctgcgcccgccgccaaccctccccttctccccagcttctcgccctgctgaattccacgccccgtcgccccaaggcctccgatccgatctccgacacgacaccccccgaacgctagcgctgacgtccgcctccatggagccgaagcctccagcgccggcgtctgagtcggcgacgtcgcggttcaggctggggaggcagtcgtcgctggcgcccgagaggggcggcgagggcggcgccggtgcgggctcggcggaggggtccgcccaggccgacggcgtcatgagcttccagctgatgtacctggcccacgagggcagcgtggaggggatccgcgagctcctcgacggcggggccgaccccaacttccgcgactccgacggccgaacggcgctgcacatcgccgcgtgcgagggatacgccgaggtcgtcgagctcctcctccagcgcggcgcggaggccgccgtcgaggaccaatggggcagcacgcctttagcggatgcaatgcattatcagaatcatgatgtgatcaagatcttggagaagcatggctccaagcataagatcgctcctatgcatgtgaacaattgtcgtcaagttcctgaatatgagattgacccggctgagcttgatttcagtaatggcaatgatatatctaagggtacttttagaaaagcaacatggaggggcattccggttgctgttaagaagctggacgacgatcttattgtggatgagaacaaagtgagggcgttcagagacgagcttgatgtgctgcaacttatacgccatccaaatgttgtgcaatttttgggtgctgtgacacaaagcaacccaatgatgattgtcatggaatttatgcacaagggtgacttgcgcactcacttggataagagaggagctctgccgccatcatatgcagtgaagctagctcttgatattgcaagaggaatgaattacttacatgagcataagcctcaagctatcattcatcgtgaccttgagccttcgaacatattgagggatgacactggacatctgaaggtggcagattttgatttgtgtaagatgctaaaatggagaagaaaagttagagaagagaaagcggtaacttcacctggcaatgcttgtaggtatgttgctccagaagtcctgcgaaatgaagagtacgataccaaagtggatgtcttctcatttgctttgatacttcaggaaatgattgaaggatgtcttccttatcattataggaaaaacgatgaaattga

SEQ ID NO: 41585 - protein, 376 aa, Panicum virgatum
  misc_feature: Ceres CLONE 2008218
  misc_feature (167)..(376): Pfam Name: Pkinase Pfam Description: Protein kinase domain
  misc_feature (82)..(114): Pfam Name: Ank Pfam Description: Ankyrin repeat
  misc_feature: SWISSPROT Homolog: EC 2.7.11.1 Non-specific serine/threonine protein kinase
MEPKPPAPASESATSRFRLGRQSSLAPERGGEGGAGAGSAEGSAQADGVMSFQLMYLAHEGSVEGIRELLDGGADPNFRDSDGRTALHIAACEGYAEVVELLLQRGAEAAVEDQWGSTPLADAMHYQNHDVIKILEKHGSKHKIAPMHVNNCRQVPEYEIDPAELDFSNGNDISKGTFRKATWRGIPVAVKKLDDDLIVDENKVRAFRDELDVLQLIRHPNVVQFLGAVTQSNPMMIVMEFMHKGDLRTHLDKRGALPPSYAVKLALDIARGMNYLHEHKPQAIIHRDLEPSNILRDDTGHLKVADFDLCKMLKWRRKVREEKAVTSPGNACRYVAPEVLRNEEYDTKVDVFSFALILQEMIEGCLPYHYRKNDEI

SEQ ID NO: 41586 - DNA, 666 bp, Panicum virgatum
  misc_feature: Ceres CLONE 2008230
  misc_feature: Encodes the peptide sequence at SEQ ID NO. 41587
gtgccacacatccgtccgcttcttctcccctcctgccggtcccgaataagcagcgcaagaggttggtggagtgatttaccccagaacaattaggcagcagcaatggcggcggagagcttcctcttcacctccgagtccgtgaacgaggggcaccccgacaagctgtgcgaccaggtgtcggacgccgtcctggacgcgtgcctggcgcaggaccccgacagcaaggtggcctgcgagacctgcaccaagacaaacatggtgatggtgttcggcgagatcaccaccaaggccaccgtcgactacgagaagatcgtgcgcgacacctgccgcgagatcggcttcacctccgacgacgtgggcctcgacgccgaccgctgcaaggtgctcgtcaacatcgaacagcagtcccccgacatcgcgcagggcgtgcacggccacttcaccaagcgccccgaggagatcggcgccggcgaccagggccacatgttcggctacgccaccgacgagacccccgagctgatgccgctcagccacgtgctcgccaccaagctcggcgcgcgcctcaccgaggtccgcaagaacggcacctgcgcctggctcaggcccgacggcaagacccaggtcaccgtcgagtacctcaacgagggcggcgccatggtccccgtc

SEQ ID NO: 41587 - protein, 187 aa, Panicum virgatum
  misc_feature: Ceres CLONE 2008230
  misc_feature (4)..(103): Pfam Name: S-AdoMet_synt_N Pfam Description: S-adenosylmethionine synthetase, N-terminal domain
  misc_feature (118)..(187): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQGHMFGYATDETPELMPLSHVLATKLGARLTEVRKNGTCAWLRPDGKTQVTVEYLNEGGAMVP

SEQ ID NO: 41588 - DNA, 1902 bp, Panicum virgatum
  misc_feature: Ceres CLONE 2008236
  misc_feature: Encodes the peptide sequence at SEQ ID NO. 41589
attgcggattgcccctccatttctccccaccacctcgaacacggctagggtcgctgtgagcccgcgatgacggcggcgaggctgacccccaacgccgtggcggcgacgctggcgggggatatcaacctcaagccggtggtgcaggtcttcgacctccggagcatcacggtcaccggccccccaggcgccgggcccaggttccgcgccatcatctccgacggcgtcgccacgacgcaggcactgttcgccgcgcagctttgcgacctcgcgcgctccggcctcgtccgccgcggtgcgatcgtgcagctcctcgagtacatcgtcaacgaggttaatggaaggagggctatggtcattcttaacatggaagttcttgttccagagtgtgagattattggaaatccagtattgcctcctgaatctggagtttctaattcaaataccatgagagcagaccagtttaatggcgcacctggttcaacagcagggagtactttgaccacagtgacaaggtccaattacaattctccagtaatccagcgaccgatggcagggaacctttcgaacatgatccctaggccaagtgacaatgcacaggtcttccaaccaacagtacagccatcctatcgccctgcacccaattacagaaaccgcggcacaatcatgaaaaatgatgctcccgctagaataatccccatatctgcactaaatccttatcagggacgctgggctatcaaggctcgcgttactgccaagggtgagatccgccggtaccataacgcaaaaggtgatggcaaagtgttctcttttgacctgcttgattctgatggtggtgagatacgggctacgtgtttcaatgctcttgttgatcgcttctatgaagctgtggaagttggtaaggtctatgtggtatcaagaggaagcctgaaacctgcaaaaaaggactacaaccatctgaataatgagtgggaaattttcttggaatctcagtcaaccattgaactttgtcctgatgagaacagctccattcctgccatgcggtttagcttcacatcgattgataaaatcgaagattcagagaacaatgctattgttgatgtcattggtgtcgttacatctgtcaaccccagttccacaatacagaggaaaaatggcatggaaactcagaaaaggaccattaccctgaaggatatgtctggtcgaagtgttgaggttaccatgtggggtgacttctgcaacagagaaggcttgcagggtgcagaaatgggtgaacatggggccttttctgtgctggctgtcaaggctggaagagtgaatgattacagtggcaagtctgttggcacaatttcttcatctcaactcctcataaaccctgatcttgctgaagctcatagccttaggcagtggtttgattgtggaggtagagatgcttctactcagtccatatccagggatttcactccagcagcatcaaggtatgagatccggaagacagtagcacagataaaggatgatggtcttggaatgggggacaaacctgattgggtcacagtgaaggctactgttgtattcttcaagactgactccttctgctacacagcttgccccaacgtgattggagacaggcgatgcagtaagaaggtgacaaagtctgactcaggcaactggttctgtgacaagtgcaaccaagagtttccggagtgtgattacaggtacctcctgcagttacagatccaagatcactcgggaacagcttgggcaacagcattccaagagcccggggaggagctacttggttgctcggcgcgagaactcaacatgctaaaagagaatgaagatcctcgctacacagatgttttgctccaaggcttgtaccggcagcatctgctgaggcttaaagtg

SEQ ID NO: 41589 - protein, 611 aa, Panicum virgatum
  misc_feature: Ceres CLONE 2008236
  misc_feature (493)..(611): Pfam Name: Rep_fac-A_C Pfam Description: Replication factor-A C terminal domain
  misc_feature (5)..(105): Pfam Name: Rep-A_N Pfam Description: Replication factor-A protein 1, N-terminal domain
  misc_feature (227)..(304): Pfam Name: tRNA_anti Pfam Description: OB-fold nucleic acid binding domain
MTAARLTPNAVAATLAGDINLKPVVQVFDLRSITVTGPPGAGPRFRAIISDGVATTQALFAAQLCDLARSGLVRRGAIVQLLEYIVNEVNGRRAMVILNMEVLVPECEIIGNPVLPPESGVSNSNTMRADQFNGAPGSTAGSTLTTVTRSNYNSPVIQRPMAGNLSNMIPRPSDNAQVFQPTVQPSYRPAPNYRNRGTIMKNDAPARIIPISALNPYQGRWAIKARVTAKGEIRRYHNAKGDGKVFSFDLLDSDGGEIRATCFNALVDRFYEAVEVGKVYVVSRGSLKPAKKDYNHLNNEWEIFLESQSTIELCPDENSSIPAMRFSFTSIDKIEDSENNAIVDVIGVVTSVNPSSTIQRKNGMETQKRTITLKDMSGRSVEVTMWGDFCNREGLQGAEMGEHGAFSVLAVKAGRVNDYSGKSVGTISSSQLLINPDLAEAHSLRQWFDCGGRDASTQSISRDFTPAASRYEIRKTVAQIKDDGLGMGDKPDWVTVKATVVFFKTDSFCYTACPNVIGDRRCSKKVTKSDSGNWFCDKCNQEFPECDYRYLLQLQIQDHSGTAWATAFQEPGEELLGCSARELNMLKENEDPRYTDVLLQGLYRQHLLRLK

SEQ ID NO: 41590 - DNA, 1302 bp, Panicum virgatum
  misc_feature: Ceres CLONE 2008238
  misc_feature: Encodes the peptide sequence at SEQ ID NO. 41591
atcccaaacaccaccccgcgcacaccccgaggtcctagtgtactttcagctacactaacccacaccatcatcatcaaacaccaacaacaccactaagagagggcttttctttgcctctttagtgactaagctcgcttagctcgaaccccacctggccaactattcaacacaacatctcttcaccaagatgctcggaatggctgccacggtattcgaacctgcgacctacagcgccagcaacatgatggacgtcgactacggtagcgacgccaacgcgtcgtcgacggggtcctcgacaaccgtcgctaacaagcggagggcgtcctctgcgttgatggccggagacagcacaatcgtgtcttcgtctgcttcatcgttcatgagctgcgacttttacgccaacaagaaggccgccgcgctcttcacccgccccagcgcgctgagcctcgacgacggcaatctcgacctggaggccgaggacatgatggagatggccgacctggcctacttcagccacgccgcctttgccgacgaccgcgtctgctttgacgacatgcccgaggagctcgtctacctcatcttcaccttcctccacggaagcgacattgccaacggcgtgcagaaggtctgtcgcaactggcgtcgcctcgcccttgacgatcagctctggctcgacctgctgaaggcktcscasatggacaagtcggactgcaacgaccasgtccagggctgttgccgaggaggagcagctgaccaagcccgcccagaagagctggaagtggctctaccagagccgcaacctgaccatcagcgacctggcccgtatcagctcgacctcggtcgtcggccgccacgagagcgccgagtacatctacgagggcgagtggaaggacggcaagcaccacggccacggaaggaagatctggaagaacatcaagtccgaggaggccaaggaggagaacggcgacgccaacggcctggtcgagggtgccgcggccgacgccgctgcgccggagaccaaccagcagtcggtggccgaccagcaccagcagtcgacgcccaatcgcgcggcgcagcccaagcgcaagcccgtcctgccctactacgagggtgagtggaaggagggcaaggagcacggcaagggcaagcgcctgttcgaggaggaccactactacgagggagagtggaaggagggcgaccgtgagggcttcggcttctaccactggcccaacgagaccttctacgagggcgagttcaaggagggcttcaggcacggccacggcacctacacctggtccgaga

SEQ ID NO: 41591 - protein, 308 aa, Panicum virgatum
  misc_feature: Ceres CLONE 2008238
  misc_feature (118)..(166): Pfam Name: F-box Pfam Description: F-box domain
  misc_feature (169)..(169): Xaa is any aa, unknown, or other
  misc_feature (178)..(178): Xaa is any aa, unknown, or other
MLGMAATVFEPATYSASNMMDVDYGSDANASSTGSSTTVANKRRASSALMAGDSTIVSSSASSFMSCDFYANKKAAALFTRPSALSLDDGNLDLEAEDMMEMADLAYFSHAAFADDRVCFDDMPEELVYLIFTFLHGSDIANGVQKVCRNWRRLALDDQLWLDLLKASXMDKSDCNDXVQGCCRGGAADQARPEELEVALPEPQPDHQRPGPYQLDLGRRPPRERRVHLRGRVEGRQAPRPRKEDLEEHQVRGGQGGERRRQRPGRGCRGRRRCAGDQPAVGGRPAPAVDAQSRGAAQAQARPALLRG

SEQ ID NO: 41592 - DNA, 352 bp, Panicum virgatum
  misc_feature: Ceres CLONE 2008238-R
gcgcctcgtgggccaagaagtatgactactactttgccatgcccatggacatgtgggagcagatgtacctccccgagatcaacaagctcatccgcgacaagaagcagcgcgagcaggaggaggaggagacccgacggatgaatctcgagttcacccagaagggcagggaggacccccgagcctggggcaagaatgccctcaactcccggtcttagagactccgcacccctcctttctctatctctactacataatcgctctctcacacgctgccttcttcctcttcatcttctatccgctcgaccggatcctttccgcgcgcgactgctgtgaatatatctctttatcaggc

SEQ ID NO: 41593 - DNA, 1599 bp, Panicum virgatum
  misc_feature: Ceres CLONE 2008241
  misc_feature: Encodes the peptide sequence at SEQ ID NO. 41594
gccacgaggcggcgaggtcgtcctcgttcgtcacccaacccaacccgtccgtctccccccacatcctccctccccagcccgtcgaaaccctagcccgcaatcccggcaaaagtctcgctctcgccgcctccccggcgccatgggcaagaagcggaagctggagagcaaatccgcggcagccgctaagtctaccccggccgctgcagccaagtccgccactgctagggccgccggcctatctgaggtcatcgcccccgccatggcgcggaaggaggagaagcttccccaggaggcaggcgtcaaggaggaggaggtcgaggaggaggtggaggtcgaggaggaagtggaggtggaggaggaggaggaggacgaggtggaggagggcgagagcgacccggcctcgattcaggcgctgctggattccttccccaaggaccagctcgtcgagctgctccgcgacgcggtcgtcgcgcacagcgacgtgctaagcgccgtccggcgcgtggccgacgccgacccggctcagcggaagatattcgtccacgggctcggctgggacgccaccgccgacaccctcaccgaggcgttcggcccctacggcgagattgaggacctcagggtcgtcagcgaccgcaacaccggcaagtgcaaggggtacggcttcatcctcttccgccaccgctcgggcgcccgcgccgctctccgcgagccccagaagaagattgggaatcgcaacactgcctgccagctcgcctctgtcggccctgtccctgctggtggtgcggccagcaactctgtgcctgccccggcgcagttgcagctgccaccggtatcagagtacacgcagcgcaagatatttgtcagcaatgttggtgcagatatcgatccccagaaactgtttcagttctttgcaaggtatggtgagattgaggagggtccgcttggacttgacaaggtcactgggaaacccaagggatttgctctctttgtctacaagactattgagagtgccaagaaggctcttgaggagccacataagcattttgaaggagttgtgctgcactgccagaaggcgattgatggaccaaagcccaacaaattggcaggacctggaggcttctacggtgctggggcttcaagtggcagcaagggggttcctggttatggagctactggtcatactctacccggaagtgttggtattggccagccaatgtcaccattggctcccagcttggcttcactgcctggaggtattgctgcagccccaggggtggatcctgctctgggacaggccttgacagctttgcttgccacccagggtgctggactgaatttgaacagcatcctgggagttggtggtaatggctcaggggtgcctcctcagggggcatctggtgccctgagtggtagcagtttgccggggatgcaaggtggttatatgggaggctatggtagttctggtgggtacgggggtgcaccgtcaggaggccctggaagaaattacatgggtcactaggatggttgtaactattttactgtggccagatgattctacatgttcctgattggcacttataaacttgctcttttaagcgg

SEQ ID NO: 41594 - protein, 459 aa, Panicum virgatum
  misc_feature: Ceres CLONE 2008241
  misc_feature (132)..(202): Pfam Name: RRM_1 Pfam Description: RNA recognition motif. (a.k.a. RRM, RBD, or RNP domain)
  misc_feature (239)..(309): Pfam Name: RRM_1 Pfam Description: RNA recognition motif. (a.k.a. RRM, RBD, or RNP domain)
MGKKRKLESKSAAAAKSTPAAAAKSATARAAGLSEVIAPAMARKEEKLPQEAGVKEEEVEEEVEVEEEVEVEEEEEDEVEEGESDPASIQALLDSFPKDQLVELLRDAVVAHSDVLSAVRRVADADPAQRKIFVHGLGWDATADTLTEAFGPYGEIEDLRVVSDRNTGKCKGYGFILFRHRSGARAALREPQKKIGNRNTACQLASVGPVPAGGAASNSVPAPAQLQLPPVSEYTQRKIFVSNVGADIDPQKLFQFFARYGEIEEGPLGLDKVTGKPKGFALFVYKTIESAKKALEEPHKHFEGVVLHCQKAIDGPKPNKLAGPGGFYGAGASSGSKGVPGYGATGHTLPGSVGIGQPMSPLAPSLASLPGGIAAAPGVDPALGQALTALLATQGAGLNLNSILGVGGNGSGVPPQGASGALSGSSLPGMQGGYMGGYGSSGGYGGAPSGGPGRNYMGH

SEQ ID NO: 41595 - DNA, 697 bp, Panicum virgatum
  misc_feature: Ceres CLONE 2008251
  misc_feature: Encodes the peptide sequence at SEQ ID NO. 41596
accacagcatctcctcatccctgagctgagcatcacagtctcctgcgagtgattagcgtgggagagaaaggcagatcaagatgccgatccgcaacatcgccgtgggcaacacccaggaggtgtaccacccgggtgccctcaaggcggcgctcgctgagttcatatccacactcatcttcgtcttcgccggccagggctccggcatggccttcggcaagctgagcggcggcggttccacccctgccgggctgatctccgctgcgattgcccacgccttcgccctgttcgttgccgtttccgtcggcgccaacatctccggcggccacgtgaacccggccgttaccttcggcgccttcctcggcggcaacatcaccctgttccgcggcatcctgtactggatcgcccagctgctgggctccaccgtggcgtgcctcctcctccgcttctccaccggcgggctccccaccggcaccttcgggctcaccggcgtgtccgtgtgggaggccgtggtgctcgagatcgtcatgaccttcggcctcgtgtacaccgtgtacgccaccgccgtggaccccaagaagggcagcctcggcaccatcgcccccatcgccatcggcttcatcgtcggcgccaacatcctcgtcggcggcgccttcgacggcgcgtccatgaaccccgccgtgtccttcggccccgccct

SEQ ID NO: 41596 - protein, 205 aa, Panicum virgatum
  misc_feature: Ceres CLONE 2008251
  misc_feature (13)..(205): Pfam Name: MIP Pfam Description: Major intrinsic protein
MPIRNIAVGNTQEVYHPGALKAALAEFISTLIFVFAGQGSGMAFGKLSGGGSTPAGLISAAIAHAFALFVAVSVGANISGGHVNPAVTFGAFLGGNITLFRGILYWIAQLLGSTVACLLLRFSTGGLPTGTFGLTGVSVWEAVVLEIVMTFGLVYTVYATAVDPKKGSLGTIAPIAIGFIVGANILVGGAFDGASMNPAVSFGPA

SEQ ID NO: 41597 - DNA, 740 bp, Panicum virgatum
  misc_feature: Ceres CLONE 2008260
  misc_feature: Encodes the peptide sequence at SEQ ID NO. 41598
ccccgcccctcctctacctccccgatctatctcgctccctcgacgccggtctcctcgccgtttggatcatctcctacatcggcgaagatgagagagatcttgcacatccagggtgggcaatgtggcaaccagattggtgccaagttctgggaggtggtgtgtgatgagcatggcattgaccctactgggcggtacactggcacctctgacctgcagttggagcgtgtcaatgtctactacaatgaggcgtcctgtggccgctttgtgccccgtgctgttctcatggaccttgagcctgggacaatggacagtgtccgcactggaccatatgggcagatcttccgccctgacaactttgtgtttgggcaatctggagctggtaacaactgggctaagggccattacactgaaggtgctgagctcattgactctgttctggatgttgtgaggaaggaagctgagaactgtgactgtctgcaaggattccaagtatgccactctcttggtggtggaactggatctggtatgggtacactgttgatctcaaagatcagggaggagtaccctgaccgcatgatgctgacattctcagttttcccctcaccaaaagtatctgatactgtggttgagccatacaatgccactctttcagtccatcagttgggtgagaatgccgatgagtgcatggttcttgacaatgaggccctctatgacatttgcttcaggactctcaagctgac

SEQ ID NO: 41598 - protein, 217 aa, Panicum virgatum
  misc_feature: Ceres CLONE 2008260
  misc_feature (45)..(217): Pfam Name: Tubulin Pfam Description: Tubulin/FtsZ family, GTPase domain
  misc_feature: Functional homolog of the protein sequence given in SEQ ID NO 50258
  misc_feature: Useful for making plants with modulated flowering time
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLGENADECMVLDNEALYDICFRTLKL

SEQ ID NO: 41599 - DNA, 649 bp, Panicum virgatum
  misc_feature: Ceres CLONE 2008261
  misc_feature: Encodes the peptide sequence at SEQ ID NO. 41600
acttttgcttctctttctctctcctcctctcctcttgcttctccctctcgctcttttcgtctccaattgctgcagtagtaggttggtttgtctgttggtgctgttcttccgttcttgatgtgggtttcggttcttgggcacctcttctcttcgcttggctaagtgaggtaattggctccaccgacatgtgaagctatctggctgtcaaagagttcggcaggacgcaagaactcggcggccttcttctccatcatctgcttctcttcttcctcgcgagaattgacgcgcgcgaattggagccatggccgcctccacgacggcggctgcgtggttcctcctcgcggtggtggtgcggcttcaggcgacggtgcccgccattgccgccggagacgacgaggcgcaggcgctgctcgccttcaggcgcgcgtcggtggcggacgacccgcgcggcgcgctcgcgggctgggcgcgggcgaactccacctcgccggcgccctgctcgtgggccggcgtctcgtgcgcgccgccgcccgacggccgcgtcgtcaccctcaacctcagcggcatggcgctcgccggcgagctccggctagacgcgctgctcgcgctcccggcgctccggcgcctcgacctccacggcaatgccttc

SEQ ID NO: 41600 - protein, 115 aa, Panicum virgatum
  misc_feature: Ceres CLONE 2008261
  misc_feature (29)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MAASTTAAAWFLLAVVVRLQATVPAIAAGDDEAQALLAFRRASVADDPRGALAGWARANSTSPAPCSWAGVSCAPPPDGRVVTLNLSGMALAGELRLDALLALPALRRLDLHGNA

SEQ ID NO: 41601 - DNA, 704 bp, Panicum virgatum
  misc_feature: Ceres CLONE 2008266
  misc_feature: Encodes the peptide sequence at SEQ ID NO. 41602
cttcttcgttcctcccactcgccgccgccacctcacgagcaacaggcgctccagctcccggagctcgcccgccttgccagcatggtaagcgagaagacccgatgcttccgtgttctgttgcccgtgttaatctcgcgtttgttttcttctcccgcagatcatccctaagaagaaccgcaatgagatctgcaagtacctcttcaaagagggcgtgctgtacgccaagaaggactacaacctggcgaagcacccgcagattgacgtgcccaacctgcaggtgatcaagctcatgcagagcttcaagtccaaggagtacgtcagggagaccttctcctggcagtactactactggtacctcaccaacgatggcattgagcacctgcgcaactacctcaacctgccttctgagatcgtgcctgccacgctcaagaagtctgccaggccgcctggccgcccgtttggctctggtcctcctggtgaccgcccaaggggcccacctcgctttgaaggcgacaggccaaggtttggtgacagggaagggtaccgtggtggtcctcggggtgctcctggtgacttcggtggtgagaagggtggagctcctgctgagtttcagccatctttcaggggttctggtgccagacctggctttggccgcggggggtggcagcggctttggccgccggcccgacctcttcttccaggga

SEQ ID NO: 41602 - protein, 138 aa, Panicum virgatum
  misc_feature: Ceres CLONE 2008266
  misc_feature (1)..(53): Pfam Name: S10_plectin Pfam Description: Plectin/S10 domain
MQSFKSKEYVRETFSWQYYYWYLTNDGIEHLRNYLNLPSEIVPATLKKSARPPGRPFGSGPPGDRPRGPPRFEGDRPRFGDREGYRGGPRGAPGDFGGEKGGAPAEFQPSFRGSGARPGFGRGGWQRLWPPARPLLPG

SEQ ID NO: 41603 - DNA, 703 bp, Panicum virgatum
  misc_feature: Ceres CLONE 2008281
  misc_feature: Encodes the peptide sequence at SEQ ID NO. 41604
cttcgcctcgctttccccccaacctccctccctcgatcccctcgccgggaagatccgatcccatcccatccacctctcccggctcaatcagagccctccactcggcggaggagaagaccagggcggaggcggaaggaatgttgcgcctttgatcgacgcggcgtcgcggtggtggttctcctggcccgcggcgatgggctgcttctcctgcttcgactcgcccgccgatgagcagctcaaccccaagctcggcggcgccggggggtacggtggcccgtcctcggccgccgcggcgtacggcgccggctccggcggcggccggcacggggacagggggtacccggacctgcagcaggcgcccatggcggccccgcgcgtcgagaagctctccgcagcggctgaaaaagcgagggtcaagagtaatgcgctcgcgagagaggcttcagcgccaaaggatgccaatggcaatgttatctctgcgcaaactttcaccttccgcgagcttgccacagccaccaggaacttcaggcccgagtgcttcctgggagaaggagggtttggacgcgtttacaaaggccgtctcgagagcacaggccaggttgttgctataaagcagcttaatagggatgggcttcaaggaaacagagaatttctagtagaagtcctcatgctcagtttattgcatcatcaaaacctggttaat

SEQ ID NO: 41604 - protein, 169 aa, Panicum virgatum
  misc_feature: Ceres CLONE 2008281
  misc_feature: SWISSPROT Homolog: EC 2.7.11.1 Non-specific serine/threonine protein kinase
MGCFSCFDSPADEQLNPKLGGAGGYGGPSSAAAAYGAGSGGGRHGDRGYPDLQQAPMAAPRVEKLSAAAEKARVKSNALAREASAPKDANGNVISAQTFTFRELATATRNFRPECFLGEGGFGRVYKGRLESTGQVVAIKQLNRDGLQGNREFLVEVLMLSLLHHQNLV

SEQ ID NO: 41605 - DNA, 678 bp, Panicum virgatum
  misc_feature: Ceres CLONE 2008288
  misc_feature: Encodes the peptide sequence at SEQ ID NO. 41606
agggctgcgcgtgctgggcgagcaacagaacagagctgcagctgcaaccagacagcaaaagcactgcatgttctagtgagtgccttactctatagctgtctgctagcgtctagatatcacacgagtcaagctatcagagtttaacctctcgatcactcctcgattgtcggcggcgaacaaacgccatggaggtgaaggtgctgagctccaagctcgtgaggccgtcgtacccggacaccacggagcacgttccgtcgtcggtgttcgacaaggccacgtaccacatccagatggccatcatctacgcgttcgcgccgccggggccctccgcggccgacatcgagcgcgggctcgccgcggtgctgggcgtgtaccgcctcttcgcggggcaggtccgccctggcctcgacggctgccccggggtgctgctcaacgaccacggcgcgcggctcgtggaggcgtccgtggacgcgcacctcgccgacatcgcgccggcgaagccgtcgcccgccgtgctgcggctgcacccggacctggagggcgagatcgaggagatggtgcaggtgcagctcacgcggttcgcgtgcggctccctcgccgtgggcttcaccgccaaccacgccgtggcggacgggcacgccaccagcgacttccttgtcgcgtggggccgcgccgcgc

SEQ ID NO: 41606 - protein, 164 aa, Panicum virgatum
  misc_feature: Ceres CLONE 2008288
  misc_feature: SWISSPROT Homolog: EC 2.3.1.167 10-deacetylbaccatin III 10-O-acetyltransferase
MEVKVLSSKLVRPSYPDTTEHVPSSVFDKATYHIQMAIIYAFAPPGPSAADIERGLAAVLGVYRLFAGQVRPGLDGCPGVLLNDHGARLVEASVDAHLADIAPAKPSPAVLRLHPDLEGEIEEMVQVQLTRFACGSLAVGFTANHAVADGHATSDFLVAWGRAA

SEQ ID NO: 41607 - DNA, 559 bp, Panicum virgatum
  misc_feature: Ceres CLONE 2008295
  misc_feature: Encodes the peptide sequence at SEQ ID NO. 41608
aagatcagatcacactcgcttacgcttagccgccgccgagctcagctcactcagctcactctcacagtctcactaactcgcacacagtgagtgccagccagccagccagcagcatgggctcgccggcggcgcgccagctgaggcagctgaagccgctgtaccagcacgcggtgaaccacttcgtggccgtgctcgcggcgccgctggccgtggcggccgccgtcggcgcggcgcgcgccgggcccggggagctgctcgtccggctgcaggcgctccgggcggcgcacgtgctcctcgccgcgtgcgtccccgccgcggcggaggcgctgtatctcctgctgcggccgcgggcggtgtacctggtcgactacgcctgcttccgcacgcggcccaactgccgcgtccccttcgccaccttcgtggagcacgccaagctggtgaccttcgcggagggcgcccccatcgacgagcgcagcgtccggttcatgacccggctgctggagcgctcggggctcggggaggagacatgcctgcccccggaccaccactacatcccgcc

SEQ ID NO: 41608 - protein, 148 aa, Panicum virgatum
  misc_feature: Ceres CLONE 2008295
  misc_feature: SWISSPROT Homolog: EC 2.3.1.119 Icosanoyl-CoA synthase
MGSPAARQLRQLKPLYQHAVNHFVAVLAAPLAVAAAVGAARAGPGELLVRLQALRAAHVLLAACVPAAAEALYLLLRPRAVYLVDYACFRTRPNCRVPFATFVEHAKLVTFAEGAPIDERSVRFMTRLLERSGLGEETCLPPDHHYIP

SEQ ID NO: 41609 - DNA, 697 bp, Panicum virgatum
  misc_feature: Ceres CLONE 2008303
  misc_feature: Encodes the peptide sequence at SEQ ID NO. 41610
tggatccaaaccggcagcggcattgctagcctgcttactgaccgctggtgagagtgagagacgacgtctgacgagtcgcagagaagaagaaaaaaggaatctatggcgtcggcgctgtcgaggagggcgaggggctcggccacggtgctgtggggcgcggcgagggggttcgcgtcggtggggaccgacatcgtctcggcggcgcccggcgtgtcgctgcagaaggcgcggtcctgggacgaaggcgtcgccaccaagttctccaccacgcctctcaaggacatcttctacgggaagaaggtggtcatcttcggcttgcctggggcatatacaggagtttgttcacaatcacatgttcctagttacaagaacaacattgataagttgaaagcaaaaggaattgactctgttatttgtgtagctgtgaatgacccgtatgtcctgaatggatgggcagaaaagctacaggctaaagatgcaattgagttctacggcgacttcgatgggagcttccacaaaagcttggatttggagatagatctgtctgctgctttgctcggccgccgatctcacaggtggtcagctttcgttgttgatggcaagatcaagtcattcaatgttgaggaagcaccctccaatttcaaggtttctagcgcggaggtgattctttgacagatctgagcttaccaatgaacct

SEQ ID NO: 41610 - protein, 189 aa, Panicum virgatum
  misc_feature: Ceres CLONE 2008303
  misc_feature (34)..(189): Pfam Name: Redoxin Pfam Description: Redoxin
  misc_feature: SWISSPROT Homolog: EC 1.11.1.15 Peroxiredoxin
MASALSRRARGSATVLWGAARGFASVGTDIVSAAPGVSLQKARSWDEGVATKFSTTPLKDIFYGKKVVIFGLPGAYTGVCSQSHVPSYKNNIDKLKAKGIDSVICVAVNDPYVLNGWAEKLQAKDAIEFYGDFDGSFHKSLDLEIDLSAALLGRRSHRWSAFVVDGKIKSFNVEEAPSNFKVSSAEVIL

SEQ ID NO: 41611 - DNA, 770 bp, Panicum virgatum
  misc_feature: Ceres CLONE 2008314
  misc_feature: Encodes the peptide sequence at SEQ ID NO. 41612
ggttgtacttcttggcaggacatagctgttgctcttcttcctcgtggagtgtccatgaggtggatgcagcatccctagcgctaggatctgtggctgaatggggagaatgaaaggggtatccgaaggtctgatcatcggaatcactgtcggggtggtgataggtgtgctgctggcagtgggaatcctgctgtgctttaggtacaggcgttcccgggcgcagatgaggagtagcagctcaaggagggcatcgacagttcccatccgtaccaatggtgttaatgcatctgccatgctctcgaactcgactacagggcaggagtctccaagagaacttgaagaccatgggagttctctgtggattgaagggcctggccgaaagaacatgacttcggcttctggaatacccaaatatgcatacaaggaactacagaaagctacctgcaatttcacaacattattaggtcaaggagccttcggccctgtttacaaagcagacatgacttctggtgagatattggctgttaaagtgctttctaacaattcaaaacaaggtgaaaaggagtttcataatgaggtcttacttcttggacgattgcaccacaggaatctggtgaatttggttggctattgtgctgacaaagggcaacatatgttattgtatgcatacatgcctaatgggagccttgcatcacacttatatggtgaaaacagtgcacccctgaaatggaatttgagagtcaacatagctctggatgttgcttgggggtttg

SEQ ID NO: 41612 - protein, 224 aa, Panicum virgatum
  misc_feature: Ceres CLONE 2008314
  misc_feature (115)..(224): Pfam Name: Pkinase_Tyr Pfam Description: Protein tyrosine kinase
  misc_feature: SWISSPROT Homolog: EC 2.7.11.1 Non-specific serine/threonine protein kinase
MGRMKGVSEGLIIGITVGVVIGVLLAVGILLCFRYRRSRAQMRSSSSRRASTVPIRTNGVNASAMLSNSTTGQESPRELEDHGSSLWIEGPGRKNMTSASGIPKYAYKELQKATCNFTTLLGQGAFGPVYKADMTSGEILAVKVLSNNSKQGEKEFHNEVLLLGRLHHRNLVNLVGYCADKGQHMLLYAYMPNGSLASHLYGENSAPLKWNLRVNIALDVAWGF

SEQ ID NO: 41613 - DNA, 689 bp, Panicum virgatum
  misc_feature: Ceres CLONE 2008318
  misc_feature: Encodes the peptide sequence at SEQ ID NO. 41614
aaggtagggtaaggaagcaggagcgtaccccgccgccgccgccgccgccgccatgaagcgcaacccccgcgtcacgagctcccgccggaagtgccgcaaggcgcacttcacggccccgtcctccgtccgccgcgtgctcatgtccgcggcgctgtcgacggagctcctccacaagtacaacgtgcgctccatcccgatccgcaaggacgacgaggtgcaggttgtgcgcggcaccttcaagggccgcgaggggaaggtggtgcaggtgtaccgccgccgctgggtcatccacgtcgagcggatcacccgcgagaaggtgaacggctccaccgtcaacgtgggcatccacccctccaaggtcatcgtcaccaagctgaagctcgacaaggaccgcaaggcgctcctcgaccgcaaggcacgcggccgcgccgccgacaaggccaagggcaagttcaccgccgacgacgtcgccgccgctgctggtggggccggcgccaccggtgcctccctccaggagatcgactaggcgctgcgcggcggggatctgatggtggtcgtgctgcctttccctccttatcgctcgctctagttttgctatctatgattatgtggattttatgtgtctgagatttgagatatgaagtactcgttacatggttaatcatttcacttcgttgatcttatcttcc

SEQ ID NO: 41614 - protein, 157 aa, Panicum virgatum
  misc_feature: Ceres CLONE 2008318
  misc_feature (51)..(82): Pfam Name: KOW Pfam Description: KOW motif
  misc_feature: Functional homolog of the protein sequence given in SEQ ID NO 51460
  misc_feature: Useful for making plants with modulated biomass
MKRNPRVTSSRRKCRKAHFTAPSSVRRVLMSAALSTELLHKYNVRSIPIRKDDEVQVVRGTFKGREGKVVQVYRRRWVIHVERITREKVNGSTVNVGIHPSKVIVTKLKLDKDRKALLDRKARGRAADKAKGKFTADDVAAAAGGAGATGASLQEID

SEQ ID NO: 41615 - DNA, 584 bp, Panicum virgatum
  misc_feature: Ceres CLONE 2008323
  misc_feature: Encodes the peptide sequence at SEQ ID NO. 41616
aacgccaagctaccagcgcgtcgcctaccctgtctctgtcagcctgcccccctcccccttcccctcggttccggcgggcatggcggtggcggctccccgagaactcaacctcgaccaagccccgtcatggggctcccgcagcgtcgactgctttgagaacctcgagcacatcggggagggcacctatgggaaagtgtacatggagaaagagacgggcaccaacgagatcgttgccctcaacaagatccgcatggacaacgagcgggagggcttccctattactgccatacacgagatcaagatcctgaagaagcttcaccaccagaacgtcatcaagctcaaggagattgtcacctccccaggcccagagcgacatgagcaaaggaagccgatagatggaaacaagcacaaagggagcatttacatggtctttgagtatatggatcatgacctcacccgtcttgccgataggccacgactgccgttcactgagccacagattaagtgttacatgacgcatcagcttacccgacggcactatcgccatctcaatcaagtgctacatcgagatattaaaggatcta

SEQ ID NO: 41616 - protein, 168 aa, Panicum virgatum
  misc_feature: Ceres CLONE 2008323
  misc_feature (25)..(168): Pfam Name: Pkinase Pfam Description: Protein kinase domain
  misc_feature: SWISSPROT Homolog: EC 2.7.11.22 Cyclin-dependent kinase
MAVAAPRELNLDQAPSWGSRSVDCFENLEHIGEGTYGKVYMEKETGTNEIVALNKIRMDNEREGFPITAIHEIKILKKLHHQNVIKLKEIVTSPGPERHEQRKPIDGNKHKGSIYMVFEYMDHDLTRLADRPRLPFTEPQIKCYMTHQLTRRHYRHLNQVLHRDIKGS

SEQ ID NO: 41617 - DNA, 702 bp, Panicum virgatum
  misc_feature: Ceres CLONE 2008334
  misc_feature: Encodes the peptide sequence at SEQ ID NO. 41618
aagaggccttggtcaagcatcagtcctggtgctaaagattttgttaaaaggttactagtcaagaacccaagggcaagactaacagctgctcaagctctctcgcatccatgggttagagaaggaggagaagcatctgagatccctgtcgacatatctgtcttatccaacatgcgccagtttgtcaagtacagccgctttaagcagtttgcacttagggctttagcaagtacactcaatgaggaagagctagctgatctgaaggatcagtttgatgcaattgatattgataaaaatggatccattagtattgaggaaatgcgaaatgcccttgcaaaggatcttccttggagattgaagggtccccgtgtgcttgagattattcaagcaatcgacagcaacaccgatggtcttgtggacttcaaagagttcgttgcagcaactctccatatacatcagatggccgagctagactctgaaaggtggggcattcgatgccaagctgctttcagcaaatttgatctggatggtgatggatacatcacgccagaggagcttagaatgatgcagcacactggcttaaagggatctattgagccgctgctggaggaggccgacatcgataaagatgggagaataagcctgtctgaattccgcaagctcctgcgaactgcgagcatgagcaatgttcccagcccagggggc

SEQ ID NO: 41618 - protein, 233 aa, Panicum virgatum
  misc_feature: Ceres CLONE 2008334
  misc_feature (164)..(192): Pfam Name: efhand Pfam Description: EF hand
  misc_feature (85)..(113): Pfam Name: efhand Pfam Description: EF hand
  misc_feature (196)..(224): Pfam Name: efhand Pfam Description: EF hand
  misc_feature: SWISSPROT Homolog: EC 2.7.11.1 Non-specific serine/threonine protein kinase
KRPWSSISPGAKDFVKRLLVKNPRARLTAAQALSHPWVREGGEASEIPVDISVLSNMRQFVKYSRFKQFALRALASTLNEEELADLKDQFDAIDIDKNGSISIEEMRNALAKDLPWRLKGPRVLEIIQAIDSNTDGLVDFKEFVAATLHIHQMAELDSERWGIRCQAAFSKFDLDGDGYITPEELRMMQHTGLKGSIEPLLEEADIDKDGRISLSEFRKLLRTASMSNVPSPG

SEQ ID NO: 41619 - DNA, 747 bp, Panicum virgatum
  misc_feature: Ceres CLONE 2008347
  misc_feature: Encodes the peptide sequence at SEQ ID NO. 41620
agagcgagacgcgtcgtccctccccacccccgccgccgccgcctcgcgcccgtgcgttccttccccacccgcgtagggttagggtttgcttggtccccgccgccatggcgatcctctcggcgctcgcgaccgaggtgctcatccccgtcgccggcgtcatcggcatcgccttcgccgtcgtgcagtgggtgctcgtgtcgcgggtgaagctctccccggccgcggccgccgcgggcggcagcaagaacgactacggcgactacctcatcgaggaggaggaggggctcaacgaccacaacgtcgtcgtcaagtgcgccgagatccagaacgccatctccgaaggagcaacatcgtttctcttcacggagtaccaatatgttggtattttcatgtcgatctttgctgttgtcatctttctcttccttggctctgttgagggattcagcacaaagagccagccctgcacctatagcgtgggcaagtactgcaagcctgccctgttcactgcactcttcagcactgcatccttcttgcttggagccatcacctctttggtctctggtttccttgggatgaagattgccacatatgccaatgccagaaccaccctggaagctaggaagggtgttggaaaggcattcatcaccgcgttccgctctggtgctgttatgggctttttgctcgcatcaagtggtcttgtggttctctacatcaccattaatgtatttaagttgtactatggtgatg

SEQ ID NO: 41620 - protein, 214 aa, Panicum virgatum
  misc_feature: Ceres CLONE 2008347
  misc_feature (6)..(214): Pfam Name: H_PPase Pfam Description: Inorganic H+ pyrophosphatase
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
MAILSALATEVLIPVAGVIGIAFAVVQWVLVSRVKLSPAAAAAGGSKNDYGDYLIEEEEGLNDHNVVVKCAEIQNAISEGATSFLFTEYQYVGIFMSIFAVVIFLFLGSVEGFSTKSQPCTYSVGKYCKPALFTALFSTASFLLGAITSLVSGFLGMKIATYANARTTLEARKGVGKAFITAFRSGAVMGFLLASSGLVVLYITINVFKLYYGD

SEQ ID NO: 41621 - DNA, 743 bp, Panicum virgatum
  misc_feature: Ceres CLONE 2008350
  misc_feature: Encodes the peptide sequence at SEQ ID NO. 41622
gacacccaagttattacaagcacgagcataaagtggcaagccggcaatgtcgccatagctgggcttggaagcatcattggcacacaacaatggaagaccatcactacctctacctcggcttggccctggtgtcgctgctgctcgccgtgatcgctaagcaccggcgcggcccggcgcacggccgccatggcctgcggctgccgccggggccgtggcagctgccgatcatcggcggcatgcaccacctcgcgggccagctcccgcaccgcgcgatgcgggacttggcgctgcgccacgggccggtgatgctgctccggatcggggaggtgcccacggtggtggtctcgtcccgggaggcggcgcgcgaggtgatgaagacgcacgacgccgcgttcgcgtcgcggccgctgagcgccaccgtgcgcgtgctcaccaacggcggccgggacatcatcttcgcgccgtacggggagcactggcgccagctccggaaggtcgccatcacggagctcctcagcgcgcggcgggtgctgtcgttccgcgccatccgcgaggaggaggtcggcgcgatgctgcgcgcgtgcgccgccgccgccgccgccgcggcgcccgtcgagatgcgcgcgcggctgtcggcgctcgtgtccgacgtcacggtgcgcgccgtgatgggcgaccggtgcagggaccgcgacgtgttcatccgggagctcgaccgctccatcgagctcggggcggggttc

SEQ ID NO: 41622 - protein, 217 aa, Panicum virgatum
  misc_feature: Ceres CLONE 2008350
  misc_feature: SWISSPROT Homolog: EC 1.14.13.68 4-hydroxyphenylacetaldehyde oxime monooxygenase
MEDHHYLYLGLALVSLLLAVIAKHRRGPAHGRHGLRLPPGPWQLPIIGGMHHLAGQLPHRAMRDLALRHGPVMLLRIGEVPTVVVSSREAAREVMKTHDAAFASRPLSATVRVLTNGGRDIIFAPYGEHWRQLRKVAITELLSARRVLSFRAIREEEVGAMLRACAAAAAAAAPVEMRARLSALVSDVTVRAVMGDRCRDRDVFIRELDRSIELGAG

SEQ ID NO: 41623 - DNA, 1126 bp, Panicum virgatum
  misc_feature: Ceres CLONE 2008357
  misc_feature: Encodes the peptide sequence at SEQ ID NO. 41624
gaccatcgaaacacagagcttcttgtctgtctgtctgtccagtgctagcaaccaacgagctagtagctagctagtaagagacgacgatggcgtccatgatcgccggctcgtccaaagtggttgcactcggtgcactgatgatcacgatcttctccctccttgtctcgtacggctcgtgcgctaggccgccgccggtgagctttaacgcctccgccttcacggccgaccccaactgggaggccgccagggccacctggtacggcgcgcccaccggagccggccccgacgacgatggtggcgcctgcgggttcaagaacgtcaacctgccgccgttctcggccatgacatcgtgcggcaacgagccgctgttcaaggacggcaagggctgcggctcctgctaccagataagatgtaccaaccaccctgcgtgctccggcaacccggtgtaacgaacatggcaccattttatgcatttcgagtgattttggtgatcgaatgacaacacaacacttggactaatatgactgttaagatgatcattctcaggcttttaggttcaagtgatgacaaagagaaagagaaaataggcgtagcaaggcccgaagggcagcccctacgggggttccgctacccggttagcggacgggggtcgagggggagccgcccctcgcgggtctcagggcagcgccctgaaagctcttcggatcaggagcaccggaagaaccgacgccaggggcaccggtgcatccgacgcttgtcggaagaaccgacgctacgatgtttggtgcaggaggaaatcgaagccaagtcagcctacagtcaccggttgaaccgactgtccaagaaagggcatcggtgcattggccgttctttgtaccagagacgatgtcaagtgcacaggagaagtttcttcagcaccggttcaaccgacggggcatcggtgcataccaccggtgtaatgacgtcagcgtccaggagaagattccttcagcaccggttgaaccggtgaggcatcggtgcaaagcatcggttcaaccggtggtctctgcgtcagccgacaggagtccaatggctactttgtgttatgagtgaccggatgaaccgacgctaccccgcccagaggcat

SEQ ID NO: 41624 - protein, 120 aa, Panicum virgatum
  misc_feature: Ceres CLONE 2008357
  misc_feature: Functional homolog of the protein sequence given in SEQ ID NO 51070
  misc_feature: Useful for making plants with altered carbohydrate content
  misc_feature: Functional homolog of the protein sequence given in SEQ ID NO 51592
  misc_feature: Useful for making plants with altered cell wall content and/or composition
MASMIAGSSKVVALGALMITIFSLLVSYGSCARPPPVSFNASAFTADPNWEAARATWYGAPTGAGPDDDGGACGFKNVNLPPFSAMTSCGNEPLFKDGKGCGSCYQIRCTNHPACSGNPV

SEQ ID NO: 41625 - DNA, 137 bp, Panicum virgatum
  misc_feature: Ceres CLONE 2008357-R
aggcagcgggaggcccaagacaccacagacacacccaagaacaaccccaagccacacaagagcccagagaacaaacccgcagcccagagcaccagcgggggaaaggcggagcgcgagaccagcaccgggggagcgag

SEQ ID NO: 41626 - DNA, 782 bp, Panicum virgatum
  misc_feature: Ceres CLONE 2008360
  misc_feature: Encodes the peptide sequence at SEQ ID NO. 41627
ctagtcagccagatcgctgcgtcgctccgcctcctcctcctaccctccgtgcggcgcctttctcggttcttcggtcggggttgggagatgtctgacgaggagcaccatttcgagtcgaagggcgacgccggcgcctccaagacctacccgcagcaggccggcacaatccgcaagaacggccacatcgtcatcaagggccgcccgtgcaaggtggttgaggtctccacttccaagacagggaagcacggtcacgccaaatgccacttcgtggccattgacattttcaatggaaaaaagcttgaggatattgtgccctcctcccataactgtgatgtgccccacgtcaaccgtactgattaccagctcattgacatatctgaggatggatttgtcagtctgctgaccgaaagtggagacactaaggatgatctaaggctccccactgatgaaactctgcttaaacagcttaaggatggatttgcggaggggaaggacctgattcttagtgtgatgtctgccatgggtgaggagcagatctgcggtctgaaggatatcggcggcaagaactagagctgctttgccactggtgattatttatctggttatctatttgggaggtggtgtgttgatgatataagcgtgtttggttgtgagtgacatgcttctggactgccattttgtcttgcggtttatgcagagtgatctggatgtacctttaatatatgtaccgttcttttgaaccaagtagctttgctacacctccggtcgtttgggctgttcgg

SEQ ID NO: 41627 - protein, 160 aa, Panicum virgatum
  misc_feature: Ceres CLONE 2008360
  misc_feature (85)..(154): Pfam Name: eIF-5a Pfam Description: Eukaryotic initiation factor 5A hypusine, DNA-binding OB fold
  misc_feature (29)..(63): Pfam Name: KOW Pfam Description: KOW motif
MSDEEHHFESKGDAGASKTYPQQAGTIRKNGHIVIKGRPCKVVEVSTSKTGKHGHAKCHFVAIDIFNGKKLEDIVPSSHNCDVPHVNRTDYQLIDISEDGFVSLLTESGDTKDDLRLPTDETLLKQLKDGFAEGKDLILSVMSAMGEEQICGLKDIGGKN

SEQ ID NO: 41628 - DNA, 662 bp, Panicum virgatum
  misc_feature: Ceres CLONE 2008393
  misc_feature: Encodes the peptide sequence at SEQ ID NO. 41629
gcttcaattccttctccaaccccacccaacccaatcgacgccaccaccagcagctagcgcccaaccatcatcgatcgatccatccatggggcggtcgccgtgctgcgagaaggcgcacaccaacaagggcgcctggaccaaggaggaggacgaccgcctcgtggcctacatccgggcgcacggcgagggctgctggcgctccctccccaaggccgccggcctcctgcgctgcggcaagagctgccgcctgcgctggatcaactacctccgccccgacctcaagcgcggcaacttcaccgccgacgaggacgacctcatcgtcagcctccacagcctcctcggcaacaagtggtcgctcatcgccgcgcgcctccccggccgcaccgacaacgagatcaagaactactggaacacgcacatccgccgcaagctcctcgccaggggcatcgaccccgtcacgcaccgccccgtcgccgccgacgccaccgtctccttccacccgccgcagctcaagccgcccaggtgccccgacctcaacctcgacctctgcatcagcccgccgtgccgccaggacgaggaccaggagctcatcaagcccgtcgtcgtcgtcaagcgcgagctgctgcagtccggccacggcgcatggctctgctttggctgca

SEQ ID NO: 41629 - protein, 192 aa, Panicum virgatum
  misc_feature: Ceres CLONE 2008393
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1010 in the 11/435,388 US patent application
  misc_feature: The sequence is a functional homolog of SEQ ID NO 1002 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1073 in the 10/374,780 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 58 in the 10/666,642 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 836 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 126 in the 10/412,699 US patent application
  misc_feature: Functional homolog of the protein sequence given in SEQ ID NO 50733
  misc_feature: Useful for making plants with altered cell wall content and/or composition
MGRSPCCEKAHTNKGAWTKEEDDRLVAYIRAHGEGCWRSLPKAAGLLRCGKSCRLRWINYLRPDLKRGNFTADEDDLIVSLHSLLGNKWSLIAARLPGRTDNEIKNYWNTHIRRKLLARGIDPVTHRPVAADATVSFHPPQLKPPRCPDLNLDLCISPPCRQDEDQELIKPVVVVKRELLQSGHGAWLCFGC

SEQ ID NO: 41630 - DNA, 639 bp, Panicum virgatum
  misc_feature: Ceres CLONE 2008404
  misc_feature: Encodes the peptide sequence at SEQ ID NO. 41631
acatgcggggccccgctcgcgaaccctagatccgaacaaccccgcactcggctggcacgcgatcccttgccttatctccccgagccattaccagcggcggctggaaccgggggtacgaggtacgcggtgtcggagcccgccgcccccgcttgcggcgcccggagcgcccgcatcgcaccgctgacgccggccggcgggttccccgcgccgcgccctagactcgcagatccgccgacgtcccaggaagcagaacttatggggaaggaacaaattgtagctgttcttcaaataggtggagaattcaccaccgatgcagatggacacatgtcttattctggtggagaggcacatgcaatgcttgtccaaagtgactggacttttagtacatttaagcaagagatatcatcgacacttaacaacctgaaacttgatcagttcgcattcaagtatttccttccaaagaatgataaaaccttgatttctatttccaatgacaaggacctacgccgcatggttgaattcaatgcagagtcagaaacaacatacatttatgttatgaagaaagctgacaacaggtcaaagagcattgttcctgtctcgggtgctgctacagatgcctttgctgttgtcccaacaact

SEQ ID NO: 41631 - protein, 127 aa, Panicum virgatum
  misc_feature: Ceres CLONE 2008404
  misc_feature (19)..(103): Pfam Name: PB1 Pfam Description: PB1 domain
MGKEQIVAVLQIGGEFTTDADGHMSYSGGEAHAMLVQSDWTFSTFKQEISSTLNNLKLDQFAFKYFLPKNDKTLISISNDKDLRRMVEFNAESETTYIYVMKKADNRSKSIVPVSGAATDAFAVVPT

SEQ ID NO: 41632 - DNA, 593 bp, Panicum virgatum
  misc_feature: Ceres CLONE 2008408
  misc_feature: Encodes the peptide sequence at SEQ ID NO. 41633
ggagcccttggctttttctgaggagaagcagagcggagggagagacaagagaggcgcctgcgtggtcggtgcctgcgtggcgtggtggccgtgccgtgccgtcccctctccctctcttcctttcggcgccggcggacgtgtcgggggaggaatggccgcggcgagggctccgctcggggcggtcgcggtggccgcgctcgtcgtcgccatcttcatgccggccgcggcggcgcaagggccggcgccggctcccaccagcgacggcacatcaatcgacctgggaatcgcgtacgtcttgatgctggtggccctggtgctcacctacctgatccacccgctggacgcctcctctccctacaagctcttctaatccctgttcgtttcatttgttggacgatgatgttatggatctgataggatttttagccatgcaagacgtttaggtgaggtttggagatttagaatgaacgtcaacatctgatctgatgttggtatgtatggtaagtttttggtggtctgaatgcctgattggttgtatcggattccatgatcttgtgccctgttgtgcttgctgttggccgttgctggattct

SEQ ID NO: 41633 - protein, 72 aa, Panicum virgatum
  misc_feature: Ceres CLONE 2008408
  misc_feature: Functional homolog of the protein sequence given in SEQ ID NO 50456
  misc_feature: Useful for making plants with altered carbohydrate content
  misc_feature: Functional homolog of the protein sequence given in SEQ ID NO 50457
  misc_feature: Useful for making plants with altered cell wall content and/or composition
  misc_feature: Useful for making plants with modulated nitrogen use efficiency
  misc_feature: Useful for making plants with modulated salt sensitivity
MAAARAPLGAVAVAALVVAIFMPAAAAQGPAPAPTSDGTSIDLGIAYVLMLVALVLTYLIHPLDASSPYKLF

SEQ ID NO: 41634 - DNA, 788 bp, Panicum virgatum
  misc_feature: Ceres CLONE 2008419
  misc_feature: Encodes the peptide sequence at SEQ ID NO. 41635
atggcccattggtggtcagccaggtcttagccacggcccacgtcctgacagtcaagcggctcctccccgaccgccgatccgcactcgccctccgcccctcccgattccccagccccgcaccggccgcgcccgaatccagaaccctaggcggcgaggcgggtaggccactggcggtcggcggcgagtcggcgaccttcgagcgagcggccagcagcagcgcagctccgcactttcagcaggcgacaggcgctccgcggcgaacggcgggtcggtggccagctaggcagcggcgctgcggcggagcggtcgagcaccccgcggccagcgcgccgtgaagggcttcgcggcggcagacgcggctccgccagcgcaagggccggcgccggggcacgggtccggcgacggtcggcgggcacagcgcggcctgactcctgagcgcggcaaccggccagacgccaagacagcaagcaaagcaaccgacccagtgaattaccaaggttgagcaaatatcttttttttggccaatggcaagggaacctagtcctgaaatagatgatgagcttttcaatgaagtttatgggaaagcatatagtggtccagttgcatcagctgcaaattcagctacaaatagtgtgatgcctaaagtaaatgacgagaagaggcccttgactcgtaatacgtcagatgatgaagatgaggccccagatcctaatgctgttcctaccgacttcactagcagagaggctaaggtctgggaggctaaagctaaggccacagaaagaaaccgg

SEQ ID NO: 41635 - protein, 87 aa, Panicum virgatum
  misc_feature: Ceres CLONE 2008419
  misc_feature: Functional homolog of the protein sequence given in SEQ ID NO 51636
  misc_feature: Useful for making plants with altered alkaloid content
MAREPSPEIDDELFNEVYGKAYSGPVASAANSATNSVMPKVNDEKRPLTRNTSDDEDEAPDPNAVPTDFTSREAKVWEAKAKATERN

SEQ ID NO: 41636 - DNA, 674 bp, Panicum virgatum
  misc_feature: Ceres CLONE 2008422
  misc_feature: Encodes the peptide sequence at SEQ ID NO. 41637
gcacggactccccctcctccctcctcgcaagagccaccgcgacgccgcgcgcctgcagccgcgatctaccgcccggcgagacgagagcgcccccgcgcccccagggaatgcggagcgatgaggcggcgctcaggcactgacgtcgccggccagcgcgagcttcgcggcggccgcacctgccaccgcaagcacgtcgaggacgggtagacgcccgcccccaatcccatccttcccgccgttagtcatcgtagggtagagttttctctcagtttggattggatcggaaggaggaggagtagggggatcatcgaccgattgatcgatcgatcgatcgagcatcatgggggacggtcacggtgacggggaggtgaaggccggcggggtgctgcaggggcgctacgagctcggccgcgtcctggggcacggcaacttcgggcgcgtccacgcggcgcgggacctgcgcacgggccggagcgtggcggtgaaggtgctgtccaaggaccgggtggtgcgcgcggggatgatggagcagatcaagcgcgagatcgccgtcatgaagcgggtgtcccaccccaacatcgtcgagctccacgaggtgatggccacgcgctccaggatctacctggcgctcgagctcgtccgcggcggggagctcttcgcgcggatcgtgcgcg

SEQ ID NO: 41637 - protein, 111 aa, Panicum virgatum
  misc_feature: Ceres CLONE 2008422
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
  misc_feature: Functional homolog of the protein sequence given in SEQ ID NO 50696
  misc_feature: Useful for making plants with modulated salt sensitivity
MGDGHGDGEVKAGGVLQGRYELGRVLGHGNFGRVHAARDLRTGRSVAVKVLSKDRVVRAGMMEQIKREIAVMKRVSHPNIVELHEVMATRSRIYLALELVRGGELFARIVR

SEQ ID NO: 41638 - DNA, 712 bp, Panicum virgatum
  misc_feature: Ceres CLONE 2008426
  misc_feature: Encodes the peptide sequence at SEQ ID NO. 41639
gcggacggcaactggcaccgtgtcagcaagggagctcctgagcagattcttgacctgtgcaactgcagagaggatatgaagaggaaggtgcactctataatcgacaagtatgctgagcgcggtcttcgttcacttgctgtcgccagacaggaagtacctgagaaatcaaaggactcccctggtgggccatggcaattcgttggtttgttgcccctgtttgacccccctaggcatgacagtgctgagacaatccgcaaggctcttgttcttggtgttaacgtcaagatgatcactggtgaccagcttgccattggtaaggaaactggaaggaggcttggcatgggtaccaacatgtatccttcctcctctttgctgggccaaaacaaggactctactcttgaagcacttcctgtcgatgagctcattgagaaggctgatggttttgctggagtcttccctgaacacaagtacgagattgtgaagagattgcaagagaagaagcacatcgttggtatgactggagatggtgtcaacgatgccccagctcttaaaaaggctgacattggtattgccgtcgctgatgctactgatgctgcaaggagtgcttctgatatagtacttactgagccgggtcttagcgtcattatcagcgctgtcctcaccagcagatgcatcttccagaggatgaagaactacactatttacgctgtct

SEQ ID NO: 41639 - protein, 237 aa, Panicum virgatum
  misc_feature: Ceres CLONE 2008426
  misc_feature (1)..(196): Pfam Name: Hydrolase Pfam Description: haloacid dehalogenase-like hydrolase
  misc_feature: SWISSPROT Homolog: EC 3.6.3.6 Proton-exporting ATPase
ADGNWHRVSKGAPEQILDLCNCREDMKRKVHSIIDKYAERGLRSLAVARQEVPEKSKDSPGGPWQFVGLLPLFDPPRHDSAETIRKALVLGVNVKMITGDQLAIGKETGRRLGMGTNMYPSSSLLGQNKDSTLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAV

SEQ ID NO: 41640 - DNA, 1270 bp, Panicum virgatum
  misc_feature: Ceres CLONE 2008440
  misc_feature: Encodes the peptide sequence at SEQ ID NO. 41641
acccatctgctctctcgtcctcgatcctaatcataggccggctcgaggtgccgcccaattcaacggggctcgcattctttactgccactgctcctcctgctcctgaatcattgtatacttggagcggtttggtttggcctccctctcaattctttactagccttttcttttgtccctgcttcggagggaggggaagagagagagaaagaatagttgctgtggttttgtctccggttggccggtggccggtgctggctggtgcgttaatggcggctgaccgtgccgcgtcctccccttcccgtctttaaatcgcgcgggaagcttaccctgggccaacgacagcgcgggaaccgtcctccatccactccctgtgtctcatctcgtctccctcgatctcttctgatcaagctactgaaggcttcagagcccttgtgtggttgtcgccatctgttccattcttaggggcctatgttcttcttcttcttcttcttcttcttcccatccgtcttcgttgctcgctcttggcatatcgttggcaagagatagataatggcgccagaggagaagaagatcctggtggcgcggaagggccggctgcggcagcgctacgacggcgagtaccgcctggtggccggctgcgtgccgtaccgtcgcgtgggccccgccggcggccagcccgagctgctcatggtctccacgcccaacagggacgaccttgtcttccccaagggcgggtgggaggacgacgaggacgtgcacgaggcggcctgccgcgaggcgcttgaggaggctggggtcaagggcgccatcaacagaaccgcgctggggatgtgggtgttcaggagcaagagcagcccggtgagcggcgacagcccccggggcgcttgcaagggctacatcttcgcgctggaggtcaccgaggagctcgaccaatggccggagcaggacacccacggccggcaatgggtgtcgccggcggacgcgtaccgcctgtgccgatacgactggatgcgcgaggcgctatcggcgctgctggaccgcctggcggcggaggcgaagcccgccgccgcgccggagcgggaagaagagcacggcggcgtgttcaggatggtgaagacggccgccgccaccgctgaccaccgagcggtggcgctctgctagtgctagctgatctcagtcagatcctcaatgccatgtccaatagcagttagaaatcgtgtgatgaatctatcattcccgcgtgtttttgaggtcgttgtacccagtcagt

SEQ ID NO: 41641 - protein, 203 aa, Panicum virgatum
  misc_feature: Ceres CLONE 2008440
  misc_feature (24)..(164): Pfam Name: NUDIX Pfam Description: NUDIX domain
  misc_feature: SWISSPROT Homolog: EC 3.6.1.52 Diphosphoinositol-polyphosphate diphosphatase
MAPEEKKILVARKGRLRQRYDGEYRLVAGCVPYRRVGPAGGQPELLMVSTPNRDDLVFPKGGWEDDEDVHEAACREALEEAGVKGAINRTALGMWVFRSKSSPVSGDSPRGACKGYIFALEVTEELDQWPEQDTHGRQWVSPADAYRLCRYDWMREALSALLDRLAAEAKPAAAPEREEEHGGVFRMVKTAAATADHRAVALC

SEQ ID NO: 41642 - DNA, 709 bp, Panicum virgatum
  misc_feature: Ceres CLONE 2008450
  misc_feature: Encodes the peptide sequence at SEQ ID NO. 41643
gtacgtgcagcaatggagatggaggttccaccaccatggctgtcctccctcgcggtcctgctggccaccgccctcttcctcgcggccgtcctccgccggcgaggagcgcgcaacaagcactacaacctcccgccgggccctcggccgcggccggtgatcggcaacctgaacctgatcggcccgctgccgcaccgctccatccgcgagctctcggcgcggtacggcccgctcatgtcgctccgcttcggctccttccccgtcgtcgtcggctcgtccgtcgacgccgccgagttcttcctcaagacccacgacctggcgttcctcgaccggccccgcatggcgtgcggcaagcacaccgtctacaactactccggcatgctctggtcgcactacggtgcctactggcgccagctccgcaagctgtggttgacggagctcctcagcgcccggcagctccggaggacggagctcgtccgcgccgaggaggtgcgcgccatgctgcgcgacatccgcgccggcgccggcgcggcggtggcggtcaaggagcacctcctcatggcgacgctcaacgtcgtgtcgcgcatggtgctgggcaggaagtacgtcggcgagcagggcgccggcgcggcggcggcggtggcgacgccggaggagttccggtggatgatcgaggagatcttcttcctcaacggcgcgctccacatcgggg

SEQ ID NO: 41643 - protein, 232 aa, Panicum virgatum
  misc_feature: Ceres CLONE 2008450
  misc_feature: SWISSPROT Homolog: EC 1.14.13.21 Flavonoid 3'-monooxygenase
  misc_feature: Functional homolog of the protein sequence given in SEQ ID NO 50304
  misc_feature: Useful for making plants with altered carbohydrate content
MEMEVPPPWLSSLAVLLATALFLAAVLRRRGARNKHYNLPPGPRPRPVIGNLNLIGPLPHRSIRELSARYGPLMSLRFGSFPVVVGSSVDAAEFFLKTHDLAFLDRPRMACGKHTVYNYSGMLWSHYGAYWRQLRKLWLTELLSARQLRRTELVRAEEVRAMLRDIRAGAGAAVAVKEHLLMATLNVVSRMVLGRKYVGEQGAGAAAAVATPEEFRWMIEEIFFLNGALHIG

SEQ ID NO: 41644 - DNA, 731 bp, Panicum virgatum
  misc_feature: Ceres CLONE 2008462
  misc_feature: Encodes the peptide sequence at SEQ ID NO. 41645
gtatcggcatacgagggcaacagattccggtggtctgctccgactccgttcgcgaccgggacgcgatccccttcctctggccgccgctcgccgccgccgccgccgcgatgcctcggtattactgcgactactgcgacacctacctcacccatgactcgccatctgtccgtaagcaacacaatgctggatacaaacacaaggcgaatgttcgaacgtactatcagcaatttgaggagcagcaaactcaaagtttaattgatcaaagaatcaaggaacatctcggacaagctgctgcttttcaagtaggtgcccctttcaaccaacatctgctctcgttcccaggagccatggcccgcccccgccttccaattctaccaacccctggcatgcctcatggattccctcaagcacctggtgcaccattgatgccaggagtgaggcccccaattttaccagctcctggtgttccaggttatccgggtggcccaccaaccatgcagcaaccaggtgtcccaccaaccatgcagcaaccaggcgcccctcctggctccgtgccacaaccaggcgccccacctggttcggttccaatgcagatagctcctctcccaaggcctccaacactaccacctccaacatctggggtcccaggagcccccattcctaacagtgcagcacctccagccatgtaccaaacgaatccaccaccacctgcaggcccgacttctggtgct

SEQ ID NO: 41645 - protein, 207 aa, Panicum virgatum
  misc_feature: Ceres CLONE 2008462
  misc_feature (1)..(38): Pfam Name: zf-U1 Pfam Description: U1 zinc finger
MPRYYCDYCDTYLTHDSPSVRKQHNAGYKHKANVRTYYQQFEEQQTQSLIDQRIKEHLGQAAAFQVGAPFNQHLLSFPGAMARPRLPILPTPGMPHGFPQAPGAPLMPGVRPPILPAPGVPGYPGGPPTMQQPGVPPTMQQPGAPPGSVPQPGAPPGSVPMQIAPLPRPPTLPPPTSGVPGAPIPNSAAPPAMYQTNPPPPAGPTSG

SEQ ID NO: 41646 - DNA, 670 bp, Panicum virgatum
  misc_feature: Ceres CLONE 2008482
  misc_feature: Encodes the peptide sequence at SEQ ID NO. 41647
ggcgaagtggccgggcgcctagctttttttccctcgtgcaaagcttgcacttgcagagagagagagagagaaatccagagctaaaagcgctcctttaatttagctgggttctctcgctccctccctctcctagtagcctgctttctctctctaacccatcctcctctccaacacacaccaaaaccaacaaagcgggcgagtgatctgatcgggcagggcaagcggcaggaaataagtttcatcaaagttagctagctagaggcctccgatcatgggtgccatgatggcctccataaccagcgaggtcctcttcttcctccccttcatcctgctggccctcctcaccttctacaccgccaccgttgcccaatgccacggcgcccgccggtggcggcgcccgacaaagaagaagcggccgaacctgccgccgggcgcccctgggtggcccttggtcggcgagaccttcggctacctccgcccccacccggccacctccgtcggccgcttcatggagcagcacgtcgcacggtacgggaagatataccggtcgagcctgttcggggagcggacggtggtgtcggcggacgcggggctgaaccggtacatcctgcagaacgaggggcggctgttcgagtgcagctacccgcgcagcatcggcggcatcctgggc

SEQ ID NO: 41647 - protein, 132 aa, Panicum virgatum
  misc_feature: Ceres CLONE 2008482
  misc_feature: SWISSPROT Homolog: EC 1.14.13.77 Taxane 13-alpha-hydroxylase
MGAMMASITSEVLFFLPFILLALLTFYTATVAQCHGARRWRRPTKKKRPNLPPGAPGWPLVGETFGYLRPHPATSVGRFMEQHVARYGKIYRSSLFGERTVVSADAGLNRYILQNEGRLFECSYPRSIGGIL

SEQ ID NO: 41648 - DNA, 693 bp, Panicum virgatum
  misc_feature: Ceres CLONE 2008488
  misc_feature: Encodes the peptide sequence at SEQ ID NO. 41649
aaaacaccagtgttagctccgcaccacgcgcggagagggcagctgtggcggcggctgcgattaacgccagacagataggtggtagaggaagaaagggggagaggggaagggccagcgagagctagctgagaggcgaactgaaggagaggcgaactgaaggagagggcagccgcaagtactgtatagcttgtaggcaatgaggtcgagggcgccgtcgttgcggcggagcgtggttgccgcggccgcagtagcgctggcggcggcgtggtgcgcggcggcgcagctgagccagagctactacgcgtcgacgtgccccaacgtggacaccctggtccgcggcgccgtcacccagaagctgcaggagaccttcaacgccgcgccgggcacgctgcgcctcttcttccacgactgcttcgtcaggggctgcgacgcgtcggtgctgctgtcgggccccaacgacgagcacagcgcgggcgccgacacgacgctgtccccggacgcgctggacctcatcacccgcgccaaggccgccgtcgacgccgacccgcgctgcgccaacaaggtctcctgcgccgacatcctcgctctcgccgcccgcgacgtcgtctcgcagacgggcgggccgtactacccggtggagctgggccggctggacggcaaggtgggcacgcgcgccgtggtgaagcacagcct

SEQ ID NO: 41649 - protein, 165 aa, Panicum virgatum
  misc_feature: Ceres CLONE 2008488
  misc_feature (46)..(164): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51490
  misc_feature: Useful for making plants with altered carbohydrate content
  misc_feature: Functional homolog of the protein sequence given in SEQ ID NO 51637
  misc_feature: Useful for making plants with altered cell wall content and/or composition
MRSRAPSLRRSVVAAAAVALAAAWCAAAQLSQSYYASTCPNVDTLVRGAVTQKLQETFNAAPGTLRLFFHDCFVRGCDASVLLSGPNDEHSAGADTTLSPDALDLITRAKAAVDADPRCANKVSCADILALAARDVVSQTGGPYYPVELGRLDGKVGTRAVVKHS

SEQ ID NO: 41650 - DNA, 945 bp, Panicum virgatum
  misc_feature: Ceres CLONE 2008497
  misc_feature: Encodes the peptide sequence at SEQ ID NO. 41651
ggagctgacaactcacagaacttgcatcaccaatcgcacaacatactcttgactctaagtacagtccagtaccgttgtacggccaggacaggatattcctgtgaagaattcagttcactacaagaaagatgggcaagcaaaagattgtgctcaagttgcccctggatgacgagaggaagaagaggaaggccttcaaggcagccgttggcatgaatggtgtgacatccgccacgatggagggcgacaagatcatcgtggtcggcgacggcgtggacccgatcacgctgaccacgatgctccggcgcagcctcggctacgcggagctgctcagcgtcagctccggcgatgacaagaagaagggagacggatacggctacggcggcggcatgatgtacagtggcggcggtggcatgggctacggcggcggcttcggtggtggcaaggagggaaaggaaggaaaggagggcaaggagagcggcggcaagggcggcggcggcggtggctacggccagtaccaggcggtggcgccggtctcgtacccggcctaccagcagtacaacgcgatgccgtcctatcctgtctactcctaccctccttacccgcagcatgaacaggatcctggatgcagtataatgtaaatctaagagcgagcctcatgtgctttgtccaagttataatctggaaagttgaaggtggcaaaaacttggagaggaactcgttgccaagatgatgcatgaaggcttcaactgtgcaaggccggatgtgatgctagctgtgagcaacagagcatcatcagtgtgagtatgtacagggttggtcagcaaaagcaggtgggtgcagagttgagagtggtggtggagttcatggaagggaaggcagggctgttattacggaagcttagtgcatacaagatggtgatgattctagtgcaaactgcagtttctt

SEQ ID NO: 41651 - protein, 169 aa, Panicum virgatum
  misc_feature: Ceres CLONE 2008497
  misc_feature: Functional homolog of the protein sequence given in SEQ ID NO 50179
  misc_feature: Useful for making plants with modulated nitrogen use efficiency
  misc_feature: Useful for making plants with modulated phosphate use efficiency
MGKQKIVLKLPLDDERKKRKAFKAAVGMNGVTSATMEGDKIIVVGDGVDPITLTTMLRRSLGYAELLSVSSGDDKKKGDGYGYGGGMMYSGGGGMGYGGGFGGGKEGKEGKEGKESGGKGGGGGGYGQYQAVAPVSYPAYQQYNAMPSYPVYSYPPYPQHEQDPGCSIM

SEQ ID NO: 41652 - DNA, 725 bp, Panicum virgatum
  misc_feature: Ceres CLONE 2008514
  misc_feature: Encodes the peptide sequence at SEQ ID NO. 41653
agtcggacaaacccaccccgagcacgcgagccgccgccgccgccggcggctgcacaccagagcaaggcagcgcagataccttgctgccgatcctcctcgcctcctcctcacaattcgctgggttcaaagccgtatacggcgaggcttggctcctccggccgcggccccgtcctccgccgccatgctgtacatcgtgggcctcggcctcggcgacgagcgcgacatcacggtgcgggggctcgacgccgtgcgcggctgctccaaggtctacatggaggcctacacctccctcctctccctcggcctggaccccgccgcgctcgccaacctcgagaagctgtatgggaaggagatcacggtcgccgaccgggagatggtggaggagcgcgtcgatcaggtgctgctcgaggctgccgacacagacgtcgccttccttgtggtcggcgacccgttcggggcaactacacataccgatctggttgttcgcgccaagaaaatgggggtacaagtgaaggtgattcacaatgcatccgtcatgaatgcaattggagtttgtgggttgcaacttttccgctatggagagactatctcaataccattcttcacggaagaatggagaccagatagcttctacgagaagaattcaaataattccaggcttgggctgcacacgctttgtctatttgatatccgtgtaaaggaccaacatgggaattctttagccg

SEQ ID NO: 41653 - protein, 181 aa, Panicum virgatum
  misc_feature: Ceres CLONE 2008514
  misc_feature (1)..(181): Pfam Name: TP_methylase Pfam Description: Tetrapyrrole (Corrin/Porphyrin) Methylases
  misc_feature: SWISSPROT Homolog: EC 2.1.1.98 Diphthine synthase
MLYIVGLGLGDERDITVRGLDAVRGCSKVYMEAYTSLLSLGLDPAALANLEKLYGKEITVADREMVEERVDQVLLEAADTDVAFLVVGDPFGATTHTDLVVRAKKMGVQVKVIHNASVMNAIGVCGLQLFRYGETISIPFFTEEWRPDSFYEKNSNNSRLGLHTLCLFDIRVKDQHGNSLA

SEQ ID NO: 41654 - DNA, 740 bp, Panicum virgatum
  misc_feature: Ceres CLONE 2008539
  misc_feature: Encodes the peptide sequence at SEQ ID NO. 41655
ggttccacatctccagaaatgatccgcagccgcccaatgcgagcccgacaagtgtcgccatcctagccagccctaactatttggctttggcgtccgaaaatcctgtagcacattggcacgtccgtacgaggactaggccgggggatggagcaggagctgaggaccgccggcggcagcggcggcggcctcagggcgcacagctccgtgtgcttctccggcgcgctcatcgacggcccgcgcatccagcaactgctcctccactgcgccgccgcgctggagtccaacgacgtcacgctggcgcagcaggccatgtgggtgctcaacaacatcgcgtcgtcccagggcgaccccaaccagcgcctcacgtcgtggctgctccgcgcgctggtcgcgcgagcgtgccgcctgtgcggcccggccggggctgcccaggcggcgcccgcgccgccggagcgggccatgtcggtgacggagctcgccgagtacgtcgacctcacgccgtggcaccggttcggcttcacggcctccaacggcgccatcctccgtgccgtggcaggcagcgccgccgtgcacgtcgtcgacctcggcgtcacgcgctgcatgcagtggccgacgctcatcgacatgctgtccaagcggcccgggggcccgccggcgctccgcatcaccgtgccgtccgcccgggccgccgtgccgcctctgctcggcgtggcggacgaggagctcggcgtccggctggg

SEQ ID NO: 41655 - protein, 198 aa, Panicum virgatum
  misc_feature: Ceres CLONE 2008539
  misc_feature (6)..(198): Pfam Name: GRAS Pfam Description: GRAS family transcription factor
  misc_feature: The sequence is a functional homolog of SEQ ID NO 70 in the 10/666,642 US patent application
  misc_feature: The sequence is a functional homolog of SEQ ID NO 502 in the 10/666,642 US patent application
MEQELRTAGGSGGGLRAHSSVCFSGALIDGPRIQQLLLHCAAALESNDVTLAQQAMWVLNNIASSQGDPNQRLTSWLLRALVARACRLCGPAGAAQAAPAPPERAMSVTELAEYVDLTPWHRFGFTASNGAILRAVAGSAAVHVVDLGVTRCMQWPTLIDMLSKRPGGPPALRITVPSARAAVPPLLGVADEELGVRL

SEQ ID NO: 41656 - DNA, 1683 bp, Panicum virgatum
  misc_feature: Ceres CLONE 2008548
  misc_feature: Encodes the peptide sequence at SEQ ID NO. 41657
agcgactagtagtagtggtaggacagctcgctgctcctcctccaccgcgcctactgagggcggggaagggcgatgggccgcgccttcctccaccgcgcgctggtcctctcgtcgctgctcctcctcgcctccggcgagatcttcttcgaggagcgattcgatgatgggtgggagcaccgttgggtgaaatctgattggaaaaggagccaaggacaagctggaacattccggcacacagcgggaacctattctggagatcctgaggataaaggtatacaaacaactggggatgccaaacattttgctatatcggcaaaattctcagaatttagtaacaagaaccgaacattagtggtccagtactcgctaaaaatcgagcaggatattgaatgtggcggtgcttacatcaaactcatgtctggccatgtcaaccagaagaaatttggtggcgacacaccttacagcttcatgtttgggcctgatatatgtggggatcagaaaaagaagctccatctcatactttcgtaccaggggcaaaactaccctatcaagaaagatttaaaatgtgaaacagacaagttgacacatttttacacatttgttctcagacctgatgccacttatagcatccttattgataaccgggagagagaatttgggagcatgtacactgactgggatatccttcctcctcgtaggatcaaagatgttaatgcaaaaaagccaaaagattgggatgacagggagtatattgaagatcctgatcaagttaagccagagggatatgactcaattcctaaagagatacctgatccaaaggacaaaaagcctgagtcatgggatgacgacgacgacggtatatggaagcctagaatgataccgaatccagaatacaagggaccatggaagcggaagaaaattaagaatcctaactacaaaggaaagtggaagaccccatggattgacaatccagagtttgaggatgacccggacctatacgttttgaaacctttgcagtatgtggggattgaagtctggcaggtcaaagccggttctgtttttgacaacattttgatttgtgatgatccggactatgcaagacatgttgtagacgaaacttttgctgcaaataaggaggctgaaaaggaggccttcgaaggagctgaaaagaagaggaaggctagagaagaagaggaagcacggcgggcgcaggaggaaggggagagacgaaggcgagagagggatagggaccgtggcagggatcgttacagggatagatataagcgtcataggcactacgactaccatgacgagctatagatcttgcaccttcgaaatctgctgggcatcagttgttcgtctatggaaaggggccttcatgattgtgttaataagatgtgccactttgtggcaaagatatttgaagtccttggccgtactgttacagtcatggagacggagagcacacgctgaatttgtatgttgcacaacctgaatcagactgaaactgtgattccgtacagattcaacccgccccaccgcggctgtaactaaatttccacgttggccatgaaatgtgagctgtagcctgtatgttcttgtactcttatgtttaccacgtcgtgttacattcacgctgcagatgttgagaaacctttcatttttaatttcatttttgtcgtt

SEQ ID NO: 41657 - protein, 415 aa, Panicum virgatum
  misc_feature: Ceres CLONE 2008548
  misc_feature (23)..(335): Pfam Name: Calreticulin Pfam Description: Calreticulin family
MGRAFLHRALVLSSLLLLASGEIFFEERFDDGWEHRWVKSDWKRSQGQAGTFRHTAGTYSGDPEDKGIQTTGDAKHFAISAKFSEFSNKNRTLVVQYSLKIEQDIECGGAYIKLMSGHVNQKKFGGDTPYSFMFGPDICGDQKKKLHLILSYQGQNYPIKKDLKCETDKLTHFYTFVLRPDATYSILIDNREREFGSMYTDWDILPPRRIKDVNAKKPKDWDDREYIEDPDQVKPEGYDSIPKEIPDPKDKKPESWDDDDDGIWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAEKKRKAREEEEARRAQEEGERRRRERDRDRGRDRYRDRYKRHRHYDYHDEL

SEQ ID NO: 41658 - DNA, 725 bp, Panicum virgatum
  misc_feature: Ceres CLONE 2008549
  misc_feature: Encodes the peptide sequence at SEQ ID NO. 41659
aatcttccccgtcgtccggccgtctccctccgcaccacacggaccgcgccccggggcgtccgcggcggactcgatcgggcacctgcgccgtcatgggctgcgcgacgtcgagccagttcggggcggcgcgcgtgatggagccccaagtgctcgcgtccgagacctcattcacggtggacgaggtggaggcgctgtacgagctgtacaagaggatgagcttctccatcatcaaggacggcctcatccacaaggaggagttccagctcgccttgttcaggaacagcgagaaagccaacctcttcgccgacagggtcttcgacttgttcgatctcaagcggactggggtgatcgatttcgaggaattcgtgcggtcgctcagcgtattccaccctaaagcgcccacgtcggaaaagacatcgttcgcgttcaagctgtatgatctaagggggacaggttatatcgagaaagaagagctcagggagttggtcttggcgcttctagatgagtctgatctctgcctttcagatagcaccgtcgaggcgattgtcgataatacattcagtcaagctgactcgaatggagatggcaagatagatcctgaggagtggaaggaatttgtgaagaagaacccggcagcattgagaaacatgtcgctcccctatttgcaggacatcaccatggcatttcccagcttcataacgcgatcgggaagccaaagactgaca

SEQ ID NO: 41659 - protein, 210 aa, Panicum virgatum
  misc_feature: Ceres CLONE 2008549
  misc_feature (151)..(179): Pfam Name: efhand Pfam Description: EF hand
  misc_feature (70)..(98): Pfam Name: efhand Pfam Description: EF hand
  misc_feature: SWISSPROT Homolog: EC 2.7.11.17 Calcium/calmodulin-dependent protein kinase
  misc_feature: Functional homolog of the protein sequence given in SEQ ID NO 50528
  misc_feature: Useful for making plants with modulated salt sensitivity
  misc_feature: Functional homolog of the protein sequence given in SEQ ID NO 51003
  misc_feature: Useful for making plants with modulated drought sensitivity
  misc_feature: Functional homolog of the protein sequence given in SEQ ID NO 51004
  misc_feature: Useful for making plants with modulated water use efficiency
  misc_feature: The sequence is a functional homolog of SEQ ID NO 2 in US patent 7250555
MGCATSSQFGAARVMEPQVLASETSFTVDEVEALYELYKRMSFSIIKDGLIHKEEFQLALFRNSEKANLFADRVFDLFDLKRTGVIDFEEFVRSLSVFHPKAPTSEKTSFAFKLYDLRGTGYIEKEELRELVLALLDESDLCLSDSTVEAIVDNTFSQADSNGDGKIDPEEWKEFVKKNPAALRNMSLPYLQDITMAFPSFITRSGSQRL

SEQ ID NO: 41660 - DNA, 1329 bp, Panicum virgatum
  misc_feature: Ceres CLONE 2008557
  misc_feature: Encodes the peptide sequence at SEQ ID NO. 41661
gaactaacgctaaaaaagtaacagtttctgtactttattgctctttgtgttgtaacgatgccgaagcctgtgacgacgaagagaaaaggagcagcgacgtcgaaacggagcagcgatgcatcggacgcgcccgcaccaccctcgtgctaccgcgaggaggaccgcacgatggtggtccacggggatgtacgccgcgtgccctacttttggctgcggaagaaacgcaacccgcgggtccgcgagttcgtcgccgcggagagcaagtacgcgaacgcgatgatccccagcagcgcggtggatgcgctttacaaggagcaccggcgccgcatcaaggagacagacgcgtcgctgccgttcctgtacaagggctacttccactacgtgcgcgatcgcgaaggcctcgaccacgagatccactgccgcaaactcgcggcgagcgaccccacattcgacgagcgctgcgcggcgctgctgcaggaagatcccgacgcggacattccggcggacgacgcggaggaggtcgtgctggacctgaacgtggagcggagccaacgaggctcgagttcgatcgagcttggggacatggatccatcgccatcgcagacgctgctggcgtactcgctgaatctcagtgacggcaaagaagagtacacgctgtacgtgaaggacatgactacgaacctcgtccttcgcaagatcacgcgcgtggacaagctcggcaagcccggtccccacgtcgcgtgggcaagcgatactgtgttttactttaccgtgctgaacgctcgcgaccggtgctttgcggtggtgcgatgcgacttgagcgccgtgtacaagccgccacagtcacccgcaacgccgaaccttgctgacgctgcgtggcgcgatgaggccacgtacaccgatggacagacagggctaaccgtcgtgtaccgcgagcgtgacgagaccttctcggttgaggtgttgtgtcggagtcacgatgagacgcacatggtgttcagcgtcgcgtcaccgaacacgaacgagtggcatttcgccgccgccgagaatgacttggagtggtcgccgttctggcgccgcgagcgcggtgtgcagtactacgtgtttccgcacccgcacggttggatcgtgacccacgaccgcggcgaaagcaagaacaggcaaatcgacgtgtgcacctcgctcgaacactggccgatcccgcacgacgcggtgcggcccctggtgccgtacgatgcgcgcgtcgtcgtcgaagacgtcgactgctaccagcagttcatcctggccaccgtcctgctcaatgcacttcccccgcgtgctcgtcatcac

SEQ ID NO: 41661 - protein, 423 aa, Panicum virgatum
  misc_feature: Ceres CLONE 2008557
  misc_feature (27)..(423): Pfam Name: Peptidase_S9_N Pfam Description: Prolyl oligopeptidase, N-terminal beta-propeller domain
  misc_feature: SWISSPROT Homolog: EC 3.4.21.83 Oligopeptidase B
MPKPVTTKRKGAATSKRSSDASDAPAPPSCYREEDRTMVVHGDVRRVPYFWLRKKRNPRVREFVAAESKYANAMIPSSAVDALYKEHRRRIKETDASLPFLYKGYFHYVRDREGLDHEIHCRKLAASDPTFDERCAALLQEDPDADIPADDAEEVVLDLNVERSQRGSSSIELGDMDPSPSQTLLAYSLNLSDGKEEYTLYVKDMTTNLVLRKITRVDKLGKPGPHVAWASDTVFYFTVLNARDRCFAVVRCDLSAVYKPPQSPATPNLADAAWRDEATYTDGQTGLTVVYRERDETFSVEVLCRSHDETHMVFSVASPNTNEWHFAAAENDLEWSPFWRRERGVQYYVFPHPHGWIVTHDRGESKNRQIDVCTSLEHWPIPHDAVRPLVPYDARVVVEDVDCYQQFILATVLLNALPPRARH

SEQ ID NO: 41662 - DNA, 661 bp, Panicum virgatum
  misc_feature: Ceres CLONE 2008557-R
  misc_feature: Encodes the peptide sequence at SEQ ID NO. 41663
ttgcgatggtccggggcggcggccagctcggaccggcgtggcacgacgcagggcgcttggccaagcgcgtcaacgccattaacgatttcatcgcgtgttgcgaattcttgatccgcgaacgctggtgcgacgcggaacggcttggggctatcggcgggtctgccggtgggacgatcgtcgccgcggccatgctccgccgcccggagctgttccgctccgttgtgctggcagtgccgttcgtggactgcctctcgacgatgctcgataaatcgctcccgttaacgaccgaagagtacgatgagtggggtaacccctcggcatcggcgacggactacaggatcatcaaggcgtacagcccgctggacaacgtgccgagcgcggaggcggtggaggaagcaggaacgatcttccctcacacactcatcgacagttcgtggaacgacacgcgcgtcggcgtgcacgaaccggccgcgttcggtgccgcgctgagggcttcttggggcccgtccgaggcggctgggcgcgtgctgctgcaccactgcaacttcaaggccggccacacgggcgagacctcgcgctatgacgaggcccgcaacgcggcgcgcatcgacgttttcgtgatgggcagcctgggcgtatcgatgaacttggcgcgagattg

SEQ ID NO: 41663 - protein, 219 aa, Panicum virgatum
  misc_feature: Ceres CLONE 2008557-R
  misc_feature (1)..(213): Pfam Name: Peptidase_S9 Pfam Description: Prolyl oligopeptidase family
  misc_feature: SWISSPROT Homolog: EC 3.4.21.83 Oligopeptidase B
AMVRGGGQLGPAWHDAGRLAKRVNAINDFIACCEFLIRERWCDAERLGAIGGSAGGTIVAAAMLRRPELFRSVVLAVPFVDCLSTMLDKSLPLTTEEYDEWGNPSASATDYRIIKAYSPLDNVPSAEAVEEAGTIFPHTLIDSSWNDTRVGVHEPAAFGAALRASWGPSEAAGRVLLHHCNFKAGHTGETSRYDEARNAARIDVFVMGSLGVSMNLARD

SEQ ID NO: 41664 - DNA, 714 bp, Panicum virgatum
  misc_feature: Ceres CLONE 2008565
  misc_feature: Encodes the peptide sequence at SEQ ID NO. 41665
caagcccacaagccgccgcgggtgggtaatataccatggccactacccacgccctcgccgccgccatctccgcttgcgctccccagcagtctctctcgtccccgctctcgcgccatggcggcgcggctcccccgcttcgccgcggccctggcggcggtcgcggtgctggctgctgctgcgggtcgggccgcggcaggggacccgccgctctcgcccaaggggctcaactacgaagtggcggcgctggtggcggtgaagagccggctgcgggacgagaagggggtcatggcgctgtgggacatcaactccgtcgacccctgcacctggtccatggtcgcctgctcccccgacaagttcatcgtctcgctccagatggcaaacaacggcttgtcctggacgctgtcgccgagcatcgggaacctcagccacctgcagacaatgtcactacaaaataacaaaatatcaggtgatattcctccagaaatagggaagctgaccaatctgaacgctcttgacctttctagcaatgggtttgttggtgatatcccgagttcattggggcagttgactcgactaaattatctgcgccttgataggaataacttgtctgggcagatccctgtagatgttgctaagcttccaggtctcacattccttgacttatcattcaacaatttgagtggcccagttccaaaaatctatgcacacgactac

SEQ ID NO: 41665 - protein, 199 aa, Panicum virgatum
  misc_feature: Ceres CLONE 2008565
  misc_feature (37)..(77): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Functional homolog of the protein sequence given in SEQ ID NO 50524
  misc_feature: Useful for making plants with modulated nitrogen use efficiency
MAARLPRFAAALAAVAVLAAAAGRAAAGDPPLSPKGLNYEVAALVAVKSRLRDEKGVMALWDINSVDPCTWSMVACSPDKFIVSLQMANNGLSWTLSPSIGNLSHLQTMSLQNNKISGDIPPEIGKLTNLNALDLSSNGFVGDIPSSLGQLTRLNYLRLDRNNLSGQIPVDVAKLPGLTFLDLSFNNLSGPVPKIYAHD

SEQ ID NO: 41666 - DNA, 1973 bp, Panicum virgatum
  misc_feature: Ceres CLONE 2008591
  misc_feature: Encodes the peptide sequence at SEQ ID NO. 41667
tcctctccctcctcctcaatcattgcccagagagagaacacggaagcggagggagctcttcttccacctctaccaccaccagccagccagccagtcccgccacagtacaccactggcacccaccccccacccagcaccaaattaggggccggatgaccaccaggcctgcagacgggggcgccgccgccgccgctgccgacaagcagctcgtccccgcctccaacggcaacgctctcgccgtccgcaaggccccctccaaggaccgccacagcaaggttgacggccggggccgccgcatccgcatgcccatcatctgcgccgcccgcgtcttccagctcacccgcgagctcggccacaagtccgacggccagaccatcgagtggctgctccgccaggccgagccctccatcatcgccgccaccggcaccggcaccaccccggcctccttctccacctcctcgccatcctccctccgctccacctcctcgcagaccacgcccttcgtcctcggcaagcgcgtccgcaacgacgccgacgccgagcccacagtcgccgcccccgcccctggattctgggcgctgccggcgcgggcagacttcggccagctctggagcttcgcggcagcgccggagatgatggcaggggaggcgtccgcagcccgggtcggaaactacctgcccatggcgcagggcaacctcaacctgctcgcctccttctccggcgggccagctccaacggccacagccggacggcccgaggaggagagcgcacgctgaacattcatacccccatcggcgttttatgcatctccacatctagggttttatttatttattactctaggttttcttccttgaatccttagcttgagacttgttgctcggtttgctttccttgctgctcaactctgcctgcgtgtctctactctctactctctactcagctcagctcgcttctggtttccttcctctctagtctctactagacctgggcaaacgtcgcgtcgggtcaaggtcgggtcacgggtcacataggacgacccgcgcccgacccgtacctatcaccgggtcgggtcgggttggcccgtgcaccctgcgcgggcgtgtcgggtcgggttttttcgggttgagtcgggttttttggcgtttgggtcggattttgggtcaaaaatcacggcccgtgcccagcccggtgattgttgcgggtcaaaaaatacggcccgcgtccacccaccacgtagctcgggtcgggtcgggtcgggtttttttcgggcgggttgggtcgggttgttcgggtcgggtgacccatgcccaggtagtctctaccaggctagcttggttgccgatcgaattgggtaaaaaattgctcgcacctgcaaaattgctccactcactcgtgtccactgctcagctcacccgccccatgagtgaccccattcctcgtcagtagtagtagatctcttgtttgttttgtgtcactacacccctggttgcttagcaaggagcaaatgttgtcctggtagtcatagagattgggaggtgtgcgcgtgtgtgctgttgctgtcaaaactcaaatgtactactaatctcctcctttccggggtgggctgttccaagaagaagagaagaaaacttcctctttgttggacaagcaagggaaatggcgtcaaattgtcgtccatctctgcagcaggcagctggtgcatcagttcagctcagctccctccctcccaagcagagagggggaagaagaggaaggaaggaaaaagaccttttcttaccacaaacaaacaaacaaacaaaggatgctgggcctggctgtaagttgtccacttggtctgctcatccgctctgtctgcttgctgtcattttgattgttgccttttgtgctcttatcttgattccattagtcatactgcttctgcacctgaatgttgagggagattgagagcaataactagtgtgctagtcctc

SEQ ID NO: 41667 - protein, 207 aa, Panicum virgatum
  misc_feature: Ceres CLONE 2008591
  misc_feature (19)..(191): Pfam Name: TCP Pfam Description: TCP family transcription factor
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
  misc_feature: The sequence is a functional homolog of SEQ ID NO 316 in the 10/666,642 US patent application
MTTRPADGGAAAAAADKQLVPASNGNALAVRKAPSKDRHSKVDGRGRRIRMPIICAARVFQLTRELGHKSDGQTIEWLLRQAEPSIIAATGTGTTPASFSTSSPSSLRSTSSQTTPFVLGKRVRNDADAEPTVAAPAPGFWALPARADFGQLWSFAAAPEMMAGEASAARVGNYLPMAQGNLNLLASFSGGPAPTATAGRPEEESAR

SEQ ID NO: 41668 - DNA, 695 bp, Panicum virgatum
  misc_feature: Ceres CLONE 2008604
  misc_feature: Encodes the peptide sequence at SEQ ID NO. 41669
atcatcgatgaacacaaccctgagccctagcaaggctagaacactacagtaaacaggccgcagaggcagctgctagctgcagggagcacagaacacacagaagcaaagcacacacgccaagaaaccaaagcgaggaaattaaagcacacaaagacaccggccaggggagcaccgaattggagctgtagctcatcatggggatggtggtggagagcatcagccccacggcggcggaggcctcctccgcctcctcgcgctcaaccggcgcgtccacggccaccaccgagtccggcgccgcccagcagccgccgcttgccgcggcgccggccagcggggaggtctcgccctcgccggcggacgagcaggccgtcacgtcgcagccgtcggcggcggcggcggtgccgcaggggtcctcgcggtacaagggcgtcgtgccgcagcccaacgggcgctggggcgcgcagatctacgagcgccacgcgcgggtgtggctcggcaccttccccgacgaggaggccgccgcgcgcgcctacgacgtcgccgcgctccgctaccgcggccgcgaggccgccaccaacttcccgggggccggggcgtcggcgcccgagctcgccttcctgctcgcgcactccaaggcggagatcgtcgacatgctccggaagcacacctaccccgacgagctccgccagggcctg

SEQ ID NO: 41669 - protein, 166 aa, Panicum virgatum
  misc_feature: Ceres CLONE 2008604
  misc_feature (74)..(123): Pfam Name: AP2 Pfam Description: AP2 domain
  misc_feature: The sequence is a functional homolog of SEQ ID NO 20 in the 10/838,616 US patent application
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
  misc_feature: The sequence is a functional homolog of SEQ ID NO 1177 in the 10/374,780 US patent application
  misc_feature: The sequence is a functional homolog of SEQ ID NO 1373 in the 10/412,699 US patent application
  misc_feature: The sequence is a functional homolog of SEQ ID NO 32 in the 10/838,616 US patent application
  misc_feature: The sequence is a functional homolog of SEQ ID NO 734 in the 11/435,388 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 48 in the 10/838,616 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 1186 in the 10/374,780 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: Functional homolog of the protein sequence given in SEQ ID NO 50661
  misc_feature: Useful for making plants with altered lignin content
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: The sequence is a functional homolog of SEQ ID NO 50 in the 10/838,616 US patent application
  misc_feature: Functional homolog of the protein sequence given in SEQ ID NO 50664
  misc_feature: Useful for making plants with altered protein content
  misc_feature: Useful for making plants with altered terpenoid content
  misc_feature: Functional homolog of the protein sequence given in SEQ ID NO 50663
  misc_feature: Useful for making plants with modulated water use efficiency
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
MGMVVESISPTAAEASSASSRSTGASTATTESGAAQQPPLAAAPASGEVSPSPADEQAVTSQPSAAAAVPQGSSRYKGVVPQPNGRWGAQIYERHARVWLGTFPDEEAAARAYDVAALRYRGREAATNFPGAGASAPELAFLLAHSKAEIVDMLRKHTYPDELRQG

SEQ ID NO: 41670 - DNA, 661 bp, Panicum virgatum
  misc_feature: Ceres CLONE 2008610
  misc_feature: Encodes the peptide sequence at SEQ ID NO. 41671
tgagagcaacctgaagcgcggccatggcggggcgtcagctgaacgtgctgtccacgctggaccaggcgaggacgcagtggtaccacttcatggcgatcgtgatcgccggcatgggcttcttcaccgacgcctacgacctcttctgcatctccctcgtcaccaagctgctgggccgcatctactacaccgacacctccaggccggacccgggcacgctgccgcccaacgtgtcggccgccgtcaccggggtcgcgctctgcggcacgctcgcggggcagctcttcttcggatggctcggcgacaagctcggccgcaagagcgtctacggcttcacgctcatcctcatggtcgtctgctccgtcgcgtcggggctctccttcgggggcacgcccaggggcgtcatcgccacgctctgcttcttccgcttctggctcggcttcggcatcggcggcgactacccgctcagcgccaccatcatgtccgagtacgccaacaagaggacccgcggcgccttcatcgccgccgtcttcgccatgcagggcttcggcatcctcttcggcgccatcgtcgcgctcgtcgtctccgccggcttccgccgcgcgtacccggcgccgccgtactcccaggaccgcgccgcctcactcatgccgcaggccgacta

SEQ ID NO: 41671 - protein, 212 aa, Panicum virgatum
  misc_feature: Ceres CLONE 2008610
  misc_feature: Functional homolog of the protein sequence given in SEQ ID NO 51638
  misc_feature: Useful for making plants with modulated phosphate use efficiency
  misc_feature: Functional homolog of the protein sequence given in SEQ ID NO 51527
  misc_feature: Useful for making plants with modulated carbohydrate content
MAGRQLNVLSTLDQARTQWYHFMAIVIAGMGFFTDAYDLFCISLVTKLLGRIYYTDTSRPDPGTLPPNVSAAVTGVALCGTLAGQLFFGWLGDKLGRKSVYGFTLILMVVCSVASGLSFGGTPRGVIATLCFFRFWLGFGIGGDYPLSATIMSEYANKRTRGAFIAAVFAMQGFGILFGAIVALVVSAGFRRAYPAPPYSQDRAASLMPQAD

SEQ ID NO: 41672 - DNA, 1766 bp, Panicum virgatum
  misc_feature: Ceres CLONE 2008642
  misc_feature: Encodes the peptide sequence at SEQ ID NO. 41673
ataaaagatacagtttctgtactttattgatcgagcaaaatggggtttgttgaccgcggaggtggtcgtgaagccaagggtgcatcccttcgcaagtcgaagaagaacccaggcgccgctgcagcacgcatcaaaactgaagccaaggcggcgcaaccaacgttcaagacgtatgcccctcccgtggtctggagtggcccaagtgccgtgttggattgctccgtagcaattttgtcaaggaagtttgatacggatcgtgatcgcattgtgggtcgcgctcatgacgaagcaaagtgcattggattgttgacttggtgcggggagtttgaacgtcaggagcaactttcgcagttttgccttgactaccctaccaaagccttctgcgcgattggtgttcatcccgacaacgtggaccgcacaaataagaaagcgcatcagggttggattgagaccacagagggacttgctcgcaacactcactgtgttgcaattcttaccggattggatctcactcgtgagcaagccacccatttttcccaagaagcgctgctgcaggacctgtttctgtgcgcaaagcgcttaaaactcccagtgttacttcatttgcaccccgatagcacaacagtggaacgatttatggagtggtatgctgctacgggagatattcaggatgtaccactgttgattcatgaggcgcatgtgttggggagcatttgtacaagtctgctggggttcatcgccgacacagcgagcgccttccccattgtgtcggcatcgggactgttcgatgaccgacgcgggggaatcgttgcatctctccggaagcttccaacggaacgtgtactgatctcaaccaatgcgccgtggagtacaccgcagaacattcaagacgaacatctgcgcgatctacctaacgagccggcaaatatttcatttgtcactgaggcattggctgaagccatggacatcaacagagatcagctgatacttgcagcgcaggccgctgttatcaatgtactgttcctaacgcgtgaatcgagtgatgttccaacgtcgacgatggatgaacaaggtgacgaggctcaagatgaagaatctgagtccgatgcagatgagactgacgatgcacagaatcaggaagaagcaccgagcgacaatgtcgaatttcttattcctttgccaaacgccaaaccctcggttgtatattcttgcgtgaaatgtcgtgcgcacctgtttcctcagagcgcacttgtcacacacccgttggatgcacccagggtcacgttcaaatccagtaagctttctcaaagggtgaggcatgtgatgcgactctcttcttagtcgttcgtggcggctcaatcggcgggggtaaagctgttgttgttggcgaagcagacgtggctgcttgtgtgtcatgtcaatcaaagctaggatcggttgcaacagatgctgcttgtccgtgtggagctcaaatgattggttgcactgcacgaatcattgcaagccgtgttgaggtggtacatgatggcgttggcgatgaagcacttctcgcacttgcacaagaagagcgcgaggctccagttgtagaaccttcatcgtcgtctgaagacgaaaattcgaagaggaaacctaaactaaatgtcaaggcaaacaatcgttccaacatgtcgcactaccgcaacaagaattgggcccctgggttgctggctgcctcggatggcctgaaggcccaggccaacgccacccttgaagatggagagaagcgg

SEQ ID NO: 41673 - protein, 433 aa, Panicum virgatum
  misc_feature: Ceres CLONE 2008642
  misc_feature (58)..(328): Pfam Name: TatD_DNase Pfam Description: TatD related DNase
MGFVDRGGGREAKGASLRKSKKNPGAAAARIKTEAKAAQPTFKTYAPPVVWSGPSAVLDCSVAILSRKFDTDRDRIVGRAHDEAKCIGLLTWCGEFERQEQLSQFCLDYPTKAFCAIGVHPDNVDRTNKKAHQGWIETTEGLARNTHCVAILTGLDLTREQATHFSQEALLQDLFLCAKRLKLPVLLHLHPDSTTVERFMEWYAATGDIQDVPLLIHEAHVLGSICTSLLGFIADTASAFPIVSASGLFDDRRGGIVASLRKLPTERVLISTNAPWSTPQNIQDEHLRDLPNEPANISFVTEALAEAMDINRDQLILAAQAAVINVLFLTRESSDVPTSTMDEQGDEAQDEESESDADETDDAQNQEEAPSDNVEFLIPLPNAKPSVVYSCVKCRAHLFPQSALVTHPLDAPRVTFKSSKLSQRVRHVMRLSS

SEQ ID NO: 41674 - DNA, 683 bp, Panicum virgatum
  misc_feature: Ceres CLONE 2008648
  misc_feature: Encodes the peptide sequence at SEQ ID NO. 41675
aggccctcgccttgcagcgtaacaagtgtccttcctccgtcttcctcctctcgctctcatccactctcctcccccctcgccagtcgccactgcggtgcggagcttcggcggctcggctcgagcagaagaaaatgcaacgggcagtgcaagccatcaggtcgcatggcagtgtgcttaaatatgctgttcaacaacacatcagcgctcccaaaccagcaatgcttcctgctgccttttctcgcttcatgtcagcttcatctgctcgcctagaggacagtggatttgaaactgccactgtagctgatatcttgaagtctaaagggaagagtgctgatggatcttggctctggtgcaccacagaggacagtgtctatgatgctgtcaaatcgatgacgcaacacaatgtgggggctttggtggtggtcaaaccgggacaggaaaaagcaattgctggcattgtcacggagagagattatctccggaaaatcatagtgcaaggacgatcttccaagtcaactaaggttggagacatcatgactgaagagaacaaactgatcaccgtgaagcctggcaccaaggtcctgcaagcaatgcagctgatgacagagaaccgcatcagacacatcccggtggtcgaaggcacggggatgctggggaatggtctccatcggcgacgtcgtccg

SEQ ID NO: 41675 - protein, 183 aa, Panicum virgatum
  misc_feature: Ceres CLONE 2008648
  misc_feature (65)..(183): Pfam Name: CBS Pfam Description: CBS domain pair
  misc_feature: SWISSPROT Homolog: EC 1.1.1.205 IMP dehydrogenase
MQRAVQAIRSHGSVLKYAVQQHISAPKPAMLPAAFSRFMSASSARLEDSGFETATVADILKSKGKSADGSWLWCTTEDSVYDAVKSMTQHNVGALVVVKPGQEKAIAGIVTERDYLRKIIVQGRSSKSTKVGDIMTEENKLITVKPGTKVLQAMQLMTENRIRHIPVVEGTGMLGNGLHRRRR

SEQ ID NO: 41676 - DNA, 683 bp, Panicum virgatum
  misc_feature: Ceres CLONE 2008654
  misc_feature: Encodes the peptide sequence at SEQ ID NO. 41677
atggccgggagctgcgcaggctattaggctatcaaagggagagcaagcggtggccatggccgggagcagcgtgtccagcggccggccgccgctgttcgcgtcggagaaaccagcgcgggtggcggcgtacgcgtaccggctgttcgcgagcacgctcctcgcggggcttcttctgatatggctgtacagggccacgcacctgccgccgaggagcagcagcgcgcggtggtgggcgtggctggggctctccgccgccgagctctggttcggcttctactgggtgctgacgctgtccgtgcggtggagccccgtctaccgccgcaccttccccgaccggctcgcccgaaggtataatgaggaggagcttcctggggtggacatatttgtgtgcacagcagacccaactcttgagccaccaatgcttgtcatctccactgtcctatctgttatggcttatgactacccgccagagaagctgaacatctatttgtctgatgatgccggttccgctataacattatatgctctgtacgaagcatctgagtttgcaaagcactgggttccattttgcaagaagtacatggttgagcccaggtctccagctgcctactttgccaaagcagatggacctcctgatgcatgcaacccctaagagtggttcgcattgaaggtaggagtgaaaa

SEQ ID NO: 41677 - protein, 198 aa, Panicum virgatum
  misc_feature: Ceres CLONE 2008654
  misc_feature: SWISSPROT Homolog: EC 2.4.1.12 Cellulose synthase (UDP-forming)
  misc_feature: Functional homolog of the protein sequence given in SEQ ID NO 51639
  misc_feature: Useful for making plants with altered cell wall content and/or composition
MAGSSVSSGRPPLFASEKPARVAAYAYRLFASTLLAGLLLIWLYRATHLPPRSSSARWWAWLGLSAAELWFGFYWVLTLSVRWSPVYRRTFPDRLARRYNEEELPGVDIFVCTADPTLEPPMLVISTVLSVMAYDYPPEKLNIYLSDDAGSAITLYALYEASEFAKHWVPFCKKYMVEPRSPAAYFAKADGPPDACNP

SEQ ID NO: 41678 - DNA, 432 bp, Panicum virgatum
  misc_feature: Ceres CLONE 2008654-R
ttttgttacatgaaggcgcaacaggcttgggggctttgttcctgcaggctgttctttgtgtgctaatagtggcaatcaatttcccggtctatgaagcgctcttcgtccgcaaggacagtggcagattgccatcttctgtcagtctagtttcattctgcattgtattaccactctgtatactgccaaccaatatgcagatgtgaagttggtgaaatgtaacaaatatatatatgatgttattcccaagggaagaattgataaaggcagctcggtggagcgcctgccacccgctttgagcgctgctcgacgcagggtaccctccattttttttccttgaaaatgctgaaactatctgtaaaagcttttggctagcaaaaagccattgaaatttatgaaaatcaggtggggatgctctcctcccgttgaccaagg

SEQ ID NO: 41679 - DNA, 1370 bp, Panicum virgatum
  misc_feature: Ceres CLONE 2008671
  misc_feature: Encodes the peptide sequence at SEQ ID NO. 41680
gtccggcttgtcgcctccgactccggcgactccgcgactgcgcacttccaactacgccgccgccagagccggagcgaagctgccgaagaagcaagcgtgcctcccttccctctccctcggtcgaccagatggacggccgcgtgaaggtggtggggcaggtggagcgcgtggacggagcgtcgctgacctacgcggagttcgtcgaccgcttcatggcgcccaaccgacccgtcgtcctcacggggctcaccgcgtcctggcaggcctgcgaggactggacgctccccggccccggcgaccgccgtcgccctgacctcagcttcttcgcccggaacttcccctcccctctcgtccaggtcgctgactgctcctcgagggagttcacggaccagaagcgccttgagatgtccatgcaggagttcatagaccattgggttggagacgctcacggtggctccagtgctggggatcgcgagagctccctgttgtatctgaaagattggcatttcgttaaggagtaccctgattatgttgcatatactacaccaacattctttgttgatgattggctcaacatgtatcttgacagtcaccctatacatagagattctgacattgccaatcataaaaatgaaataaactgttcggactatcggtttgtttacatgggagaaaaaggaacttggactcctctgcatgctgatgtttttaggtcatacagctggtcagcaaacatttgtgggagaaaacaatggctgtttctaccaccatcacaaagtcatcgtgtatttgataggtacatgagatcctcagtctataacttaaatgatgatgtttctgaaaagctttttcctgaattcaataagactgaatggctagagtgcattcaagagcagaatgaaatcatatttgttcccagtggatggtatcaccaagtacataacctggaggatactatatctataaaccataattggtttaatgcctacaacctgcactgggtgtggaacttgctttatgaagactacaaagttgcaaaagaatatattgaagacattcgagacatatgtgatgattttgaagggctttgccaacggaacttggcggctaatacagggatgaacttctatgatttcttcattttcattgtgcggtttgctttagccaatgtaattgagctttaccatgttcagcagccagaggttgcaacattttcaacagaaactgcacaccattttgtctataatctgaagtcaattcgtaatgttgcatcaaaaatgctaactacagaggcttttcactactgagaatcttcgtagtatttctgaagataaccgaaatgctttctccaatgtcaaacaaatatttaa

SEQ ID NO: 41680 - protein, 392 aa, Panicum virgatum
  misc_feature: Ceres CLONE 2008671
  misc_feature (177)..(283): Pfam Name: JmjC Pfam Description: JmjC domain
  misc_feature: SWISSPROT Homolog: EC 1.14.11.16 Peptide-aspartate beta-dioxygenase
MDGRVKVVGQVERVDGASLTYAEFVDRFMAPNRPVVLTGLTASWQACEDWTLPGPGDRRRPDLSFFARNFPSPLVQVADCSSREFTDQKRLEMSMQEFIDHWVGDAHGGSSAGDRESSLLYLKDWHFVKEYPDYVAYTTPTFFVDDWLNMYLDSHPIHRDSDIANHKNEINCSDYRFVYMGEKGTWTPLHADVFRSYSWSANICGRKQWLFLPPSQSHRVFDRYMRSSVYNLNDDVSEKLFPEFNKTEWLECIQEQNEIIFVPSGWYHQVHNLEDTISINHNWFNAYNLHWVWNLLYEDYKVAKEYIEDIRDICDDFEGLCQRNLAANTGMNFYDFFIFIVRFALANVIELYHVQQPEVATFSTETAHHFVYNLKSIRNVASKMLTTEAFHY

SEQ ID NO: 41681 - DNA, 1307 bp, Panicum virgatum
  misc_feature: Ceres CLONE 2008683
  misc_feature: Encodes the peptide sequence at SEQ ID NO. 41682
attaaaaccaccggaagcgccgcctcgtccgcttctggcacagcagagcaatcaggcgaactactagagctagctaaacctcggagccatcccccccgcgagcgagacaccctcgaggcctcctccgatcgcagcctcgcaatccccccccccccccccccccatggcgtcgcacatcatcctgccgccggaggacgccgacgagaaccaccaccgggaggaggatggggaggaggaggaggagcgggaggagctggggcacgacggcggggagcgcgcgcccccggagcagccgcccaaggcggcgctgccgttctcggccacgtgcgtgcggatctcgcgcgactcgtacccgaacctccgcgccctgcgcaacgcctcctccgtcagcctcgccgacgccgcctacgtcaagatctccgagggcgacttcgggtacgtgctcgacgacgtgccgcacctcaccgactacgtccccgatatcccgacttatcctaatccgttacaagaccatccagcctattcaactgtcaagcagtacttcgtcaatgaagatgatactgtaccgcaaaaggtggttgttcagaagaacagccggcgtggcgtccacttccgtcgtgctgggcctcgtcagaggatttattttggtcccgatgaagtaaaagcctgcattgtaacttgtggaggcctctgcccagggcttaacactgttatcagagaacttgtgtgtggcttgtcacacatgtacaacgtcaacagcatctttggaatacagaatggatacaaagggttttattctagcaactaccttcccctgacaccgaagagtgtcaacgacatccacaaaaggggtggtacaattcttgggacatcacgaggtggtcatgatacaaagaagattgttgataacattcaagatcgtgggattaatcaggtgtatatcattggaggagatggaactcagaagggagcatacgatatattcaaggaaatccgaaaacgtagcctgaaagtttctgtggctggagtccccaagacaattgataatgacattgcgattatcgacaagtcctttggttttgatacggctgtggaagaggcccagcgtgccattgattcagctcatgtcgaagcttgcagtgctgagaatggaataggcttagtaaaactgatggggcgctatagtgggttcattgcgatgtgtgctactcttgctagtcgagatgtggactgttgtttgattccggagtctccattttatatggatgggagaaggtgggctgcttggatatatagaaaaggagctg

SEQ ID NO: 41682 - protein, 381 aa, Panicum virgatum
  misc_feature: Ceres CLONE 2008683
  misc_feature (167)..(381): Pfam Name: PFK Pfam Description: Phosphofructokinase
  misc_feature: SWISSPROT Homolog: EC 2.7.1.11 6-phosphofructokinase
MASHIILPPEDADENHHREEDGEEEEEREELGHDGGERAPPEQPPKAALPFSATCVRISRDSYPNLRALRNASSVSLADAAYVKISEGDFGYVLDDVPHLTDYVPDIPTYPNPLQDHPAYSTVKQYFVNEDDTVPQKVVVQKNSRRGVHFRRAGPRQRIYFGPDEVKACIVTCGGLCPGLNTVIRELVCGLSHMYNVNSIFGIQNGYKGFYSSNYLPLTPKSVNDIHKRGGTILGTSRGGHDTKKIVDNIQDRGINQVYIIGGDGTQKGAYDIFKEIRKRSLKVSVAGVPKTIDNDIAIIDKSFGFDTAVEEAQRAIDSAHVEACSAENGIGLVKLMGRYSGFIAMCATLASRDVDCCLIPESPFYMDGRRWAAWIYRKGA

SEQ ID NO: 41683 - DNA, 598 bp, Panicum virgatum
  misc_feature: Ceres CLONE 2008683-R
ttaaatacatagatcctacatacatgatccgtgccattccaagcaatgcatcagacaacgtgtactgcacacttctggctcacagcgctatccatggtgcaatggcagggtacagcttcaccgttggaatggtcaacggtagacatacctatatacctttctatagggtgacatccacaaggaacaaggttaagatcaccgacaggatgtgggccaggctgctatcgtcgactaaccagccaagtttcttaagtcagaaggacatcgatgaagcgatggaggatgataggcttgccaacaggccaccactgccgatgggcgccaaccatcgtgtggcgagctccttcgagcagtcctcttctacttcttccaacggagagatctaagtgattgctggcgccccgggaatgtgtacatgagctgttaagctttgccacgcttatcaattttgctttttatgtgcatatgccttgcgtatgaggacgcatggatactatcctgatacccagagcaataaaatgaacaccggtgcggtgatcagtgaacctgtacaagcactatcttgtgctcgctgggtaatattcaatgcaatttcatc

SEQ ID NO: 41684 - DNA, 692 bp, Panicum virgatum
  misc_feature: Ceres CLONE 2008685
  misc_feature: Encodes the peptide sequence at SEQ ID NO. 41685
gagttaagggaaatgtaattcctctctatgcaaaccatttccttgtgcattttgatcatggaaagaagatttttcattacgatgttgacatatacccacacccttcgaaagaaacagcaagaatgatcaagaacaagctagttgaagaaaattcaagtgtcctctcaggggccctgccagcctttgatggccgcaagaatctgtttagtccaattgagtttcaacagaacagacttgagttctttgttaatcttccagcagctgcatcaacgcgatttatagcagctaaagagtgtgcccacatgcgtgacaagcagaatcatagggttttcagggtgaaccttcggttggtttcaaagcttagtggtgaggagttgaacaagtacttgaatgaagagaaggatggtattcctcttcctcaagattaccttcatgcattggatgtcatcctgcgggaaggtgctatggaaaattctattcccataggtcggtctttgtattcacattccatgggagaagcaaaggaaattggtggtggggctgttgtattacgaggttttttccagagcttgaggccgacaaagcaaggtctttccctcaatgttgacctctcccttacagcattccacgaaaacattggcataattgcatacttgcagaaacgctgtgacttcatgaaggacctttcacag

SEQ ID NO: 41685 - protein, 229 aa, Panicum virgatum
  misc_feature: Ceres CLONE 2008685
  misc_feature: The sequence is a functional homolog of SEQ ID NO 188 in the 10/666,642 US patent application
  misc_feature: Functional homolog of the protein sequence given in SEQ ID NO 51205
  misc_feature: Useful for making plants with modulated biomass
VKGNVIPLYANHFLVHFDHGKKIFHYDVDIYPHPSKETARMIKNKLVEENSSVLSGALPAFDGRKNLFSPIEFQQNRLEFFVNLPAAASTRFIAAKECAHMRDKQNHRVFRVNLRLVSKLSGEELNKYLNEEKDGIPLPQDYLHALDVILREGAMENSIPIGRSLYSHSMGEAKEIGGGAVVLRGFFQSLRPTKQGLSLNVDLSLTAFHENIGIIAYLQKRCDFMKDLS

SEQ ID NO: 41686 - DNA, 1448 bp, Panicum virgatum
  misc_feature: Ceres CLONE 2008701
  misc_feature: Encodes the peptide sequence at SEQ ID NO. 41687
aatattttatttcggcagatttaaatctcaatgaagcacaactttatcttcgaaccctcaagaaactatcatgaacaacacatgctgccaatctcacctcaaaactttgaccctctagacaaaaatagagaggctgtttctcaaaagaaaacaattttctcaacatccaccaaaccaaaggccgcctatgatattattttcgagtcagacaacagtcaaccaaaatccgatgatttcaataccgagactgaactcaaaagaatgctcttcagagaaatgaaagcccactttgaaaatctcaaattagaacttgtcgaaagcttctctgttatcttgagagattatcgttcaactggaaagatcagtaacgatgagctccaagaaatcaagagacaaattttatacaacaagaggaagtttgaagagattcaggaaaatctgggccaccttagccaacaatacagcgaagccaactccatttatggaaaagacgctgacaactacagaactattggcagcttctctaccctttctcgaaatgagaggcagcttgaatcctctccttctggagacatgatctcacagaagcaacttgatatacaattcaaagcccacagacagggattgcttgtggaagtccaaaatgccatcaaagtcaaggggaaaagcaaattgagcgaagataccgtcggcgagctcaagcaaattaaatataattttgaaaacgacctcaagcaaaatttcgaaatcatcaatggaagagtcaaaagagctgaggaaaatctcaacgaaatcatgagaaaaaagcgagaacatatggaagccatcagagaagaatttgttgcatccatgaatcatcatgaagccgccgttaatcaagaattcaaccatatcgaaaatgtcctcaaatctaaatgtgatcaaaatcaagctaaagctatcgttaacaatgaaattaataaacgtatggaattatttaaaacagaaattgatagtctccgaaaaactctcaaagaaaatcaagaagaaatggagagagtcgagacaattgttaatagaaagttggaaaatcttgattttgatatgaaaagacaatttgttgaacttcaagcttccaattcacaaagaggtggtgctcctcaggatttaattgacagaagaattcaaaaactcaacagtgattcagaaacttatcataaaactatccaacaacttcgagcccaagtcgatgaaatcaccaaatttcataaaaccttacagactcaggttgtgactccttcatctcaaagcacaatcttgagactcgaagaaaaaatcaaaggcctccaaaatcacatcatcgaactcgaaacctttgttaaagaaacaataaaactgcatcaatgtccgaagtagaagcctttatgcgacctgctcccggagaatcaaactttaccagttatacaaag

SEQ ID NO: 41687 - protein, 437 aa, Panicum virgatum
  misc_feature: Ceres CLONE 2008701
  misc_feature: SWISSPROT Homolog: EC 2.7.11.1 Non-specific serine/threonine protein kinase
MLPISPQNFDPLDKNREAVSQKKTIFSTSTKPKAAYDIIFESDNSQPKSDDFNTETELKRMLFREMKAHFENLKLELVESFSVILRDYRSTGKISNDELQEIKRQILYNKRKFEEIQENLGHLSQQYSEANSIYGKDADNYRTIGSFSTLSRNERQLESSPSGDMISQKQLDIQFKAHRQGLLVEVQNAIKVKGKSKLSEDTVGELKQIKYNFENDLKQNFEIINGRVKRAEENLNEIMRKKREHMEAIREEFVASMNHHEAAVNQEFNHIENVLKSKCDQNQAKAIVNNEINKRMELFKTEIDSLRKTLKENQEEMERVETIVNRKLENLDFDMKRQFVELQASNSQRGGAPQDLIDRRIQKLNSDSETYHKTIQQLRAQVDEITKFHKTLQTQVVTPSSQSTILRLEEKIKGLQNHIIELETFVKETIKLHQCPK

SEQ ID NO: 41688 - DNA, 583 bp, Panicum virgatum
  misc_feature: Ceres CLONE 2008701-R
actttatcaatggaacaacatcaaactttttggatgatgaagaagatgctgaaatatattgtaatttggatgatgatggttatatctttgatgaggatggagactttgttctcaattctcaaggtcaaaaggttaagttgacaccagaacaaattgacagatttaacaacaacaacatgatcgaataagccttcaaaagccagatttcacatcatctttcactgtcttctcaattaaaactctattttattttcttaacattgaggcacaataaattatatgctatttgatctggagctctgagtttgaactctttatgtaacacaacaattgacaacagtattttctgtgtggtttgatggatcacattaacgttgcccttcatggcaactgaatgtaacattgcatcagattttctccagtaatatgcataaaattattatttgagtagaattattgtttacagaaaattatctatctatatattccattgcttttttctttaagaatttataattattccatgctgtttgtttattattgaaatataataagaattttaatatcaatataataataaccg

SEQ ID NO: 41689 - DNA, 555 bp, Panicum virgatum
  misc_feature: Ceres CLONE 2008707
  misc_feature: Encodes the peptide sequence at SEQ ID NO. 41690
aaaaaaaaaaaaaaaaaaaaactacccttctccatccgctcccaccctctcggctgccaggagaagcagccgtcgccgccgccgcttcgacagccaccgcagggtaccaagatgaaagcacttgcaggtttaaggagaatcaatttagatgggctgcgttggcatgtatttgatgcaaagggccaggtgcttggacggttggcatcccaaatagctgttgtgctacaagggaaggataaaccaacttatgcaccacatgtggaaaatggagacatgtgcattgtgctaaatgccaaggatatcagtgttacaggaagaaaaatgaccgataagatttactactggcacacagggtacattggccatctaaaggaaagaagactcagggaccagatggagaaagacccaactgaggtgattcgcaaagctgtcctgcgcatgcttccccgcaacaggctgcgtgatgacagggatcgcaagctgaggatattttctggaaatgagcatccattccacgaacgccctcttgaaccgtttgtgatgccacgcagacaa

SEQ ID NO: 41690 - protein, 147 aa, Panicum virgatum
  misc_feature: Ceres CLONE 2008707
  misc_feature (17)..(144): Pfam Name: Ribosomal_L13 Pfam Description: Ribosomal protein L13
MKALAGLRRINLDGLRWHVFDAKGQVLGRLASQIAVVLQGKDKPTYAPHVENGDMCIVLNAKDISVTGRKMTDKIYYWHTGYIGHLKERRLRDQMEKDPTEVIRKAVLRMLPRNRLRDDRDRKLRIFSGNEHPFHERPLEPFVMPRR

SEQ ID NO: 41691 - DNA, 703 bp, Panicum virgatum
  misc_feature: Ceres CLONE 2008710
  misc_feature: Encodes the peptide sequence at SEQ ID NO. 41692
atttttttccggcctcctcttcctcgcgcggcgcctgcccccctgccggttcgaagcgtgcgaagagagcgaagaagcagcgcggagagatggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaatctgtgcgccatccatgctaagcgtgtgaccatcatgcccaaggacattcagctggccaggaggatccgtggcgagagggcttaatcatgatcatgacaatcaaaatctcgtgtcgtagtagtggtttaatgtggtgccatgttcaggacatcagtagggcttgttttgtggatcataagtttctcttctgcagcactatatgttgcgactaccgttgtttggtgttattactagggtcgtcgaatacttaaattgtctagtgttgttaccgtggtgacagtttgacc

SEQ ID NO: 41692 - protein, 136 aa, Panicum virgatum; identical to SEQ ID NO: 9871
  misc_feature: Ceres CLONE 2008710
  misc_feature (58)..(132): Pfam Name: Histone Pfam Description: Core histone H2A/H2B/H3/H4

SEQ ID NO: 41693 - DNA, 656 bp, Panicum virgatum
  misc_feature: Ceres CLONE 2008717
  misc_feature: Encodes the peptide sequence at SEQ ID NO. 41694
cacccacccgtcgcctgcccacccatttctcccgagagccccgacgcgcgctgcctgcaccctcgccgccgccgccgcctcctctccagctcggacccccatggcttccctcgccggatccgccctctccctcgcgatgcccgtcaaggcaattaacattaagtccgtctctttctctggtttaaggaaggataatgtaaccttccgtctgcagccagtgccacaaagatttgcagtctgctgtctggctaaaaaggagacagtggaccaggtttgtgatattgtcaagaagcagcttgcacttgctgaaggcactgaagtttgtggctcctccaagttccaagatcttggtgctgattcattggacactgttgagattgttatgggccttgaggaggcttttgggatcagtgtggaggagtcaagcgcgcagtcaattgcaaccgtggaagatgctgctaatctcattgatgaccttgttgctgcaaaatcgtcctaaactcggatcaatattacttatcctggccctgaaccaaggcatctcttgtcccatgctccttccctgctagattttaccctggagagccatttctttgttattactgatttactgtcattgtggatcctgcaatattattacattgaagcttttgtgc

SEQ ID NO: 41694 - protein, 132 aa, Panicum virgatum
  misc_feature: Ceres CLONE 2008717
  misc_feature (56)..(123): Pfam Name: PP-binding Pfam Description: Phosphopantetheine attachment site
MASLAGSALSLAMPVKAINIKSVSFSGLRKDNVTFRLQPVPQRFAVCCLAKKETVDQVCDIVKKQLALAEGTEVCGSSKFQDLGADSLDTVEIVMGLEEAFGISVEESSAQSIATVEDAANLIDDLVAAKSS

SEQ ID NO: 41695 - DNA, 711 bp, Panicum virgatum
  misc_feature: Ceres CLONE 2008718
  misc_feature: Encodes the peptide sequence at SEQ ID NO. 41696
gccgcgtcgccgccgtctcctccgcctccctgtctgtcccctccccacccccatcccgtaaaagcaccggccattgccgcaccaagcttccctcccctcaaatgcccgagaccccaccgccgcgacgcgccccaccgtccgcacatggctaacgggctcctcctccgcgccgcctccccgggcctccgccccgccgccggctcctccgctgactccggccggggacatggcgtggtgacgatcggcgattcgaggccgcgcggtgctgctctgcgggtgggaggacctagccggagagaattctcatttatcacaacagccgccaaagatcattctgtcttgacccggcagcttctagattcgcgacatgatacagtagacgaggtaggtacagaacatgatccgttcattgagttgaaagcgaggttcatggacttcaaacagcgaaactatgtggaaaatttttcaaattaccaaagtttggcgcaacagcaaacaccaaagttcatggtgattgcttgtgctgactccagggtctgccctaccagtattttggggtttcagcctggggaagcatttacagttcgtaatgtggcaaatttggtaccaccatatgagcatgggggttcagagactagtgcagcactagagtttgctgtcaatacactccaggtagaaaatgtattggtggtaggtcacagccgatgtggt

SEQ ID NO: 41696 - protein, 188 aa, Panicum virgatum
  misc_feature: Ceres CLONE 2008718
  misc_feature (114)..(188): Pfam Name: Pro_CA Pfam Description: Carbonic anhydrase
  misc_feature: SWISSPROT Homolog: EC 4.2.1.1 Carbonate dehydratase
MANGLLLRAASPGLRPAAGSSADSGRGHGVVTIGDSRPRGAALRVGGPSRREFSFITTAAKDHSVLTRQLLDSRHDTVDEVGTEHDPFIELKARFMDFKQRNYVENFSNYQSLAQQQTPKFMVIACADSRVCPTSILGFQPGEAFTVRNVANLVPPYEHGGSETSAALEFAVNTLQVENVLVVGHSRC

SEQ ID NO: 41697 - DNA, 724 bp, Panicum virgatum
  misc_feature: Ceres CLONE 2008719
  misc_feature: Encodes the peptide sequence at SEQ ID NO. 41698
cacacaggagcccgcggagtgatcaaaaaagcaagtaacaagagaagatgaccgacgttgtgatgaccatcagtactaccacggatttggaaagagaactgaataaacccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctggcgtggaggcgctaccgacgtacgttctactgaagaatgacaatgtgatggacatggtcgttggcgtcaggaggcacgagctcgagaacgccataaaaaacaatacctaacgactgatccgatcagatcatccatgcgtcgagaacgaacgggaaatgaatgattcatagttaaataagcccactactgtacgtcccatgtgttgtatcacggatactgaaactcgtgtgtgcatgtacacatcctagctagctcagccgccgtagcagctagctacgatgcattgtacgtatggatctcgattatcgattgtcccatgtttgatttcctaaacttctgtggaactagatccccatgttatgtatactctggtttgaaacagtttgcaataaatcaatgtctggctagtataaaaaaactccaccaagagccgccagttcgacaaaccccggccccgcag

SEQ ID NO: 41698 - protein, 108 aa, Panicum virgatum
  misc_feature: Ceres CLONE 2008719
  misc_feature (4)..(107): Pfam Name: Thioredoxin Pfam Description: Thioredoxin
  misc_feature: SWISSPROT Homolog: EC 1.8.1.8 Protein-disulfide reductase
MTDVVMTISTTTDLERELNKPDKLIVLEFMAPWSEPCKVMKEPYRRIARARKDRVNFYTLNVDKFKDLAEEAGVEALPTYVLLKNDNVMDMVVGVRRHELENAIKNNT

SEQ ID NO: 41699 - DNA, 1207 bp, Panicum virgatum
  misc_feature: Ceres CLONE 2008733
  misc_feature: Encodes the peptide sequence at SEQ ID NO. 41700
  misc_feature (599)..(599): n is a, c, t, g, unknown, or other
ctctgtttcttgcattgcttcctccgtgctgtaacacagagccaaaattttcttccaagttattccaactccaagtgtatcgttccatatatagccttttattcccacaatgcaaccgcacctgcagtaatggcgacgatgccggcgcagcgagccgcaacgcgcgtctcctccggcggcggccggctcgtgttcggcaagcctgagaaggccaagggcgggagactgcttgtgaggagctgtgacaatggcggcggcggcaggaatggcagacgtgtcagtgtctcagtggaagctgtcaacggcgctgtcaagctgaacggcgccgcggtggtggccgacgtccggcaggtacccgcgccaccgccgccgccgtcgtcagtggacgacgccggcgatgccttccggctcggcaagttcgtggaagcgaggctcgtgtacaggcagcagtttgtgatcaggtcctacgagatcgggcctgaccggactgccaccatggagaccatcatgaacctcctgcaggagacagcgctgaaccatgtgatgtgctccgggcttgccggcgacggcttcggcgcgacgcggcagatgagcctcangaagctcatctgggtggtcaccaggatcaacatccaggtcgacaagtacagcagatggggagacgtcgtcgagatcgacacctgggtcgcgtcgtcagggaagaacggcatgcgccgagactggatcatccgggaccgcaacaccaagaacatgatcgcaggagccacaagcaactgggtgatgatgaaccgagagacccggaggctgtccaagatccccgaggaggtcaggcaggaggtgcttcccttctacctggaccggagcatcatcgccgccgacgccgatgccggcggccgcaagatcgagaagctcaccgactccacggcgcagcacatacgatcaggactagctcccaggtggagcgacatggatgtcaaccagcacgtgaacaacgtcaagtacatcggctggatcctcgagagcgtgccgctggacgtgctggaggactaccacctgacgagcatcacgctcgactaccgccgggagtgccgccagtcgcagctcctcgagtcgctcaccagcatgacgacggccgagccggcgccgccgctgccggcggcggccggccggtgcggcggcgacctgcacagcacgcatctgatacggc

SEQ ID NO: 41700 - protein, 359 aa, Panicum virgatum
  misc_feature: Ceres CLONE 2008733
  misc_feature (101)..(359): Pfam Name: Acyl-ACP_TE Pfam Description: Acyl-ACP thioesterase
  misc_feature (157)..(157): Xaa is any aa, unknown, or other
MATMPAQRAATRVSSGGGRLVFGKPEKAKGGRLLVRSCDNGGGGRNGRRVSVSVEAVNGAVKLNGAAVVADVRQVPAPPPPPSSVDDAGDAFRLGKFVEARLVYRQQFVIRSYEIGPDRTATMETIMNLLQETALNHVMCSGLAGDGFGATRQMSLXKLIWVVTRINIQVDKYSRWGDVVEIDTWVASSGKNGMRRDWIIRDRNTKNMIAGATSNWVMMNRETRRLSKIPEEVRQEVLPFYLDRSIIAADADAGGRKIEKLTDSTAQHIRSGLAPRWSDMDVNQHVNNVKYIGWILESVPLDVLEDYHLTSITLDYRRECRQSQLLESLTSMTTAEPAPPLPAAAGRCGGDLHSTHLIR

SEQ ID NO: 41701 - DNA, 671 bp, Panicum virgatum
  misc_feature: Ceres CLONE 2008740
  misc_feature: Encodes the peptide sequence at SEQ ID NO. 41702
ctctctctctctctctctctctctctctctctcgacccttcctgctggtcagtgagttctgaccaacgccactacactgaccagcaggaactagggggtcgccggagaagggcgcgctatggagccggcggtagagaagaaggaggccgaacaggaggagcagcagctaccgcaagcgcgcaaggaagacgcgcccgccgccgccgctgcagaggaggacgaggcagattcggaggagaccgagcgccgcaaccgcgacctcaaggccgtccttcacccccttaggcgcaagctcgttctctggtacacgcgtcggacgcctggggcgaggtcgcagtcgtacgaggacaacatcaagaagatcattgatttcagcactgtcgaatcattctgggtttgctactgccacctcgcgcgcccgtcttctctgccgagccccactgatcttcatctcttcaaggatggcatccggcccctctgggaggaccctgcaaatcagaatggtggcaagtggataattaggttcaagaaggctgtttcaggtcgtttctgggaagatttggtaagtggaccagtacctgtcttactgtctatgtatgttttcaagagattgtttgatgccagcgttgatcatattttggttaaactccatgaacatccattacctgaac

SEQ ID NO: 41702 - protein, 184 aa, Panicum virgatum
  misc_feature: Ceres CLONE 2008740
  misc_feature (25)..(182): Pfam Name: IF4E Pfam Description: Eukaryotic initiation factor 4E
MEPAVEKKEAEQEEQQLPQARKEDAPAAAAAEEDEADSEETERRNRDLKAVLHPLRRKLVLWYTRRTPGARSQSYEDNIKKIIDFSTVESFWVCYCHLARPSSLPSPTDLHLFKDGIRPLWEDPANQNGGKWIIRFKKAVSGRFWEDLVSGPVPVLLSMYVFKRLFDASVDHILVKLHEHPLPE

SEQ ID NO: 41703 - DNA, 683 bp, Panicum virgatum
  misc_feature: Ceres CLONE 2008765
  misc_feature: Encodes the peptide sequence at SEQ ID NO. 41704
atctgtctggccatggcgtggtgggccaaatgagaaggctgctactgttgataatgctttggcctacaatacaaacctcatacgtcatgtactgaataattctggtacacccagccaaccaatgaatcagtcaagcacctacatctttgagctattcaatgaggatcttcgctcaggacctgaatcggagaaaagttgggggattatgtttcctaacgcaaccactgtgtactctctatcatttgaggatgtggccacaactatcccagaatcaccggccctgcgtggaatgttttgtgtggcaaattctagtgcaccccatagtgcacttaagcatagtttggattgggcatgtggccctggctctgcaaactgcagtgcaattcagcctgggcaaccatgctatgaatcagataacattgtagctgttgcatcatatgctttcaatgattattatcatagaacacaagctagtggtggcacgtgcagctttaatggcactgcaatgataacatctactgatccaagccatggctcatgcattttcgctggaagcactggcgccaacagcgatggtggtacagcctccgggcccgtaagccctgacagttttgcttcgagatcccaatcctgctggttgactcacctagcagctgcattgttgctcattctagtggtgtaaa

SEQ ID NO: 41704 - protein, 226 aa, Panicum virgatum
  misc_feature: Ceres CLONE 2008765
  misc_feature (97)..(182): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50558
  misc_feature: Useful for making plants with altered carbohydrate content
  misc_feature: Functional homolog of the protein sequence given in SEQ ID NO 50559
  misc_feature: Useful for making plants with altered cell wall content and/or composition
SVWPWRGGPNEKAATVDNALAYNTNLIRHVLNNSGTPSQPMNQSSTYIFELFNEDLRSGPESEKSWGIMFPNATTVYSLSFEDVATTIPESPALRGMFCVANSSAPHSALKHSLDWACGPGSANCSAIQPGQPCYESDNIVAVASYAFNDYYHRTQASGGTCSFNGTAMITSTDPSHGSCIFAGSTGANSDGGTASGPVSPDSFASRSQSCWLTHLAAALLLILVV

SEQ ID NO: 41705 - DNA, 1325 bp, Panicum virgatum
  misc_feature: Ceres CLONE 2008766
  misc_feature: Encodes the peptide sequence at SEQ ID NO. 41706
tcccatctccgcctcgccgctacctttcccttccctcccacctcgcgctcctccaccttcctgccccctcctccgccgcggctcggcaagcaacagctccccatcgacccaccgccgccgccgccgccgccgccacgcctcccaccaccatggcgtcgggcggccgcgctcttgccccgaggccatgactcggcgccgcccgtggccgtggctctccgtctcctccctctccctgcgacgacaacccctcccgttcctccccctcctccttgggcggcggtagatggcggcggcgatggtggtgggcggggccggcaaggaccgctcctcgcctggcggcggcggggcgccgcaggtggacacgggcaagtacgtgcgctacacccccgagcaggtcgaggcgctcgagcgggtctacagcgagtgccccaagcccagctcgctgcgccggcagcagctcatcagggagtgccccatactcagcaacatcgagcccaagcagatcaaggtctggttccagaaccgcagatgccgcgagaagcagcggaaggaggcctcgcggctgcagactgtgaaccggaagttgactgcgatgaacaagctgttgatggaggagaatgacaggctgcagaagcaggtgtcccgtcttgtttacgagaatgggtacatgcagcagcagctccataatccttctgttgcgactacagacacgagctgtgagtctgtggtcacaagtggtcagcaccaccagcagcaaaacgcagcagctccgcgtcctcaaagggatgcgaataacccagctggtctactcgctattgctgaggagaccttggcagagttcctgtcgaaggcgacggggactgctgtcgattgggtgcaaatggttgggatgaagcctggtccggattccattggaatcatcgctgtttcgcacaattgtagtggcgtagcagcccgagcttgcggcctagtgagccttgagcccacaaaggtcgcggagatccttaaggatcgcccctcttggtaccgcgactgccggtgtgtggatatcctccatgttatccctacgggtaacggtggaactatcgagcttatctacatgcagacttatgcaccgacaactttggcggcaccgcgcgacttttggactctccgttacactagtggtcttgaagatggcagtcttgtgatctgtgagaggtcattgacacaatcgactggaggcccatcaggacccaacactccgaattttgtcagagccgaggtgcttcctagtggctatttaattcgaccgtgtgagggaggtggctccatgattcacattg

SEQ ID NO: 41706 - protein, 347 aa, Panicum virgatum
  misc_feature: Ceres CLONE 2008766
  misc_feature (177)..(347): Pfam Name: START Pfam Description: START domain
  misc_feature (29)..(87): Pfam Name: Homeobox Pfam Description: Homeobox domain
  misc_feature: Functional homolog of the protein sequence given in SEQ ID NO 50330
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
MAAAMVVGGAGKDRSSPGGGGAPQVDTGKYVRYTPEQVEALERVYSECPKPSSLRRQQLIRECPILSNIEPKQIKVWFQNRRCREKQRKEASRLQTVNRKLTAMNKLLMEENDRLQKQVSRLVYENGYMQQQLHNPSVATTDTSCESVVTSGQHHQQQNAAAPRPQRDANNPAGLLAIAEETLAEFLSKATGTAVDWVQMVGMKPGPDSIGIIAVSHNCSGVAARACGLVSLEPTKVAEILKDRPSWYRDCRCVDILHVIPTGNGGTIELIYMQTYAPTTLAAPRDFWTLRYTSGLEDGSLVICERSLTQSTGGPSGPNTPNFVRAEVLPSGYLIRPCEGGGSMIHI

SEQ ID NO: 41707 - DNA, 499 bp, Panicum virgatum
  misc_feature: Ceres CLONE 2008766-R
  misc_feature: Encodes the peptide sequence at SEQ ID NO. 41708
tcatgtgctgttccctgaaggctgctcctgtgtttaccttcgccaaccaagccggccttgacatgctggagacgaccctgattgctctccaggacatctcactggagaagatcctggacgatgatggcaggaaggcactttgcaccgagtaccccaagattatgcaacagggcttcgcatacctccctggcggtgtctgcgtgtcgagcatgggtcggcccgtgtcgtacgagcaggcggtggcgtggaaggtcctgagcgacgacgacaccccgcactgccttgccttcatgttcgtgaactggtccttcgtgtgagaaaaaccctagtcgagtctgccatttctcaagaacttgtctgtatccatgtaccgtcgcttttgccctgtcatgacaaactatgaaacgcatctcccaagttcatcctgtggacacaaactgcttgtatccgtctttgctttgcttgcttgtgctatctatgatggatcgttgtttgtttc

SEQ ID NO: 41708 - protein, 104 aa, Panicum virgatum
  misc_feature: Ceres CLONE 2008766-R
  misc_feature (1)..(104): Pfam Name: MEKHLA Pfam Description: MEKHLA domain
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: Functional homolog of the protein sequence given in SEQ ID NO 50330
  misc_feature: Useful for making plants with altered carbohydrate content
MCCSLKAAPVFTFANQAGLDMLETTLIALQDISLEKILDDDGRKALCTEYPKIMQQGFAYLPGGVCVSSMGRPVSYEQAVAWKVLSDDDTPHCLAFMFVNWSFV

SEQ ID NO: 41709 - DNA, 712 bp, Panicum virgatum
  misc_feature: Ceres CLONE 2008772
  misc_feature: Encodes the peptide sequence at SEQ ID NO. 41710
accatatctatcccgtcccggaaacattctgcacgcggcagctagcagctgcaggaatggctacttccacacctcctgccagcctcctgctgctccagcgcctgctcccgttaacgctgctgctgttcattggcggcgcgccagcgacggcgcgcgccgccgacatgccgatgccggtcaacgaggaggtgctggggctggtggtcttcaagtcggcgctctccgacccgtccggcgcgctggccacgtggacggagtccgacgccacgccctgcggctggcgctgcgtcgagtgcgacccggccacctcccgggtgctccacctctcgctctccggcctcgcgctctccggccccatgccgcggggcctcgaccgcctccccgcgctccaggagctcaccctcgcccgtaacaacctctccggcccgctcccgccgggcctctccctgctcaagtcgctccgctcgctctacctctcctacaacgccttctccggcccgctccccgacgacgtcgcgctgctcgcctccctgcgctacctcgacctcaccggcaacgccttctccggcccgctcccggctgcattccctccgaccgtccgcttcctcatgctgtccgacaaccagttctccggcccggtaccggagggcctgcccaagagcccgctgctgctccacctcaacctgtccggcaaccagctctccggctcgcc

SEQ ID NO: 41710 - protein, 218 aa, Panicum virgatum
  misc_feature: Ceres CLONE 2008772
  misc_feature (41)..(81): Pfam Name: LRRNT_2 Pfam Description: Leucine rich repeat N-terminal domain
  misc_feature: SWISSPROT Homolog: EC 2.7.11.1 Non-specific serine/threonine protein kinase
MATSTPPASLLLLQRLLPLTLLLFIGGAPATARAADMPMPVNEEVLGLVVFKSALSDPSGALATWTESDATPCGWRCVECDPATSRVLHLSLSGLALSGPMPRGLDRLPALQELTLARNNLSGPLPPGLSLLKSLRSLYLSYNAFSGPLPDDVALLASLRYLDLTGNAFSGPLPAAFPPTVRFLMLSDNQFSGPVPEGLPKSPLLLHLNLSGNQLSGS

SEQ ID NO: 41711 - DNA, 1309 bp, Panicum virgatum
  misc_feature: Ceres CLONE 2008784
  misc_feature: Encodes the peptide sequence at SEQ ID NO. 41712
aacaaacgctaaaaaagtaacagtttctgtactttattggttcatccgtaccacctaccgcgtttaccacacacttccaccactcgtatactcaatgggcggcgacgatttcaccatcgcgtacgctgacaatcaccacgggctcacgtcgtctgaggcggcggcgcgcctggcccagttcggtcgcaacgaactgcccgagaagaccacgcccggatgggtgatcttcgtgaagtgtctgtggggccccatgcccatcgcgctgtggatcgccgtcatcatcgagttcgccttgcagaattggcccgacggcgcgattctgctggcgatccagttcggtaacgcgacgattggttggtacgagacgacgaaggccggcgatgcggtggcggcgctgaagcagtcgctgaagccgcgcgcgacggtgtaccgtgacgggcaatggcaggagatcgacgccggcatcgttgtgccgggcgacaaggtgaagctggcgagcggctcagccgtgccggccgactgcaccgtgaacgacgagccgggcagcatcgtgacgccgcagatcgacgtcgacgaggctgcgctgactggcgagtcgctgcccgtgacgatgacgccgaagacgcacatggcgaagatgggctcgacggtcgtgcgcggcgaggtggacggcaccgtgcagtacacgggcacgaacaccgtgttcggcaagacggcgctgctgctgcaggcggtcgaggcggacctcggcaacatccactacgtgctcgtgaaggtcatgtacgggctgaccggcctgtcgatgctcctctgcatcatctgcttcatcttcttgatgacctaccaccacacgacgttcaaatccacgatccagttcacagtcgtgctgcttgtcgtgtcgatcccgatcgccatcgagatcgttgtgacgacgacgcttgcgctgggctcgaaggagctctcggcgaagaaggtgattgtgacgcgcctgtccgcgatcgagatgatggccgcggtgaacatgctgtgctcggacaagacgggcacgctgacgctgaacaagatggagatccagcaggactgcccaatcttcacgcagggcgaggaccgcgagagcgtgctcgtgtactcggcgcttgcggcgaagtggcgcgagcctcctcgtgacgccctcgacaccatggtgctcggcgccgcgaacctgaaccgttgcgacacgtacaagcagctggagtacaagccgttcgacccgcgcgtgaagcgtacggaggcgacgcttgtcagcccggacggcgtcatgttcaaggtg

SEQ ID NO: 41712 - protein, 404 aa, Panicum virgatum
  misc_feature: Ceres CLONE 2008784
  misc_feature (75)..(304): Pfam Name: E1-E2_ATPase Pfam Description: E1-E2 ATPase
  misc_feature (4)..(69): Pfam Name: Cation_ATPase_N Pfam Description: Cation transporter/ATPase, N-terminus
  misc_feature: SWISSPROT Homolog: EC 3.6.3.6 Proton-exporting ATPase
MGGDDFTIAYADNHHGLTSSEAAARLAQFGRNELPEKTTPGWVIFVKCLWGPMPIALWIAVIIEFALQNWPDGAILLAIQFGNATIGWYETTKAGDAVAALKQSLKPRATVYRDGQWQEIDAGIVVPGDKVKLASGSAVPADCTVNDEPGSIVTPQIDVDEAALTGESLPVTMTPKTHMAKMGSTVVRGEVDGTVQYTGTNTVFGKTALLLQAVEADLGNIHYVLVKVMYGLTGLSMLLCIICFIFLMTYHHTTFKSTIQFTVVLLVVSIPIAIEIVVTTTLALGSKELSAKKVIVTRLSAIEMMAAVNMLCSDKTGTLTLNKMEIQQDCPIFTQGEDRESVLVYSALAAKWREPPRDALDTMVLGAANLNRCDTYKQLEYKPFDPRVKRTEATLVSPDGVMFK

SEQ ID NO: 41713 - DNA, 685 bp, Panicum virgatum
  misc_feature: Ceres CLONE 2008784-R
tgtcgctggactcgatccacgactacgagaacagctggtactacaagatgggcctgccgccggcggactacccgcacatcatcacgacgatctacctgaaggtgtccatctccgatttcctgacgctgttcgcggcgcgcacgcagacgaagcccttcttcgcgtacccgccgtccctcatcctcatggttggcgcgacgggctccctcatcttgtcttcgtgcgtcgcggcgttctggccccagtcatcgccggataacgtgctgactgtgggcctggcgcgcctcagcgacgggcagccggacatgccgtcgcaacgcctgatgccgctgtacgtgtggctatactgcgtggtgtggtggttcctgcaggactggatcaaggtgctgtcgtacgtgatcatggacaagttcgacattttcaacttccgcacgttcatggatcccgacatgcccgcggtcgcgccgtcgcaccagcgcagccgcattgacgagcccctgctgaacaagggagctcatcagcgccgtgtgaactagacggcttcaaaaagagacgtttctttccaaaactactaaccttgattcttcagagatacccacccgacgcgcctgtcttcaccccacaagcgtcgaggttcactgcccactaccccgccctcaaacacaatgcgcgtgttctgccctcg

SEQ ID NO: 41714 - DNA, 499 bp, Panicum virgatum
  misc_feature: Ceres CLONE 2008787
  misc_feature: Encodes the peptide sequence at SEQ ID NO. 41715
atccagagccctctctccgaaagagctacatcgatttctcttcacctattccccatatgttggtattttcaagtcaatctttgctgttgtcatcattctcttccttggctctgccgacggattcttcacccagaccccgccctgcacctaaatcgagggcaacctctgctcgcctgccccgctcgccgcactcttcatcaccgcatccatcttgcttgcatccatcacctctttggtcactggattccctggaatgaatcatcaaccacatatgccaatgaccgaaccaccctggaatctaagaaagacgtcgggaaggcattcgtcactgctttcctctctggtgctgttatgggctttttgctcgcctccagcggccgtgtggttctcaacctcatccattaatgtatttcaagttgtactatggctgatgactggtacggtctcttccactctatcactggatatggtctaggtggatcttccatggctctcttca

SEQ ID NO: 41715 - protein, 134 aa, Panicum virgatum
  misc_feature: Ceres CLONE 2008787
  misc_feature: SWISSPROT Homolog: EC 3.6.1.1 Inorganic diphosphatase
IQSPLSERATSISLHLFPICWYFQVNLCCCHHSLPWLCRRILHPDPALHLNRGQPLLACPARRTLHHRIHLACIHHLFGHWIPWNESSTTYANDRTTLESKKDVGKAFVTAFLSGAVMGFLLASSGRVVLNLIH

SEQ ID NO: 41716 - DNA, 724 bp, Panicum virgatum
  misc_feature: Ceres CLONE 2008788
  misc_feature: Encodes the peptide sequence at SEQ ID NO. 41717
agttcgtggaaggttgaagagttggactgcggcggccagagacatgggtgaaagccgagggggtagcggtgcgatgaggcgaagcggcggtgccggccaacctcctccgcctacggcgagcagtggtggcggccggctcgcagtacttgcgtctcacttctccagctcttcgctcggcagcccagccaccatggccggcgagaaggaagccgccctcgccgcggaacccatcgacggccccaccattttcgacaaaattatcaggaaggagatcccatctcaggtggtttatgaggaccaaaaggtccttgcgttcagagacatatcacctcaagctcccacacatattataatcatacccaaggttaaagatggcttatcaaggttgtcaaaggcagaagaaaggcacgtcgaggttctgggaagtcttctatatgctgcgaagactgtagcaaagcaggaagggtttggcgatggcttcaggattgtcatcaacgatgggcccaaaggatgccaatccgtataccaccttcatgttcatcttctcggcggacgacagatgaactggccacctggttgagttgatttggcggtttccacgggaggaattcacttctccaattggcttgcagctctggctttatgttgtatacctccttcgcaaagcatagttcatttgcaatttgtaactgttgtaaaaggagaaaaataaaacagtcatcgg

SEQ ID NO: 41717 - protein, 129 aa, Panicum virgatum
  misc_feature: Ceres CLONE 2008788
  misc_feature (25)..(124): Pfam Name: HIT Pfam Description: HIT domain
  misc_feature: SWISSPROT Homolog: EC 3.6.1.29 Bis(5'-adenosyl)-triphosphatase
MAGEKEAALAAEPIDGPTIFDKIIRKEIPSQVVYEDQKVLAFRDISPQAPTHIIIIPKVKDGLSRLSKAEERHVEVLGSLLYAAKTVAKQEGFGDGFRIVINDGPKGCQSVYHLHVHLLGGRQMNWPPG

SEQ ID NO: 41718 - DNA, 1734 bp, Panicum virgatum
  misc_feature: Ceres CLONE 2008792
  misc_feature: Encodes the peptide sequence at SEQ ID NO. 41719
acgagccggcgacggagtggcctccccgtcccttcatcccgttgtcttcactccaactcctcctctgctgctgctattgcgattgggagggcggtccttgtcgcgagcgacgccgaggctttcgggacggggactgattgattgattgcacgaccccgccagactcggtgccgcctgcgaattactagtgggcagcggcgcgcgctctgctcgtggtcgtggtggtgtagccggtgtgcttgcggtgcggagcctgcggcggcgatggaccaggacctcgtcgagatccacccgcgcgagctccagttcacctttgaggtgaagaaacaaagttcatgtactgtacatctagtcaacaagtccaatgaatttgttgctttcaaggttaaaacaacatctccaaaaagatactgtgttcgaccaaatactggagttatccttcctaggaaaacttgtgaattcacagttaccatgcaagcactccgaactgctccaccagacatgcaattaaaagacaagtttttggtgcagaccacagttgttccttatggtacatctgatgaggaccttattcctgcctttttctccaaagaaactggcaggtacatcgaggaaagtaaattgagagttgtccttgttagtgcatcccattctcttgaagatgaacccattaatggagttcacaacactgagccagctgttgaagttcctgtactgaaagagatgccaaatatagagaacgaagtgccagctgttgcaaaagaagttcctccccctctgaaacaaactccagcaattgcaactgaaataccttcaccagtcaaagagactccaggcttgagagaaattcctgtgccaataaatgaagtaccagttgcattgacagaatctccatccaataaaaaagattcatctgctattgcaattgaacatgcatctactgttgcaaatgaacatgcccctgctattaagattgaatcccctcctttgaaacaaagcactgcagtttttaaggaatctcctccactggagaaaactcctaaggaagctgttatgctaagtgatcggggacttttcaatgtgcagaaccatcaattgtctcatgtaacagaagatgttcagaatctgaagtcaaagctcaacaatcttgaatcaaaattggaagaggctgaaaggatgataataaggctaagagaagagagcagaagtaccacccaggagcgggataagttacagcaagaaatggtatttctaagaaagaagggtgctcccaggagtcaagtgggctttcccttgctgtttgtggtgtacgtggcgcttcttggtacctcattcggttacctgctgcgattatgagttccgtgttcagcagctgggatactcgatgtggcaagagagttgaagggcagtcgcactccaacatcatggagaggagcatttgttagcattattagtgcagatggttttggatataacatcggtggcaaactaaactaccagcttcctgtatgtatagaacagttctttttgcgttgtatagaacccacccaaaagatgactgctgcgctgcctgtagactaacctgggtttattttgcatatgcccaagttttcttccttttttgcagtttgctggattcagttctactgaatgatcacaatatcttgtgttatttaccattcgggttatctttgactcgacattagaggtggtaatggatcattgtcccttcac

SEQ ID NO: 41719 - protein, 363 aa, Panicum virgatum
  misc_feature: Ceres CLONE 2008792
  misc_feature (5)..(112): Pfam Name: Motile_Sperm Pfam Description: MSP (Major sperm protein) domain
MDQDLVEIHPRELQFTFEVKKQSSCTVHLVNKSNEFVAFKVKTTSPKRYCVRPNTGVILPRKTCEFTVTMQALRTAPPDMQLKDKFLVQTTVVPYGTSDEDLIPAFFSKETGRYIEESKLRVVLVSASHSLEDEPINGVHNTEPAVEVPVLKEMPNIENEVPAVAKEVPPPLKQTPAIATEIPSPVKETPGLREIPVPINEVPVALTESPSNKKDSSAIAIEHASTVANEHAPAIKIESPPLKQSTAVFKESPPLEKTPKEAVMLSDRGLFNVQNHQLSHVTEDVQNLKSKLNNLESKLEEAERMIIRLREESRSTTQERDKLQQEMVFLRKKGAPRSQVGFPLLFVVYVALLGTSFGYLLRL

SEQ ID NO: 41720 - DNA, 1775 bp, Panicum virgatum
  misc_feature: Ceres CLONE 2008796
  misc_feature: Encodes the peptide sequence at SEQ ID NO. 41721
aagggcgctactaaccgcaacgggattcctcgaaatctcggcacgaattccccggccccctccaaccgcgcgcgcgcacggtgcccaccggtccttggcggcggcggcgatgacgcagacgcagacgcaggacctggagatggcggggaccgccggggcgtactacccgccgccgcgggccggcgccggcggcgaggacctcgacgacgacggcaggaagaagcgcacgggaacggtctggacagcgagtgcgcacatcatcacggcggtcatcggctctggcgtgctgtctctcgcctggtcgacggcgcagcttggctgggttgttggaccggtgaccctgatgatctttgccttcatcacgtactatacctccagcctccttgccgactgctaccggagtggcgatcaggccacagggaagaggaactacacctacatggatgccgtcgctgcatatctgggccgatggcaagtctggtcctgtggtattttccagtatgtcaatttggttggaaccgcggttgggtacaccattacagcatccatcagcgcggcggctgtgcacaaggccaactgttttcacaagaatggccacgcggccgactgcagccaatacgacaccatgtacatggttgtctttgggattgtgcagatcttcttctcccagctcccaaacttcagcgacttgtcgtggctgtccatcctcgccgccatcatgtccttctcctactcgtccattgccgttggcctctcgttggcacggaccatttcaggtcgtactggtaagactactctgactggcactgaggttggagtagacgttgattcagcccagaaggtctggatggcactccaagctcttggcaacatcgcgttcgcgtactcctactccatgattctcatagaaatccaggacacggtgaagtcccctccggccgagaacaagacaatgaagaaggccaccctgctgggcgtgtcgaccaccacggcgttctacatgctctcaggctgcctcggctacgccgcgttcgggaacgccgcacctggcaacatcttgacggggttcggcttctacgagccctactggctgatcgacttcgccaacgtctgcatcgtggtgcacctggtgggcgcctaccaggtgttctcccagcccatcttcgccgctgtcgagacggcggccgtcgcgcgctggccgaactccaagttcatcacccgcgagcaccccctggtggccggccagttcaacgtcaacatgctcaggctgacctggcggacggtgtttgtggtggtgagtacggtgctcgccatcgtgatgcccttcttcaacgacatcctgggcttcctcggcgccattggcttctggccgctcaccgtgtactacccggtggagatgtacatccggcagcggcggatacagaagtacaccaccaggtgggtggcgctgcagacgctcagcttcctgtgcttcctggtgtcgctcgcctcggcggtcgcgtccatcgagggcgtcaccgagtcgctcaagcactacgtccccttcaagaccaaatcatgatgactgagcttcgccatgtcacaaaggttaggaatggcgtaggaccatgcgatgctcgctcagcggtggacagtaatgtttgttgttgtgcgagagatcagaactggtcagaagccatcccaatagggcgctaaaaaatccgagaggtttcatggcgtcttggatatattgtacattgtacagaagcttaagctgatataagaatttaagagtt

SEQ ID NO: 41721 - protein, 483 aa, Panicum virgatum
  misc_feature: Ceres CLONE 2008796
  misc_feature (39)..(471): Pfam Name: Aa_trans Pfam Description: Transmembrane amino acid transporter protein
MTQTQTQDLEMAGTAGAYYPPPRAGAGGEDLDDDGRKKRTGTVWTASAHIITAVIGSGVLSLAWSTAQLGWVVGPVTLMIFAFITYYTSSLLADCYRSGDQATGKRNYTYMDAVAAYLGRWQVWSCGIFQYVNLVGTAVGYTITASISAAAVHKANCFHKNGHAADCSQYDTMYMVVFGIVQIFFSQLPNFSDLSWLSILAAIMSFSYSSIAVGLSLARTISGRTGKTTLTGTEVGVDVDSAQKVWMALQALGNIAFAYSYSMILIEIQDTVKSPPAENKTMKKATLLGVSTTTAFYMLSGCLGYAAFGNAAPGNILTGFGFYEPYWLIDFANVCIVVHLVGAYQVFSQPIFAAVETAAVARWPNSKFITREHPLVAGQFNVNMLRLTWRTVFVVVSTVLAIVMPFFNDILGFLGAIGFWPLTVYYPVEMYIRQRRIQKYTTRWVALQTLSFLCFLVSLASAVASIEGVTESLKHYVPFKTKS

SEQ ID NO: 41722 - DNA, 663 bp, Panicum virgatum
  misc_feature: Ceres CLONE 2008806
  misc_feature: Encodes the peptide sequence at SEQ ID NO. 41723
gatttgatccatccacccgttcccttccattccctccctctcccgcgtccgccccctcttcgtcgtctcggtgcgggcggcctcgttcccgcgagggttggcgcggagcggagagccgcccgggcgccgagttctagtctgggctcgcctctccctttttgaactgaaacataggattatgaagatggcacatttggtcactcactgtagtttcagtgcatttcgggctgttcagacgttctccatatctcctggatattgctgcgatgttggccgtttacagaactcgaaatcttcaaatctgtccctcaaatcttctctcaagagacaaaagaagtcatatgttacttgtgctagtgctgctgtacaaggacagacacccacacctctaactggtagtcaggaagcttctgggcattcatcctcccagcctaaaaaagtaatggttattggtggagatggatactgtgggtgggcgacagctcttcatctctccaacaaaggttatgaggttgctatagttgataaccttgttcgacgtcttttttatcaccagcttggtcttgagtcccttacccccataacttccatccgaaatcgtgtccgtcgatggaagtctctcactggcaagactatccacctctttattggtgacatatgtga

SEQ ID NO: 41723 - protein, 159 aa, Panicum virgatum
  misc_feature: Ceres CLONE 2008806
  misc_feature: SWISSPROT Homolog: EC 3.13.1.1 UDP-sulfoquinovose synthase
MAHLVTHCSFSAFRAVQTFSISPGYCCDVGRLQNSKSSNLSLKSSLKRQKKSYVTCASAAVQGQTPTPLTGSQEASGHSSSQPKKVMVIGGDGYCGWATALHLSNKGYEVAIVDNLVRRLFYHQLGLESLTPITSIRNRVRRWKSLTGKTIHLFIGDIC

SEQ ID NO: 41724 - DNA, 512 bp, Panicum virgatum
  misc_feature: Ceres CLONE 2008811
  misc_feature: Encodes the peptide sequence at SEQ ID NO. 41725
acacacgcacgcttattataccacaccgactcaggcggtccactccgcgagtcagcacagctcctccccccgcccccccaccccccccaccaacccccccgcgtcgtgaactgggagctagcacagccaacccgcgagcggatcaccagagatggccacggcgacctacctctccttctcggcaccgacgtcgtcgtgcgccgggcggcagcggcggcggcaggcgacgcgggcgtcgccgtcggcgacggaccgaccgcgcgaggtggtgtcgccgaagcggcggctgccactgcggaaggtaccgggcgactacggcccgccggtggtgggcgcgctccgggaccggctcgagtacttctacgggcccggggggcgcgacggcttcttcaccgcccgcgtccgcgcgcacggctccaccgtggtgcggctcaacatgccgccggggcccttcgaggagcgcgacccgcgcgtggtggcgctgctcgacgccgcctccttccgggtgctct

SEQ ID NO: 41725 - protein, 120 aa, Panicum virgatum
  misc_feature: Ceres CLONE 2008811
  misc_feature: SWISSPROT Homolog: EC 4.2.1.92 Hydroperoxide dehydratase
MATATYLSFSAPTSSCAGRQRRRQATRASPSATDRPREVVSPKRRLPLRKVPGDYGPPVVGALRDRLEYFYGPGGRDGFFTARVRAHGSTVVRLNMPPGPFEERDPRVVALLDAASFRVL

SEQ ID NO: 41726 - DNA, 1634 bp, Panicum virgatum
  misc_feature: Ceres CLONE 2008812
  misc_feature: Encodes the peptide sequence at SEQ ID NO. 41727
aatcttacgaggctgctgctgcttgcacgcttgcaacaaaacctccagtccccttttattcattcacaacccggacccatctccctttcccattcaattgcttccctgcgactcaaactgctgctctctgttaatcgaccgaaccattcttgtttcttcgtccgactcgatcaacgaacactgctttgtctgtacagacacgccccccccttcccctctagcttgtctcgaacatcaatcgccttgcttcattcgtcatctctcccaccgccgaaaccccattatttggtttcccacttccccatcccttcgcttcccaaactccactccaccgccctgcgtgcgcactttcggattgctagtggtctacaaagcgcgataaggggaagacgagtttggctgcaagccgtcttttcctaaggcggacgacgaaaccaagtcatatcaaacgcccgactcccttctaggagctccgttttcgaaaatggtcctcggaactatcaagtgcgtggtcgtcggtgacggtgctgtcggcaagacatgtcttctcatcagctacacgacgaacaagttcccctcggaatatgtgcccacagtcttcgacaactacgccgtcacggttatgatcggtgacgagccgtacacgctggggctattcgatacggccggacaagaagattacgaccgcctgcgccctctctcatacccccagactgacgtcttcctcgtctgcttcagcgtcacgtcaccagcgtctttcgagaacgtccgcgagaagtggttccccgaggtacaccaccactgcccaggcgtgccgtgcctgatcgtcggcacccaggtggatctgcgggacgacacccaggtggtgcagaagctgaataagcagaagatggcgccggtgaagaaagaggatggcgaacggatggcgagggacttgggcgctgttaaatacgtcgagtgcagcgcgctcacgcagttcaagctcaaggatgtgtttgatgaggctattgttgctgcgcttgaaccgccgccgccgaagaacaacaggaccagcaaacacaaatgccagattctctgatacgggcttggagcatatggcgtgatggccagtcagacttgattcaactggcgtgggggccagcccatcaggaaacaaagaatctggacagctatatacccaggtcaatacgaccagccgtcaccccgcggcttgaaagttgtctcgagcgggcgcacaacaattggacagcaacccccaaacaccctctatccggggaaaagagggatttgagagcaaaacccgggcaaatagccagggttgtttcctcctggaactgccttaattcgccttgggccacgaacgacgcccaattggaaaacaagggctgggtttatttactatcaaaaagggtggcctggagttgatcattgttaattttgttctcgagagacatcaaccccagccacccagcttcttggtaccgaccctccctggcttggtagcgggtattttttccttccttcttgattctatctctcgtcaatggggggcaagttcataaaccgaggcaggaaactttccattttgataggacagtatggcgatcggtgtgcaattgaatcaagatcctcct

SEQ ID NO: 41727 - protein, 197 aa, Panicum virgatum
  misc_feature: Ceres CLONE 2008812
  misc_feature (7)..(180): Pfam Name: Ras Pfam Description: Ras family
  misc_feature (7)..(120): Pfam Name: Miro Pfam Description: Miro-like protein
  misc_feature: Functional homolog of the protein sequence given in SEQ ID NO 50617
  misc_feature: Useful for making plants with modulated nitrogen use efficiency
MVLGTIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDTQVVQKLNKQKMAPVKKEDGERMARDLGAVKYVECSALTQFKLKDVFDEAIVAALEPPPPKNNRTSKHKCQIL

SEQ ID NO: 41728 - DNA, 722 bp, Panicum virgatum
  misc_feature: Ceres CLONE 2008820
  misc_feature: Encodes the peptide sequence at SEQ ID NO. 41729
atcacaaccgacctccgatccacttctgctcaccagacactgctaagctagctagctgctttacacttcactcactagtcactagcagcttgatcattcgacgatcagtgagtgttatcacatatcagtcgtagctgcaatattatatatagaattttatatatggctcgcctctccgccgttgtcgccgtcgtcctggtggctgcgctggtggcggccgagaccgcttcggctgcggtgagctgcagccaggtgacgtcggccgtggcgccgtgcctagggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatcccaagcaagtgcggcgtcaacgtcggcgtgccaatcagcccaaacgtcgactgcgccaagattaactgagacgaaggatgatggatgctcagctctctatcgtctttgggtatatgatgtcggccaacaagagcagagagcagtcgtttaatttactacctcttccttttacatttgtacaacaccacgcaccacctgtgtacgtcgtcgtctatgtacaacaataatcctctctctgcttatgtgtttgctgggtctctgttttcatgtactac

SEQ ID NO: 41729 - protein, 117 aa, Panicum virgatum; identical to SEQ ID NO: 12304
  misc_feature: Ceres CLONE 2008820
  misc_feature (28)..(113): Pfam Name: Tryp_alpha_amyl Pfam Description: Protease inhibitor/seed storage/LTP family

SEQ ID NO: 41730 - DNA, 692 bp, Panicum virgatum
  misc_feature: Ceres CLONE 2008823
  misc_feature: Encodes the peptide sequence at SEQ ID NO. 41731
gcgctgcgcctccgggcggccgccaacgcccgcctcgcgcgccgtcgccgaccggggcctcgtcgccatcgccatcgccgccgtcaagttgctgccgggagtctccagctacatcgcggcggagaagaagaaggttgttgacaagatgcaatctggtgggacatcgtccaagaacaaccggcgaactgagttgccgacaattggccttggtgaggaagtgataaaggatcttgaaacattgaaagccaaagatgtagactggcagggaaagtgctctggcacagtatatatcgctggaagtgagtctgagggccatttcgaattgataaacaaagcttactctatgttttcacacaccaatccgctgcatcaagatgtattcaagagtgtggcacacatggaagctgaagtagttgcaatgacagctgctttgcttggcagcaaagaaaaatcatccggtggacaaatttgcggcaacatgacatctggtggaactgaaagcatattattagcagtcaaaacatcgcgcgactatatgcgatcaaagaaaggaattacaaagcctgaaatgataattgctgaatcagcacattctgcatatgacaaggctgctgaatatttcaatattaaagtgcgccgtgtgcctgtgaacaaagagtttcttgcagatgtgaaaggattcaggcgatgca

SEQ ID NO: 41731 - protein, 230 aa, Panicum virgatum
  misc_feature: Ceres CLONE 2008823
  misc_feature: SWISSPROT Homolog: EC 4.1.2.27 Sphinganine-1-phosphate aldolase
RCASGRPPTPASRAVADRGLVAIAIAAVKLLPGVSSYIAAEKKKVVDKMQSGGTSSKNNRRTELPTIGLGEEVIKDLETLKAKDVDWQGKCSGTVYIAGSESEGHFELINKAYSMFSHTNPLHQDVFKSVAHMEAEVVAMTAALLGSKEKSSGGQICGNMTSGGTESILLAVKTSRDYMRSKKGITKPEMIIAESAHSAYDKAAEYFNIKVRRVPVNKEFLADVKGFRRC

SEQ ID NO: 41732 - DNA, 606 bp, Panicum virgatum
  misc_feature: Ceres CLONE 2008825-R
  misc_feature: Encodes the peptide sequence at SEQ ID NO. 41733
cgaaggctgggctcaaggcccctcccaacctttatttgatgatggcaacgttgctagctcgtagcaaccgttatgctgaaatagcattgtttgtatcaaacaagatcctagagccgtccaaggaactggcaatgcagctcatggaactgggtcagcagcaccctccaacaaggaagctgggcctggacatgctaagggaacggagcctgcaccacgactacgtcgctgcacttctgcaagacgggtactatctggaggccctacgctacgccagaaaatacaaggttattaccgtgcagcccgctctgtttctggagaaagccgtggcgagcaacagcgcccagaacctggccgcggtgctgagcttcttctgtgagttcacgccgagtttcaagactacgtcggactttggcagataccggcacattctgtccgaaatggtttgagcggctgtgtttgtaaaatcttcgcctaaattactttagcacgttctatagaatagttaacattgctggggagatatgacgttctctcgggtgatatttttagcagctcttgtagaaataaataaatagattgattgattgaaaatgttgctaaatgatt

SEQ ID NO: 41733 - protein, 147 aa, Panicum virgatum
  misc_feature: Ceres CLONE 2008825-R
  misc_feature (1)..(134): Pfam Name: Mic1 Pfam Description: Colon cancer-associated protein Mic1-like
KAGLKAPPNLYLMMATLLARSNRYAEIALFVSNKILEPSKELAMQLMELGQQHPPTRKLGLDMLRERSLHHDYVAALLQDGYYLEALRYARKYKVITVQPALFLEKAVASNSAQNLAAVLSFFCEFTPSFKTTSDFGRYRHILSEMV

SEQ ID NO: 41734 - DNA, 1411 bp, Panicum virgatum
  misc_feature: Ceres CLONE 2008825
agcccagcctagcgcaagcttcttcgcccatcccctccccggagaccgggcaggacggcaaggtaaaagcggcgaacgccggaccggcacgggctctcgccccaccaccaccgaaccctcgatcgcatccaacccttcggccactgctcagcacgaactccggcgccgaaagacccttgactttcgctgctcttctcgggaggctcttctgcggtgaggtctgtgttgggcatggtggcctgagtacccagctagggctcggatgaaggagcggaagccggcggcatcctcccccgctctcgcccggatcctcgcatcctgcgtgtcccaggcaaaagattatgggagatgcatagctgcaaaggtccctgagattgaacataatatgtgttctaaggagtttctagcgctcagagcatgcatgaagaacgtggttaagaacaaagcttgaggttaagaacaaatctcttttggtgtgattactgtggatttcagtcatcttgaaaagtggaaactcatttgcttggttgaacaagcagtctatcacagtcacttgaggagacaaagaatgctaggcaatcagatgcaaggtggtttgggcactcctggggcgctgtctcatgcttatgtccaacatcctccactgcgatgtgatataccagacatccggggtctgttctatgatgatgcgaataagttccttatagctccaacagctgataggattctgtactggaaaatagctccatttattccatctggacctccaaattccgatccaattaatgaaggacctgtcttgtcagttagatattccctggatcacaaagtcatcggaattcaacgttccagacatgaaattgagtttagaagtagagaaacaggggtgacctgtagcaaaaagtgcagagctgattccgaaactattcttggctttttctggacagattgccccacatgtgatgtcatacttgttaaaacaagtggcctagatctgctttcctacgagcctcagtcccatgcttttcgcttggtagaatcaaagaaattcaatgtgagctggtatctttacacacatgaaagtaggctgattcttcttgcttctggaatgcaatgcacgatgtttactggttatcagttttctgctggtgggattgtcaaaataccgaagtttgagatgatgatgtctaaaactgaagcaaacaacaagcctgttctagctgcagatgatgttcacattgtaacagtctatggtaggatttactgcttgcagcttgaccgagttagtacttcattgaatttatatcgtttttaccgtgatgctgttgtacagcagtgtactctgcctacttactcaagcagaattgcagttagtgcggttgacaacataattatggttcatcaaatagat

SEQ ID NO: 41735 - DNA, 679 bp, Panicum virgatum
  misc_feature: Ceres CLONE 2008856
  misc_feature: Encodes the peptide sequence at SEQ ID NO. 41736
aaagacgtcatccgtcttcacactactatctctcttcctcctcgttgcgccttcctccccgctttccctgcgaaaccaccaccaccccaacccatcatcccctttcccttctccaagcgccccgatccggccgacaaggattttcatgacagcagattggggagaccgtttgtgaaagcttatgaacaagaaagttatggaaaggaggatgtactttctgctgttgagaaatgcatgaaaaagtatgctgataatttgctacgatctcttgagggaatcactagtcggctttcgcaactggagatctattgctataagcttgagcgatccataggtgaacttcgaagtgatgtgcttcgtgatgagactgatcatagattgaagtctcttgagaagcatctacatgaagtgcacaggtctgtccaaattcttagggacaaacaggagttagctgaagctcagaaggaactggccaaattccaacttacacaagatacatctaaaaggaaggaagatgtaccaacatctattcctgagccaaagaaacttgaagaaaagcctgatacatcaggccagcaattggcccttgttttgcctcatcaggtgaacccgccatcacttgtacctagagccactgaatcagtcccacagtacaaggatcaacctgtgcagcaagcaa

SEQ ID NO: 41736 - protein, 226 aa, Panicum virgatum
  misc_feature: Ceres CLONE 2008856
  misc_feature: SWISSPROT Homolog: EC 3.6.3.14 H(+)-transporting two-sector ATPase
  misc_feature: Functional homolog of the protein sequence given in SEQ ID NO 50774
  misc_feature: Useful for making plants with altered carbohydrate content
KDVIRLHTTISLPPRCAFLPAFPAKPPPPQPIIPFPFSKRPDPADKDFHDSRLGRPFVKAYEQESYGKEDVLSAVEKCMKKYADNLLRSLEGITSRLSQLEIYCYKLERSIGELRSDVLRDETDHRLKSLEKHLHEVHRSVQILRDKQELAEAQKELAKFQLTQDTSKRKEDVPTSIPEPKKLEEKPDTSGQQLALVLPHQVNPPSLVPRATESVPQYKDQPVQQA

SEQ ID NO: 41737 - DNA, 733 bp, Panicum virgatum
  misc_feature: Ceres CLONE 2008858
  misc_feature: Encodes the peptide sequence at SEQ ID NO. 41738
taaagattgctgtggacgtggtcaatgagggtcttgttgatcgccgttcagccattaagatggtagagccaggccacctggaccagcttctccatcctcagtttgagaacatagcagcatacaaggatcaagtaatcgctacaggattgccagcttcacctggggctgctgtgggccagattgtatttactgctgaggacgctgaagcatggcatgcccaagggaaaccttgtattctggtgaggacagagaccagcccagaggatgttggtggcatgcacgcagcagttggaattcttacagcaaggggtggcatgacctctcatgcagctgtggtagcccgtggctggggaaaatgctgtgtctcgggatgctcaagcgttcgcgtaaatgatgccgagaagtctgtagcgattggagacaaggtgctgaatgaaggcgattggctatcactgaatggatcaactggtgaagtgatccttgggaagcagccacttgccccaccagccctcagtggtgatttggaaaccttcatgtcctgggtagatgaagttaggcaactgaaggttatggctaatgcggacactcctgaggatgcactggcagcacgaaacaatggagcgcaaggaattggactatgccggacggagcacatgttctttgcttcggatgagaggatcaaggctgtgaggcagatgattatggctcccacacttgaactgaggcagaaggc

SEQ ID NO: 41738 - protein, 243 aa, Panicum virgatum
  misc_feature: Ceres CLONE 2008858
  misc_feature (66)..(156): Pfam Name: PEP-utilizers Pfam Description: PEP-utilising enzyme, mobile domain
  misc_feature: SWISSPROT Homolog: EC 2.7.9.1 Pyruvate, phosphate dikinase
KIAVDVVNEGLVDRRSAIKMVEPGHLDQLLHPQFENIAAYKDQVIATGLPASPGAAVGQIVFTAEDAEAWHAQGKPCILVRTETSPEDVGGMHAAVGILTARGGMTSHAAVVARGWGKCCVSGCSSVRVNDAEKSVAIGDKVLNEGDWLSLNGSTGEVILGKQPLAPPALSGDLETFMSWVDEVRQLKVMANADTPEDALAARNNGAQGIGLCRTEHMFFASDERIKAVRQMIMAPTLELRQK

SEQ ID NO: 41739 - DNA, 720 bp, Panicum virgatum
  misc_feature: Ceres CLONE 2008862
  misc_feature: Encodes the peptide sequence at SEQ ID NO. 41740
aggtacgcctgatcccgccgccgtttcctctggcgctcccgctcgacgagcctacatgggcgtagcaccagcggcgggcggtttcgtcttagccttggcttcttccagttccagcttccgctgctgctccatctagctgcctctacgcgctcgcttccagtggcgggagcgcccaatggacgaggagatcggcggcgccgcgcggcaggctcagtggaaaaattactgcaaaactctctccctgctagcgttccagagcttaggtgtggtgtatggagacttgagtacgtcgcctttgtacgtctatagaaactcattgtccggaagactgaacgcctacattgacgagacaaccatctttgggttgttttctctgatattttggacttttacactggttccgctgctgaagtacgtcataattgtattgagtgcggatgataatggggagggtggaccatttgctttgtactcacttctttgcaggcatgcaaaattcagtttgctgccaaaccagcaagcggcagatgaagagctgtcaacatattatcagccagacactgatcgcactgcggtgtcctctccattcaaaaggtttctagagaagcacaggaagctgcggacctgtttacttctttttgttctgtttagtgcatgcatggtgataggtgatggtgtacttacaccaactatatctgttttgtcagccatctctggatt

SEQ ID NO: 41740 - protein, 181 aa, Panicum virgatum
  misc_feature: Ceres CLONE 2008862
  misc_feature (23)..(181): Pfam Name: K_trans Pfam Description: K+ potassium transporter
  misc_feature: Functional homolog of the protein sequence given in SEQ ID NO 50430
  misc_feature: Useful for making plants with modulated biomass
MDEEIGGAARQAQWKNYCKTLSLLAFQSLGVVYGDLSTSPLYVYRNSLSGRLNAYIDETTIFGLFSLIFWTFTLVPLLKYVIIVLSADDNGEGGPFALYSLLCRHAKFSLLPNQQAADEELSTYYQPDTDRTAVSSPFKRFLEKHRKLRTCLLLFVLFSACMVIGDGVLTPTISVLSAISG

SEQ ID NO: 41741 - DNA, 711 bp, Panicum virgatum
  misc_feature: Ceres CLONE 2008863
  misc_feature: Encodes the peptide sequence at SEQ ID NO. 41742
aaatccctcgtcttcttcctcctcgcttcccctctccacctcctccccactccccctcccccgcctaatccccaatccggaacctcaccgccgagaaccccagatcaaacccctccccccgcccattcacattcccattcctctcgcgcgatccagccttcttccctgtccgccggagggaggacaagaaatcgggccaggaatctcaccagccaccggggggtttcttgatccgggcgcgggattggtcgcgcccaggacccggagcaaggcgaatcaagaacgccccgcgggtgccagggccggggagcaatcaagatcgtttttttcccttcttcaccttctcttgagggctgtcggttctgttcccctccccgcctgagcaaccccgccggcagccgcggctcccgatgctcgtctggtccacgggggcgggagagggagcagcggccgtgcgcgtgggcggccgccagcgaggatgcagatccgcctgtcgccgagcatgaggagcatcaccatctccactagccatggcctgctagactttatgaggctcaaggccgccgcgcggcacttctcctaccgcaccgtcttccacaccatcctcatcctcgccttcctcctgcccttcgtcttcatactcaccgctgtcatgacgctcgagggcttcaacaagtgctcctccctagattgtctgggaagacggttagg

SEQ ID NO: 41742 - protein, 77 aa, Panicum virgatum
  misc_feature: Ceres CLONE 2008863
  misc_feature: Functional homolog of the protein sequence given in SEQ ID NO 51640
  misc_feature: Useful for making plants with altered cell wall content and/or composition
MQIRLSPSMRSITISTSHGLLDFMRLKAAARHFSYRTVFHTILILAFLLPFVFILTAVMTLEGFNKCSSLDCLGRRL

SEQ ID NO: 41743 - DNA, 702 bp, Panicum virgatum
  misc_feature: Ceres CLONE 2008867
  misc_feature: Encodes the peptide sequence at SEQ ID NO. 41744
acagagcaaactcgatctgtcgtctctgatctccccaccattgtcgcctagctgccatgccaacaatggacatgctccacgtcttgctcctcctatcctcaatctacgtgtcctcgtcgtcggtgtttacaccggtggcggtggcggccacggatgcggaggcgctcctccggttcaaggcctccatccagaaagaccctgcaggagccctctcatcttggcagcagagcgggagcggcggcccatgcagctggcgcggcgtgggctgtgatgacgagggcgacgacgggagggtgacgcggctcaacctcgccggcagcggccttgtggccgagcgcgcgtcgctcgccgcgctgtccgcgatggacacgctccagcacctcaacctgtccggcaacggcgcgctccgcgccgacgccgccgacctgctccgccttccccacgcgctgcggacgctggacttctcctacggcggcctcggcggcgtcctcccgggggacctgctcgcgggctacccgaacctcaccgacgcccgcctggcgcggaacaacctcaccggcgtgttcccggagtcgcttctcgccggcgcgccgagcatccagtcgttcgacgtgtcgggcaacaacctgtccggcgacatctccaggatgtccttcgccgagacgctgacgctgctcgacctgtccgagaaccgcttcggcg

SEQ ID NO: 41744 - protein, 212 aa, Panicum virgatum
  misc_feature: Ceres CLONE 2008867
  misc_feature (27)..(69): Pfam Name: LRRNT_2 Pfam Description: Leucine rich repeat N-terminal domain
  misc_feature: SWISSPROT Homolog: EC 2.7.11.1 Non-specific serine/threonine protein kinase
MDMLHVLLLLSSIYVSSSSVFTPVAVAATDAEALLRFKASIQKDPAGALSSWQQSGSGGPCSWRGVGCDDEGDDGRVTRLNLAGSGLVAERASLAALSAMDTLQHLNLSGNGALRADAADLLRLPHALRTLDFSYGGLGGVLPGDLLAGYPNLTDARLARNNLTGVFPESLLAGAPSIQSFDVSGNNLSGDISRMSFAETLTLLDLSENRFG

SEQ ID NO: 41745 - DNA, 671 bp, Panicum virgatum
  misc_feature: Ceres CLONE 2008867-R
  misc_feature: Encodes the peptide sequence at SEQ ID NO. 41746
cgtgctcctcgacgccgacatggaggcccgcgtcgccgacttcggcatggcgcgcctcatcagcgcgctggacacacacctcagcgtgagcacgctggcggggacgccgggctacgtgccgcccgagtactaccagagcttccggtgcaccgccaagggcgacgtctactcgctcggcgtcgttctcctggagctcctcacggggaggaggcccacggacaaggaggacttcggggacaccaacctcgtcggctgggtcaagatgaaggtcagggagggcgccggcaaggaggtcgtcgacccggagctcgtgctcgccgccgcggacggcgaggagagggagatggcgaggttcctggagctggcgctgcagtgcgtggacgacttcccgtccaagcgccccaacatgctgcaggtggttgccatgctcagggagctcgacgacgcgcagccgccgactactgaaccagcagcaccgcccgctgcttgcgacacaccagaggacggatgatggttacgacgcatgtagctgtacgttcctgcttcttgccactgccacaccagaggacggagttgacgagtggtacccatgtggatgtagaatgctctcttctctgtacattgctttgcttctctgtactgtattgatgatggactgatttttgaggtgg

SEQ ID NO: 41746 - protein, 169 aa, Panicum virgatum
  misc_feature: Ceres CLONE 2008867-R
  misc_feature: SWISSPROT Homolog: EC 2.7.11.1 Non-specific serine/threonine protein kinase
  misc_feature: The sequence is a functional homolog of SEQ ID NO 2 in US patent 7135625
VLLDADMEARVADFGMARLISALDTHLSVSTLAGTPGYVPPEYYQSFRCTAKGDVYSLGVVLLELLTGRRPTDKEDFGDTNLVGWVKMKVREGAGKEVVDPELVLAAADGEEREMARFLELALQCVDDFPSKRPNMLQVVAMLRELDDAQPPTTEPAAPPAACDTPEDG

SEQ ID NO: 41747 - DNA, 647 bp, Panicum virgatum
  misc_feature: Ceres CLONE 2008873
  misc_feature: Encodes the peptide sequence at SEQ ID NO. 41748
acgtgttttttgtgttggaaatgaatcgtgttgctacgctccctttcagaaacccagttcgccttggaaaattagatccaaaacacacagccttcttctgttgtgatatccaagaaagattcagaactgtaatccacgtcatgcctccagtcataaaggttgcctcactcatgtccaaagtctcaaaacaactcgaaattccccttattgtcacagaacaatacccaaaagcaatgggcaacacagtgcctgaaatcgatgtttcacatgcgaaagtttttccaaaaactttattttcaatggttatccctcctgttgctgacatcatcaaagatcctgagatccattctgtcgtcctttatggaatcgaggcccatgtttgtgtctttcaaacaacattagatttgttagaaagaggaattgatgtccacatcctcgctgatggaacaagcagcatgagacaatttgaccgcttaacagccttcaaccgtctccgggatgttggtgcttttgtcacaacttcacaaagtgttttatttcagttgtgctcagattcaacacatcctcatttcaaaacgatttctggccatatcaaagaactcgctgccgaaaacttggactacgatctctcccgcttatgaaccatc

SEQ ID NO: 41748 - protein, 212 aa, Panicum virgatum
  misc_feature: Ceres CLONE 2008873
  misc_feature (24)..(179): Pfam Name: Isochorismatase Pfam Description: Isochorismatase family
VFFVLEMNRVATLPFRNPVRLGKLDPKHTAFFCCDIQERFRTVIHVMPPVIKVASLMSKVSKQLEIPLIVTEQYPKAMGNTVPEIDVSHAKVFPKTLFSMVIPPVADIIKDPEIHSVVLYGIEAHVCVFQTTLDLLERGIDVHILADGTSSMRQFDRLTAFNRLRDVGAFVTTSQSVLFQLCSDSTHPHFKTISGHIKELAAENLDYDLSRL

SEQ ID NO: 41749 - DNA, 728 bp, Panicum virgatum
  misc_feature: Ceres CLONE 2008905
  misc_feature: Encodes the peptide sequence at SEQ ID NO. 41750
agcaaccaaggcacgcctgcactcgcaactcctcatcgtcttcgagactgcgtgtcctgctggttcgtgttgtgttcgtgcttcgccgctagctaccggccatggcgacgccgctctccgttccttccttgatcatggaggaggaagggcggttcgaggcggaggtggcggaggtggagtcgtggtggggcacggagcggttccgcctcaccaagcgcccctacggcgcccgcgacgtggtcctcctccgcggcacgctccggcagagctacgcctccggggagatggcccggaagctgtggcgcacgctccgggcgcaccaggccgccggcaccgcctcccgcaccttcggcgcgctcgaccccgtccaggtcaccatgatggccaagcacctcgacaccatctacgtctccggctggcagtgctcctccacccacacctccaccaacgagccgggcccggacctcgccaactacccctacgacaccgtgcccaacaaggtggagcacctcttcttcgcccagctctaccacgaccgcaagcagcgcgaggcgcgcatgtcgctgccccgcgccgaccgcgcccgcgcgccctacatcgactacctcaagcccatcatcgccgacggcgacaccggcttcggcggcgccaccgccaccgtcaagctctgcaagctcttcgtcgagcgcggggccgccggggtccacctcgaggaccagtcttcgggt

SEQ ID NO: 41750 - protein, 208 aa, Panicum virgatum
  misc_feature: Ceres CLONE 2008905
  misc_feature (21)..(208): Pfam Name: ICL Pfam Description: Isocitrate lyase family
  misc_feature: SWISSPROT Homolog: EC 4.1.3.1 Isocitrate lyase
MATPLSVPSLIMEEEGRFEAEVAEVESWWGTERFRLTKRPYGARDVVLLRGTLRQSYASGEMARKLWRTLRAHQAAGTASRTFGALDPVQVTMMAKHLDTIYVSGWQCSSTHTSTNEPGPDLANYPYDTVPNKVEHLFFAQLYHDRKQREARMSLPRADRARAPYIDYLKPIIADGDTGFGGATATVKLCKLFVERGAAGVHLEDQSS

SEQ ID NO: 41751 - DNA, 1096 bp, Panicum virgatum
  misc_feature: Ceres CLONE 2008914
  misc_feature: Encodes the peptide sequence at SEQ ID NO. 41752
agagcggtgcgtcttccccgcttccttcgtctcatctcaaatctcgagtcaaaaaaaaaaaaaaccaaaacccccacgcgcactccgccgcctcagtcctgtgtcctgtcctccctccgagcctccgccgcagccttcgtcgtcgcgcgagcgagcggccgagccagcggacccaggaagggaggaggccatggcggggggcggggacaaggtggactacgtcttcaaggtggtgctcatcggcgactccgcagtcggcaagtcgcagatcctggcccgcttcgcccgcaacgagttcagcctcgactccaaggccaccatcggggtcgagttccagacgcggacgctcgtcatcgagcacaagtccgtcaaggcgcagatctgggacaccgccggccaggagaggtatagagctgtcacaagcgcgtactacagaggtgctctaggagctttgctagtctatgatatcaccaaacgccagagcttcgaccacattcctcgttggctggatgagctccgtggccatgctgacaagaacattgtcatcatgctggttggcaacaagagtgacctcgaggaggagcgtgctgtgagcaccgaggatgccaaggagtttgccgagaaggagaacctcttcttcctggagacctccgcgctgcaggccaccaatgtcgagaactcctttcagactgtcttgacagagatcttcaagattcacagcaagaagaacatggcggtggaccccaaggccaacggtgctgccccgtcactggcagggaagaaggtcctcgtcccaggccccgcccaggagattcccaagagcaagtgctgcagttccatgtgatgtcttgcccggatttcattgggtttgtgtgcattgaaaatattcatgtgatgtttctggatgtacatctcgactggaataggcttagatttgaattactggttattttgatgtgcggatggaatgagtcgatatcatagtttagatttgtcactcgtctctatggtgacacgaggatagggagtggggagaaaagctctttttgcatagacttgtggaattaattacaaatagcaatgcacgctgattgtt

SEQ ID NO: 41752 - protein, 217 aa, Panicum virgatum
  misc_feature: Ceres CLONE 2008914
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MAGGGDKVDYVFKVVLIGDSAVGKSQILARFARNEFSLDSKATIGVEFQTRTLVIEHKSVKAQIWDTAGQERYRAVTSAYYRGALGALLVYDITKRQSFDHIPRWLDELRGHADKNIVIMLVGNKSDLEEERAVSTEDAKEFAEKENLFFLETSALQATNVENSFQTVLTEIFKIHSKKNMAVDPKANGAAPSLAGKKVLVPGPAQEIPKSKCCSSM

SEQ ID NO: 41753 - DNA, 752 bp, Panicum virgatum
  misc_feature: Ceres CLONE 2008931
  misc_feature: Encodes the peptide sequence at SEQ ID NO. 41754
agaggaggcagtgacggtcgggtccggcgggcacgtcgcgggtgatccggccggcggcgccatgagcagggagcaccagcagccgccgcggcggttcatcgccatccccttctcctccggctgccgctcccactccagcgtcgacgtcgtcgacacctcgcgccacgccggcaagaagccccacccgcaagggattgagttcggggtggtgccaggcggcgcgtcggcgaggccgacggcggcggcagcggcgggcaagggggaatcgctggtggcgcggctcctccgcgggttcaagaacctgtcccagatcttcgcggtgtacgacgaggacgacgaggaggaggaggagcgggagatggtgatcgggctccccacggacgtgaagcacgtcgcgcacatcggctgggacggcagcaccagcaccaccaccagcctccgctcctggaaccgcgccgcgccgcctccgccaccggcatcctcctcgtcgtcgtccgcgtccgcgtccgcgtccacctccgccgccgcgccgcctcagcagcagcaccagccgccggagcagtacccgctgcccctcccggcgctcgacatgcggcagttcgagctcgccatggccgcccaggccgccgccacgagcgccggcaccagcggcccccaccggcatcacagctagcgtcgagccaagggaggagttgggacaccctttggctcgtcagtcgtcacagggcgtcgtccgtttctgccgtccacct

SEQ ID NO: 41754 - protein, 203 aa, Panicum virgatum
  misc_feature: Ceres CLONE 2008931
  misc_feature (101)..(163): Pfam Name: PBD Pfam Description: P21-Rho-binding domain
MSREHQQPPRRFIAIPFSSGCRSHSSVDVVDTSRHAGKKPHPQGIEFGVVPGGASARPTAAAAAGKGESLVARLLRGFKNLSQIFAVYDEDDEEEEEREMVIGLPTDVKHVAHIGWDGSTSTTTSLRSWNRAAPPPPPASSSSSSASASASTSAAAPPQQQHQPPEQYPLPLPALDMRQFELAMAAQAAATSAGTSGPHRHHS

SEQ ID NO: 41755 - DNA, 669 bp, Panicum virgatum
  misc_feature: Ceres CLONE 2008933
  misc_feature: Encodes the peptide sequence at SEQ ID NO. 41756
acgaagccagcgaaaatccagtagagagagagaggggcagaggggacaggggagggaggcagccggcagccattactcccaccagccagcaccaccaccgccgctgctggggtcgcctgcagcaagtacaggcggatatccgcttccattactgtgtctcgcggcggcggaccagcggcggggcagagggttcgcttcggcggccgcaataaattccgccctccccccatggcacggagggccgcctccttgctcgtctcccgctgcctcctcgccagcagggccgcctcggcaggtgccgcgcccgctgtcccctccgcgctccgcaggccagataggacgcgcggactgttgccaggggtccttcaaaggttcagcactgcagcagcagcagaagagcccatctcgcccccagtccaagtgaactacacaaagctcctcatcaatggcaactttgttgattccgcatccggcaagaccttcccaacactggaccctcgtacaggggagttaattgctcatgtggctgaaggtgacgcggaggatgttaaccgtgccgtcgctgcagcacgcaaggcttttgatgaggggccgtggccgaagatgactgcatatgagaggtcccttatcctgctacggtttgctgatttgatcgagaagcacaatgac

SEQ ID NO: 41756 - protein, 146 aa, Panicum virgatum
  misc_feature: Ceres CLONE 2008933
  misc_feature: SWISSPROT Homolog: EC 1.2.1.3 Aldehyde dehydrogenase (NAD(+))
MARRAASLLVSRCLLASRAASAGAAPAVPSALRRPDRTRGLLPGVLQRFSTAAAAEEPISPPVQVNYTKLLINGNFVDSASGKTFPTLDPRTGELIAHVAEGDAEDVNRAVAAARKAFDEGPWPKMTAYERSLILLRFADLIEKHN

SEQ ID NO: 41757 - DNA, 1384 bp, Panicum virgatum
  misc_feature: Ceres CLONE 2008939
  misc_feature: Encodes the peptide sequence at SEQ ID NO. 41758
gagctgagtggtggaggactggacgtggaggtggaggtggagggatcgttatgctcggctgtcgctaacgacagctcctcaggtctatatataggtcgttcgtcgtgatcagaaccacacaggcaagatggcgagcttgcacaagatcacacttgttctcatgttctgcctggtagccctgggaagagcagagtacctcaaatacaaggattccaagcagcctgttgctgttcgtgtcaaggatctgcttagccggatgactcttgctgagaagattggccagatgacccaaattgagaggaaaaatgccacggccgatgcattggctaaatacttcataggcagtgtactgagtggtggaggcagtgtgcctggtcctcaagcatctgctcaggcttgggcctccatggtgactgagatgcaaaagggtgctctttccacccgtcttggcattccgatcatctacggtattgatgccgtgcatggtcacaacaatgtctacaaagctactatcttcccccacaacgttgggcttggagctacaagggaccctgatcttgtcaagagaataggagaagcaacagctcttgaagttagagctacaggaattccttatgtctttgctccctgtattgcggtttgtagagatccaagatggggacgttgctatgagagctacagtgaggacccaaaggttgtccaatcaatgacctcactcatctctggtttgcaaggcgaagttccggcgaatgacgtgggaagaccatatgttgctggaagtaagaatgttgctgcttgtgcaaagcactatgttggtgatggtggcacgtatatgggaatcaatgagaacaacacaatcatcaacacacatggactgctgagcatccatatgcctccttactataattctattatccgaggcgtctccactgtcatggtctcgtactcaagctggaacgggaagaaaatgcacgcaaaccatttcctagtcactgattttctcaagaacaagctcaagtttaggggttttgtgatttccgactgggaaggcattgaccgcatcactagtcctcctcacgctaactattcttactccattgaggccggaattggtgctggtattgacatgatcatggttccatataaatacacagaattcattgacgatctcacaacacaagttcagaacaaggtcatccccattagcagaatcgacgacgctgtttacagaattctccgagtcaagttcagcatgggtctatttgagaacccttaccctgatcccagccttgccggtgaactcgggaagcaagaacaccgggacttggcacgtgaagcggtcaggaaatccctggtgcttctgaaaaacggaaagtcctcgtac

SEQ ID NO: 41758 - protein, 418 aa, Panicum virgatum
  misc_feature: Ceres CLONE 2008939
  misc_feature (101)..(337): Pfam Name: Glyco_hydro_3 Pfam Description: Glycosyl hydrolase family 3 N terminal domain
  misc_feature: SWISSPROT Homolog: EC 3.2.1.21 Beta-glucosidase
MASLHKITLVLMFCLVALGRAEYLKYKDSKQPVAVRVKDLLSRMTLAEKIGQMTQIERKNATADALAKYFIGSVLSGGGSVPGPQASAQAWASMVTEMQKGALSTRLGIPIIYGIDAVHGHNNVYKATIFPHNVGLGATRDPDLVKRIGEATALEVRATGIPYVFAPCIAVCRDPRWGRCYESYSEDPKVVQSMTSLISGLQGEVPANDVGRPYVAGSKNVAACAKHYVGDGGTYMGINENNTIINTHGLLSIHMPPYYNSIIRGVSTVMVSYSSWNGKKMHANHFLVTDFLKNKLKFRGFVISDWEGIDRITSPPHANYSYSIEAGIGAGIDMIMVPYKYTEFIDDLTTQVQNKVIPISRIDDAVYRILRVKFSMGLFENPYPDPSLAGELGKQEHRDLAREAVRKSLVLLKNGKSS

SEQ ID NO: 41759 - DNA, 659 bp, Panicum virgatum
  misc_feature: Ceres CLONE 2008939-R
  misc_feature: Encodes the peptide sequence at SEQ ID NO. 41760
gacagcccggcaacgatatcactgccggcacgacgatcctctctggaatcaaggccgccgttgatccgagcacgcaggtggtgtactccgagagcccggacagcaccgtgctcgccgacaagtacgactacgcggtggtggtggtcggggagccgccgtacgcggagacgttcggcgacaacctgaacctgacgatcccggcgccggggccgagcgtgatccagtcggtgtgcaaggccaccaagtgcgtggtggtcctcatctccgggaggccgctggtggtggagccgtacctgggcgacatggacgcgttcgtggcggcgtggctgccggggacggaggggcagggcgtcgccgacgtgctgttcggggactacggcttcacggggaagctgtcgcggacgtggttcaagtcggtggaccagctgcccatgaacgtgggcgacgcgcactacgacccgctcttcccgttcggcttcgggctcaccacaatgccacgaaatgagtgacgggctgtgacccgtgagggtctcgaattggttggtggggagggatttgggctcgccgcacacacattgggctgtgtttttttttttgggcaacacacattgggctgtgttgggcttgtgggtaataacagtgagtggtgcattcttctt

SEQ ID NO: 41760 - protein, 168 aa, Panicum virgatum
  misc_feature: Ceres CLONE 2008939-R
  misc_feature (4)..(165): Pfam Name: Glyco_hydro_3_C Pfam Description: Glycosyl hydrolase family 3 C terminal domain
  misc_feature: SWISSPROT Homolog: EC 3.2.1.21 Beta-glucosidase
QPGNDITAGTTILSGIKAAVDPSTQVVYSESPDSTVLADKYDYAVVVVGEPPYAETFGDNLNLTIPAPGPSVIQSVCKATKCVVVLISGRPLVVEPYLGDMDAFVAAWLPGTEGQGVADVLFGDYGFTGKLSRTWFKSVDQLPMNVGDAHYDPLFPFGFGLTTMPRNE

SEQ ID NO: 41761 - DNA, 709 bp, Panicum virgatum
  misc_feature: Ceres CLONE 2008941
  misc_feature: Encodes the peptide sequence at SEQ ID NO. 41762
ctctcggagccataagaccctctctctctcctctggtctcgcacccgccgccgccgcccgccgtcgccgctctcgctcgcaccgtcgcgtcgccgcaggattcgcaaagatggcggtgccgctgctgacgcagaagatcgtgaagaagcgggtgaagcagttcaagaggccccacctcgaccgctacaagtgcctcaagccaagctggcgcaggcctaagggtattgactcccgcgtcaggcggaagtttaagggatgcaccttgatgcccaacattggatacggctctgacaagaagaccaggcactaccttcccaacaagttcaagaagtttgttgtacacaatgtctctgagcttgagctgcttatgatgcacaacaggacgtactgtgctgagattgcccacaacgtctccacccgcaagcgcaaggagattgtcgagcgcgctgcgcagctggacattgtggtcaccaacaagcttgccaggctccgcagccaggaggacgagtgaaatgttcagtagttgcagttgcgttagagcagtactgagattgaagatacctttccagtttccaccatttgtatgcttgtgttagacttgttctgtagacgatattttgccatgagtgaatggcgaaccccatctagttttgacctgacatccataaagtgtgacagtgatttcctatcgcttcagattttgagtaca

SEQ ID NO: 41762 - protein, 133 aa, Panicum virgatum; identical to SEQ ID NO: 32446
  misc_feature: Ceres CLONE 2008941
  misc_feature (14)..(123): Pfam Name: Ribosomal_L32e Pfam Description: Ribosomal protein L32

SEQ ID NO: 41763 - DNA, 646 bp, Panicum virgatum
  misc_feature: Ceres CLONE 2008951
  misc_feature: Encodes the peptide sequence at SEQ ID NO. 41764
aatcaaaaatgatttcagacgatccttctgttatccaacctgctgttgagcacctccgtaaaacctttttgactggtagaacccttcccctcaaatacagaaaacaacaactcaacaaccttatcagaggtctcaaagaacttgagcccaaattccatgctgctctccaaaaagacctcaatgctaacgaaatgatgagctacatgctctctactaatctcaccattgaagacattaagcacaccttatccaacatcgattcctggagcaagcccaagtctgtagacactcctttggtcatcggtcccggcagaagttatattcagcccgagccttatggtgttgctttgattgttggcccttggaattatccagtttccacttgtgttccctatttggcaactgctattgctgctggtaactgctgtatcgtcaagccatctgaaatgtcagctcatacttcaaatgtgattgctgaattagtggataaatatttggataaggattgttatagatgtattgaaggacaggttgaagttgctaaagcaattattaaggagaagtttgatatcattgtttttactggaagtactgagaagggaaaattggttgcaaaagctgcttgcgaaaatttgactccttgcgt

SEQ ID NO: 41764 - protein, 212 aa, Panicum virgatum
  misc_feature: Ceres CLONE 2008951
  misc_feature: SWISSPROT Homolog: EC 1.2.1.3 Aldehyde dehydrogenase (NAD(+))
MISDDPSVIQPAVEHLRKTFLTGRTLPLKYRKQQLNNLIRGLKELEPKFHAALQKDLNANEMMSYMLSTNLTIEDIKHTLSNIDSWSKPKSVDTPLVIGPGRSYIQPEPYGVALIVGPWNYPVSTCVPYLATAIAAGNCCIVKPSEMSAHTSNVIAELVDKYLDKDCYRCIEGQVEVAKAIIKEKFDIIVFTGSTEKGKLVAKAACENLTPC

SEQ ID NO: 41765 - DNA, 665 bp, Panicum virgatum
  misc_feature: Ceres CLONE 2008955
  misc_feature: Encodes the peptide sequence at SEQ ID NO. 41766
cctttcatcagttctgtcttcagggtccggaaatcccaaattcccaatctctcctctcctgcctccgcaagcgtgcgcctaaaccctagctcgcctcccgatggcgccaaaaaagcaaaaagccaatccggccaagtccgccgccgccgcggagccagccgccgggaaccaccgccaggaaccggcgtcctccgaaaacaagccccgcggtaccatatacttccccatcactgacaacccggagcctaccgcctccgccaaggaggacaaggacaaggtcgccgtcaacaatgaggacaaggcgggggacatcgggaagctcctcgagccgctgtcgcgggagcagctcgtgtcgctactccgcacggccgcggaggcaagccccgtcacgatggcggccgtgcaacgggccgcggaggccaaccccgcaagcaggaagctcttcgtccacggcctcggggggggcgccggcgccaacaacctccgctccgcgttctcacgcttcggcaagctcgaggactgccgcgtcatctccgacaagcagtcgggcagatccaagggctacgggttcgtcttcttccgctcccgccacgctgcgctccgcgccctacgccgtccccagctccaaatcgaaggtcgtcttgctttctgccacctcgccgcct

SEQ ID NO: 41766 - protein, 188 aa, Panicum virgatum
  misc_feature: Ceres CLONE 2008955
  misc_feature (114)..(184): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAPKKQKANPAKSAAAAEPAAGNHRQEPASSENKPRGTIYFPITDNPEPTASAKEDKDKVAVNNEDKAGDIGKLLEPLSREQLVSLLRTAAEASPVTMAAVQRAAEANPASRKLFVHGLGGGAGANNLRSAFSRFGKLEDCRVISDKQSGRSKGYGFVFFRSRHAALRALRRPQLQIEGRLAFCHLAA

SEQ ID NO: 41767 - DNA, 602 bp, Panicum virgatum
  misc_feature: Ceres CLONE 2008956
  misc_feature: Encodes the peptide sequence at SEQ ID NO. 41768
agcgactcccaccacagaacggcggcggcggcggcggaggcggaggagggagaagaggaggcgacggccagggcgcgaggaagggagcggagcaccagccatggtgcacgtcagcttctaccgcaactatggtaagacattcaagaagccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcactgctccgccgcatgaaccgctatgggctgcttgctgagggtcagaacaagcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccatcattcatggtgagggtggagtctgagaagcacattgacttttcactgtcaagcccgttcggcg

SEQ ID NO: 41768 - protein, 167 aa, Panicum virgatum; identical to SEQ ID NO: 29969
  misc_feature: Ceres CLONE 2008956
  misc_feature (7)..(108): Pfam Name: Ribosomal_S4 Pfam Description: Ribosomal protein S4/S9 N-terminal domain
  misc_feature (109)..(156): Pfam Name: S4 Pfam Description: S4 domain

SEQ ID NO: 41769 - DNA, 697 bp, Panicum virgatum
  misc_feature: Ceres CLONE 2008959
  misc_feature: Encodes the peptide sequence at SEQ ID NO. 41770
cccctatctttggagctaatggaaaaactactggtgatgtacactcagcgttcccctctccacccaacatctatagcccttttaagttaaacgcaccttcatctgtaggtacgtgctatcctaacctctattctactgggagttcacagagagatcgcatggcctcattgtttagtagttgtgcacccaatccagaaggtgtcaactcttttgggagctctaacagaagtgttggtaccaattacgggagcaccctacaacgcacacagcatagacggatacaatgtgatggctgtggggtgacactgatcgttgggcctcgctacaagtccaatgttaaagaagactatgatttgtgtgatgcctgtttctctctcatgggcaatgagactgaatataccagattagacatgcctgcttcaaaatgtaacatgaagatcctggggaagattccagctgtgaaagctgactgtcgcttcattaaggatgttactgtccctgatgggacaccaatggcgccgtcaactccatttacgaagatttggcgcatgtgtaacagtgggtctaccacgtggccgtatggtacccagcttgtctgggttgctggagatcacttacaatgcctgagttcagtcagattagcgatttcagcaaatggggggctaaatccatgggaagagactgatgttagtgttga

SEQ ID NO: 41770 - protein, 231 aa, Panicum virgatum
  misc_feature: Ceres CLONE 2008959
  misc_feature (89)..(132): Pfam Name: ZZ Pfam Description: Zinc finger, ZZ type
PIFGANGKTTGDVHSAFPSPPNIYSPFKLNAPSSVGTCYPNLYSTGSSQRDRMASLFSSCAPNPEGVNSFGSSNRSVGTNYGSTLQRTQHRRIQCDGCGVTLIVGPRYKSNVKEDYDLCDACFSLMGNETEYTRLDMPASKCNMKILGKIPAVKADCRFIKDVTVPDGTPMAPSTPFTKIWRMCNSGSTTWPYGTQLVWVAGDHLQCLSSVRLAISANGGLNPWEETDVSV

SEQ ID NO: 41771 - DNA, 737 bp, Panicum virgatum
  misc_feature: Ceres CLONE 2008997
  misc_feature: Encodes the peptide sequence at SEQ ID NO. 41772
aaaatcctcaggcagctcgtccccaatcgcagtcgcagcgcggctcttgcctcttgtaggttgtagccatagcgaaagagagagcgccatggccaaggctcacatcctcgtgctgccggtgccggcccagggccacgtcaccccgctcatggagctctcccaccgcttggtcgaccacggcttcgaggtcacgttcgtcaacaccgaagcgcatcacgcgcgggtcgtcggcgcgctgcaggcggcgggcggcacggcggcgctgaccggcatccacctggcatccatcccggacgggttggacgataacgacgaccgcaaggacatcggcaagatcttcgactcctactcccggcacatgccggggcacctggagcggctcatcgccggaatggaggcggccggcaggcccaaggtgaagtggcttgtgtgcgacgtgtacacgtggtggtccttggacgtcgccaaaaagtttggcatccgcgtggccgcattctggccgccggcggcggcttgcttagtcatttgtctcaagatccccaagttgatagaggatgggctcctcaacaacaagggttggccagagcgtgaggagacgttccagctcgcacccgggattccgccgcttcacacgtcgcagctgccatggatgaatgtcgtcgcgcccgaagcgcacccggtcgtcttcgagctgcacatccggaccggcatgctcaccgcgcacgccgagatggtgg

SEQ ID NO: 41772 - protein, 216 aa, Panicum virgatum
  misc_feature: Ceres CLONE 2008997
  misc_feature: SWISSPROT Homolog: EC 2.4.1.218 Hydroquinone glucosyltransferase
  misc_feature: Functional homolog of the protein sequence given in SEQ ID NO 50296
  misc_feature: Useful for making plants with altered carbohydrate content
MAKAHILVLPVPAQGHVTPLMELSHRLVDHGFEVTFVNTEAHHARVVGALQAAGGTAALTGIHLASIPDGLDDNDDRKDIGKIFDSYSRHMPGHLERLIAGMEAAGRPKVKWLVCDVYTWWSLDVAKKFGIRVAAFWPPAAACLVICLKIPKLIEDGLLNNKGWPEREETFQLAPGIPPLHTSQLPWMNVVAPEAHPVVFELHIRTGMLTAHAEMV

SEQ ID NO: 41773 - DNA, 666 bp, Panicum virgatum
  misc_feature: Ceres CLONE 2008998
  misc_feature: Encodes the peptide sequence at SEQ ID NO. 41774
gaagccatctgcaagtcaagtctcactagtcactcctaatcctaaaccacaagacaccttggtgttagaagtgcaatggcgaccagcaccatggccctctcctctacggccttcgccggcaaggccgtcaacgtgccatcgtctctctttggcgaggcccgcgtgaccatgcgcaagaccgcggcgaagcccaagccggctgcctccggcagcccgtggtacggcccagaccgcgtgctctacctcggcccgctctccggcgagcccccgagctacctgaccggcgagttccccggcgactacggctgggacaccgccgggctctcggccgaccccgagaccttcgccaagaaccgggagctggaggtgatccactcccgctgggccatgctcggcgcgctcggctgcgtcttccccgagctgctcgcccgcaacggcctcgccgacgatcccgaggccttcgccgagctcaaggtcaaggagctcaagaacggccgcctcgccatgttctccatgttcggcttcttcgtgcaggccatagtcaccggcaagggcccgcttgagaacctcgccgaccatctcgccgaccccgtcaacaacaacgcctgggcctacgccaccaacttcgtgcccggcaagtgaggggtcggttcccgaactgttcga

SEQ ID NO: 41774 - protein, 183 aa, Panicum virgatum
  misc_feature: Ceres CLONE 2008998
  misc_feature (58)..(150): Pfam Name: Chloroa_b-bind Pfam Description: Chlorophyll A-B binding protein
MALSSTAFAGKAVNVPSSLFGEARVTMRKTAAKPKPAASGSPWYGPDRVLYLGPLSGEPPSYLTGEFPGDYGWDTAGLSADPETFAKNRELEVIHSRWAMLGALGCVFPELLARNGLADDPEAFAELKVKELKNGRLAMFSMFGFFVQAIVTGKGPLENLADHLADPVNNNAWAYATNFVPGK

SEQ ID NO: 41775 - DNA, 1723 bp, Panicum virgatum
  misc_feature: Ceres CLONE 2008999
  misc_feature: Encodes the peptide sequence at SEQ ID NO. 41776
ctctctccagtccacaaacataaatggaactagtcttctcaccgctccaatggctgatactcctacctccggtcttcctctgtgctctcctctcctacctgtacaccatcctatggctgagaccagagagtctcagggagaaactgaggagccagggagtgaaggggcccaagccttctttcctctttggaaacatagcggagatgaggagaatccagaaggaactggccatgtctgtccaagaactgcacgtagggaccactgataagttctccttggattatacggccaccctgttcccctacttcctccattggagcagaatttatggttccatcttcttgtattcaactgggagcatacaagttctgaatacgacagatcctgacatggtgaaggagctggccaattgcaaatcttttgatattggaaggcctgtgttcttgcaaaaagagcgtggggctcttcttggcatggggatattgtcatcaaatggtgagctttgggcgcatcaaagaaaggtgattgcaccagagttcttcatggacaaggttaagggcatgttgcacgttatggtcgaagctgcaatgccaatgttgacttcatgggaaaacataactggagaggaagggagcaatgcagagattgtggtggatgagtccttgagaaacttttcagctgacgtcatatcacggacttcatttggaagcaattttgcagcaggtaaagagatattcaacaaaatttggcaacttcagattgcaatggcagcacaaagcatgcttggtgttactggagtaagatacttgccaacaaaaaccaatagagaaatctggagtctgaagcacgagcaagattcagtcgccttatcaactaaggatctcctgcactctataattaagggtgctaaagcccgccacttcacttcacagacgcctgaggatttcatcatcgacaactgcaagaacatctacttcgcagggcatgaaacaacctcaaccactgctgcatggtgcttgatgcttcttgcttcacaccctgaatggcagtcccgtgctcggactgagctattggatgtttgtcaagagaaaccaatagaatttgacatgctgcggaagttgaaaatgataacaatggtgatccaggagacccttcgcctgtaccctccagcagcgtttgtggcacgagaagctctgaacgacctaaaaatcggcagcctcaacattccaaaaggaaccaacatcagaatcccagttgcactggctcaccgggatcctgttgtctggggtcccaattccgacaggtttgatcctggcaggtttgccaacggcatagcaggcgcctgcaaggcccctcatatgtacattccctttggtgtgggtgcccgcacctgcgccggccagaacctggccatggttgagctcaaggttgtgctatcacttgggctgtcaaagtttgagtttgcactttcgccaagctacgtgcatcgcccagcgttcagactgaccattgagcctggcaatggcgtgcctttgattcttaagaagctttactaaaccatgattggtgtcggtgtatgtatacagtagaactttgtgcctccccttcttgtctcaattgttggaacgttactctagcttaagttgcttgttgctatggatgttacatgggatgaacaattcggtaatcgtgaatgctttgctgtcggacatctgcatttccg

SEQ ID NO: 41776 - protein, 510 aa, Panicum virgatum
  misc_feature: Ceres CLONE 2008999
  misc_feature (46)..(504): Pfam Name: p450 Pfam Description: Cytochrome P450
  misc_feature: SWISSPROT Homolog: EC 1.3.3.9 Secologanin synthase
MELVFSPLQWLILLPPVFLCALLSYLYTILWLRPESLREKLRSQGVKGPKPSFLFGNIAEMRRIQKELAMSVQELHVGTTDKFSLDYTATLFPYFLHWSRIYGSIFLYSTGSIQVLNTTDPDMVKELANCKSFDIGRPVFLQKERGALLGMGILSSNGELWAHQRKVIAPEFFMDKVKGMLHVMVEAAMPMLTSWENITGEEGSNAEIVVDESLRNFSADVISRTSFGSNFAAGKEIFNKIWQLQIAMAAQSMLGVTGVRYLPTKTNREIWSLKHEQDSVALSTKDLLHSIIKGAKARHFTSQTPEDFIIDNCKNIYFAGHETTSTTAAWCLMLLASHPEWQSRARTELLDVCQEKPIEFDMLRKLKMITMVIQETLRLYPPAAFVAREALNDLKIGSLNIPKGTNIRIPVALAHRDPVVWGPNSDRFDPGRFANGIAGACKAPHMYIPFGVGARTCAGQNLAMVELKVVLSLGLSKFEFALSPSYVHRPAFRLTIEPGNGVPLILKKLY

SEQ ID NO: 41777 - DNA, 658 bp, Panicum virgatum
  misc_feature: Ceres CLONE 2009026
  misc_feature: Encodes the peptide sequence at SEQ ID NO. 41778
aaaccacagaggtcgatgccctagcaagttggaagcccgcccccttcatattcgcctccgcctccgcggctccgcctcctcgtcaaacccacgcgaccgcgagagctctccgagagcaccaccacgagcgagacgaatcttccgaatctctcggcggcgatggcgctctccgaccgctcccgcgagtcgctcctcccgagcttcctctacgcctcctcctcggcgcgctccttcgccgccaccccctcgcgcctctcagtccccgtccccgccccggccccggccgcggctggagcgggtggcggcgtgcccttcacgatccaggcgcccaaggagaagatcgagctctactcgccggcgttctacgccgcctgcacggccggagggatcgccagctgcgggctcacccacatggccgtcaccccgctcgacctcgtcaagtgcaacatgcagatcgatccagcgaaatacaagagcatctcatctggatttggtgtcctgttaaaggagcaaggggctaggggcttcttcaggggatgggtgcctaccttgcttggttacagtgctcagggggcttgcaagtttggcttctatgagttcttcaagaagtactactcagatattgcagggcctgagtatgcccagaagtacaagactc

SEQ ID NO: 41778 - protein, 166 aa, Panicum virgatum
  misc_feature: Ceres CLONE 2009026
  misc_feature (68)..(156): Pfam Name: Mito_carr Pfam Description: Mitochondrial carrier protein
MALSDRSRESLLPSFLYASSSARSFAATPSRLSVPVPAPAPAAAGAGGGVPFTIQAPKEKIELYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKT

SEQ ID NO: 41779 - DNA, 712 bp, Panicum virgatum
  misc_feature: Ceres CLONE 2009033
  misc_feature: Encodes the peptide sequence at SEQ ID NO. 41780
gaccccatcgctgagtcgcagccgcagcccaccggaggaaaccctagccagcgcgcccgccgaccgcagcagcagccgccccgcatggcgtccccggcccggcccgccgccgcctccgtctccggcgccttcggcctctcgcccgaccccaagcgctgctccttcgaccaggcgctccggcagaaggattttcaggagaacagaatgttgatgtcatttgttaatttccatgagcaagaaaaaatttctaaagaaattgtaacagaagcaatagagaactgcatgaagaaacaagcagataacttgttgaattcgctggaagtcatcagcggtaggctgtcacaattggagttatattgctataagctggaacggtctattggagaactacgaagtgatgtgatggattatcatggtgaagcaaatcttaactaccgttgccttgaaaagcatgtgaaagagcaatccgtgcaggtccttcaggaaaagcaggagcttgcagagacccagaaagaaatgagcaaacttcagatagtacacgaggactctgcacaaaagagtgaaggtactgctccatctgttttcatggctagagaaaatgagctcgcccttgtgccgttgccccaagtaaatgctgtccagtctcctggtatgcaattccaaagttgcaatcgacttattttacagcaactggtgccagtctctttgagca

SEQ ID NO: 41780 - protein, 209 aa, Panicum virgatum
  misc_feature: Ceres CLONE 2009033
  misc_feature: Functional homolog of the protein sequence given in SEQ ID NO 50774
  misc_feature: Useful for making plants with altered carbohydrate content
MASPARPAAASVSGAFGLSPDPKRCSFDQALRQKDFQENRMLMSFVNFHEQEKISKEIVTEAIENCMKKQADNLLNSLEVISGRLSQLELYCYKLERSIGELRSDVMDYHGEANLNYRCLEKHVKEQSVQVLQEKQELAETQKEMSKLQIVHEDSAQKSEGTAPSVFMARENELALVPLPQVNAVQSPGMQFQSCNRLILQQLVPVSLS

SEQ ID NO: 41781 - DNA, 1355 bp, Panicum virgatum
  misc_feature: Ceres CLONE 2009043
  misc_feature: Encodes the peptide sequence at SEQ ID NO. 41782
tttaaatttaactacttcaacagatagctctgaaaatggatgaggctagatatgaaactcttctagacgaaaataccaacttgaagaaggctctttcctccactaagcatgtccttgaacgaactctgaatgactatgagactttgagattgattcacgaagacttcaaaggtcagtacgacaagctcaaaagagagaatgatgaagctcatcagaagtatttccagctcttggctgataagaaggaggttgaagcacagttcgacaatacaattcgcaattttaaaaatgcaattgaacagaaacagagagagttagaagatgtccaagcgaaggtgattccttctttggattatgatatgatgaggataaaaattatcaatgagcttgaaggtccacaaaggcttgctttagaaactaagcagcaagaaatggatagacttcaagatctggtctatgagctgaaaagacaagtcgagatctttaactcaaagtatgatgcaatcaagtatgaagctgagaaagacattagagacttgaaggaaagacataagcttgagatcaatgacttgatgttggaaatccaggctttacaggaaagagctgatgataatagagataaggaggttatcagacatatgagaagagagcttgatgagctgagattcagatatggcgagaacgaaaatgagatggaggaactaatcagagaaaaagacagattamgagaggaaaagaacgatattttgatctagtggaacaaacgggttgaagtagaacagagcgagaagagacacttaaaggcagagaatgactagttgatcatcagaatcagacagctggagaacgaatcttcaactgtgaatgatcgctttggagataaacagcatgaagtttccagacttcaaaaggaaaatgagaaactacagcatgataatgaaaacaagttgaagcacatacatggcttgcaatcccagttgagagacttggaggatagccagcattcagctcagacaagacttccagagtacatttctcaaagccaacttcaaagccatgaaaagcatatttccgagaagaatagaatcgctaccctgcagagagaaatcgagtcttaccaaaagactatcgttgaactagaaaacaaacacggaaccgccaacttccagactggtaaagatcttgatctcgccagacaagagctcagtcgtgtgaatgagttgtactaccaaactcaaagacacttggaaaccatagaagaagaagtcaatagattgaagcgagacctcgacaatacacatgatgagatgtactatctccagcgcaagatcaaggagcttactctccagaaagat

SEQ ID NO: 41782 - protein, 239 aa, Panicum virgatum
  misc_feature: Ceres CLONE 2009043
  misc_feature: SWISSPROT Homolog: EC 2.7.11.1 Non-specific serine/threonine protein kinase
MDEARYETLLDENTNLKKALSSTKHVLERTLNDYETLRLIHEDFKGQYDKLKRENDEAHQKYFQLLADKKEVEAQFDNTIRNFKNAIEQKQRELEDVQAKVIPSLDYDMMRIKIINELEGPQRLALETKQQEMDRLQDLVYELKRQVEIFNSKYDAIKYEAEKDIRDLKERHKLEINDLMLEIQALQERADDNRDKEVIRHMRRELDELRFRYGENENEMEELIREKDRLREEKNDILI

SEQ ID NO: 41783 - DNA, 612 bp, Panicum virgatum
  misc_feature: Ceres CLONE 2009043-R
gtgaaggtgtccatcgggtacatcaggttcatcatgcgccaggtgcaggagctccagcgccagccgctgcggccacaacagtagcaatacccgtccgtcacaacatcctccgccaccgggagagggggagtatcagcagccgggcccagcgcttctctcgtgggcccgcccgggtgacccggcgttgggcccttcctcccgttgggtcccgggcggctcataggtagggccggattgatgaggacggtggatatccacgggcccacctagtcgtagtccttgttgttgaggggcagtgcacaaacgaccctgggcttcgggttcagcagccccggccagagcagccatggtggaatccagagatgaagatgatctatggagaaaggggaaaggaagcttgattagctcccttggtgccggtaggggataaagtaggaatgggggaagatggatggattatttgggggacgatggatcatggatgccatgaagtagatagagaggtaattttgatttgatctttaataggatttttcaagctgagagaacgaaagagggtagcaagtgtatgttttctcttccaatggctgtcaatccatgccatgttttatg

SEQ ID NO: 41784 - DNA, 1440 bp, Panicum virgatum
  misc_feature: Ceres CLONE 2009047
  misc_feature: Encodes the peptide sequence at SEQ ID NO. 41785
gcagcgagaacaggagagagattcccgattccactccaactcccagcagtccactccaccgcacctttcctccccctccttctccagctccggcgaggcgaggccgtcgtcgccctccacctccttccgcatccccatcccctccctgaccaaggatctgcaccgccgccacccgttcccttgctgtgcgccgtccccccttgaaatcccgcccccggaatcgcgccgccgccaaccctgccctcttcctgcgccgcccctgccctctcccgccgccgtcgcgcctccggatccgcgccgacgcccctgccgtccccccgaccgaagcaacgccgcctgcctcgcccttgctgtgcgccgctgcctcccccttttggaaatcaggagctatatgagtagtggataagttgaattttgaggccattgggtactctcaggggaagtgcattgatagccttaccattaacttcctaagatggctactcagttaccatgcttcacacagctcagtccaccatcttctaattggggaaatgaagctgcaatctgcaaggatacatctggtagggcatttgtcagaagtactcgagctttgagtcattttcacttccagtgctgtgcaaggccccgcagtgccaactctttccagaagaaagactcgttccttgaccttcatccagaggtgtctctgctccgtggtgagaagaatgttgaggttgtggacccattgaaaggtgcttctgatggaagtccgttagaggggctgggattgccaccagaccggagtgattataatgaggccaagatcaaggttgttggagttggaggtgggggttcaaatgctgtcaacaggatgattgagagctctatgcatggtgttgagttttgggtcgtgaacactgatgtgcaggcgataagaatgtctcctgtgcttcctcacaataggttgcagattgggcaggagctgacacgtggtttgggagcagggggaaaccctgatattggtatgaatgcagcaaaagagagcagtgaatccatacaggaagcacttcatggtgctgacatggtttttgtgacggctggaatgggtggagggactggaactggaggcgctcctgtaattgctggaattgccaagtcaatgggtatacttactgttggtattgtcactacgcctttctcatttgaggggaggcggcgggcagttcaagcacaggaaggaatagcagctttgcgaaatagtgtggacaccctaattgtcatcccaaatgacaagttgttatctgctgtttctccaaatactcctgtaacagaagcattcaatttggctgatgatatccttcgacaaggcattcgtggcatatctgatatcattacggttcctggattggttaatgttgattttgctgatgtgcgtgccatcatgcaaaatgcagggtc

SEQ ID NO: 41785 - protein, 321 aa, Panicum virgatum
  misc_feature: Ceres CLONE 2009047
  misc_feature (109)..(304): Pfam Name: Tubulin Pfam Description: Tubulin/FtsZ family, GTPase domain
MATQLPCFTQLSPPSSNWGNEAAICKDTSGRAFVRSTRALSHFHFQCCARPRSANSFQKKDSFLDLHPEVSLLRGEKNVEVVDPLKGASDGSPLEGLGLPPDRSDYNEAKIKVVGVGGGGSNAVNRMIESSMHGVEFWVVNTDVQAIRMSPVLPHNRLQIGQELTRGLGAGGNPDIGMNAAKESSESIQEALHGADMVFVTAGMGGGTGTGGAPVIAGIAKSMGILTVGIVTTPFSFEGRRRAVQAQEGIAALRNSVDTLIVIPNDKLLSAVSPNTPVTEAFNLADDILRQGIRGISDIITVPGLVNVDFADVRAIMQNAG

SEQ ID NO: 41786 - DNA, 539 bp, Panicum virgatum
  misc_feature: Ceres CLONE 2009047-R
aatgcagccgctgaaataatctacgacctcgttgatccaaatgccaatatgatatttggtgctgtcatagacccatcactgagtggtcaagtgagcataaccttgattgctactggattcaaacggcaggatgaaccagaggatcgcagcccaaaggtcggccagcagatccaaggtgagaatggccgacgcccatcctccacagaaggcagcatggtggagatccccgagttccttcgacgaagaggcccttctcgcttcccacgagtttgaaccaggcttcccccttgtcccgccctgtatgatatacctccgttaggtcagatggctcctgcaaggcaccgaagccttccagattaggtgttctcggtagtggttcttgttcagttttgtttgctccttcgtgcgccatatttctctagtctttcagtcaataatgtgtagaagtgagcttgctagtgctatagaagaatgtgtttccttttacactgatctgctcgacattgtctgtcctgctctgattccttcgacttgccggc

SEQ ID NO: 41787 - DNA, 745 bp, Panicum virgatum
  misc_feature: Ceres CLONE 2009054
  misc_feature: Encodes the peptide sequence at SEQ ID NO. 41788
aaaaccacacttagtcaccgtcacatgcacttaccatcgcggtggagaacccaatggccaaataccaatcatctcggttataattcaccgcactcaacctacactatctataacctggttcgaacctgatctacctactacaccttgacgccaaaactccaccgagtaaacctttttttcaccatggcgcctggaccaacaaccgaggaacccagcaatcatcatggcctggggagcaagctcaagcttccgtttcgcgagctcagagacagactcaaccataacaaccacttgaacaacgcaaaggttcatttggttcaccaaaaacacaagatcggcaagtttgccaacctgttcaaccccgagcatcgccatgatgaagaacacgaaaaagcttgtgacgagaagcgcaccaagattggcgagtcccatcgctttgagtcctacttccccgaacgcgacgggaacatggtgaagtggtatgttgacggtagggactatttttgggcagtatcagccgccctcgaaaatgccaaagaaacaatttacattgccgattggtggctgtcccccgaactgttcctccgccgccctccgtatttcaaccaggaatggcgtctcgaccaggtcctcaaacgccgggcagaggctggcgttaagatctacatcgccatctaccgtgaagtcgaagccgccctcacctgcaactcagagcataccaagcatgcccctccaagccttgggc

SEQ ID NO: 41788 - protein, 187 aa, Panicum virgatum
  misc_feature: Ceres CLONE 2009054
  misc_feature: SWISSPROT Homolog: EC 3.1.4.4 Phospholipase D
MAPGPTTEEPSNHHGLGSKLKLPFRELRDRLNHNNHLNNAKVHLVHQKHKIGKFANLFNPEHRHDEEHEKACDEKRTKIGESHRFESYFPERDGNMVKWYVDGRDYFWAVSAALENAKETIYIADWWLSPELFLRRPPYFNQEWRLDQVLKRRAEAGVKIYIAIYREVEAALTCNSEHTKHAPPSLG

SEQ ID NO: 41789 - DNA, 646 bp, Panicum virgatum
  misc_feature: Ceres CLONE 2009054-R
cgccgcttcgagaccacgatggatgggcgcccgtttgaggccgggtggcatgccgcgacgctgcgcaggtatctctggcgggagcatctggggttgctgccgccgcagagcttggatgcggggggggacccgaatgcgcagccgccgggggatgactcgccgaatgatgtgtgggatcgggatgagtcgtggaagtttgtggaggacccattgagtgatgaggtgtgggatatgtggactgggagggcgacgaagaatacggaggtgtttcggcagctgttccatgctgacccagacgatcatgtcaaaacgtttgacgactacaacggcttcctgccggccaagggcgtcaaggcaggccatatcttcgaccgcatgatcccgccgcaggaggtgagacagaagctggagaagatcaagggtcacctggtttggatgccgttggagttcctccgggatgccgagatggcggagaaggggctgcaggtgaatcagtggaccgagagcgtctacacttagcctcttagggtgaggggatcggtatgtccgatgccgattatccatgtaaactacatactcggttttagtcttcggtgggttgatcggcgttcgtggcaagctgctttggctcgttcgagtttctctc

SEQ ID NO: 41790 - DNA, 743 bp, Panicum virgatum
  misc_feature: Ceres CLONE 2009058
  misc_feature: Encodes the peptide sequence at SEQ ID NO. 41791
actacaccacagatatccaccaagacaactgcattagtgagccatggcttctcctgtcaagagcaggaagctgcgcatcctcctcatgcccttcttcgccactagccacatcggcccattcaccaacttcgccgtccacctcacggctgcgcggccggacatcgtcgaggccaccatcgccgtcagcacggcgaacgccgcggtcgtacagtcagctcttgcacggcagcagagccccggcagcgtgacagcggtgagggtggcgacgtacccgttcccggtggtggatggcctcccaccgggggtggagaacctctcgaccgtcaaggccgcggatgggtggcggatcgccgtcgccgctttcgacgagaccctgatgaggcccggacaggaaggcctcatcagggagcactcgccggacgtcatcatcaccgacgcgcacttcttctggaacaccgacgtcgccgccgatctcggcgtgccatgcgtcgctttccaagtcatcggaaccttcgcggcgacggccatgacgcacctcagggatattggcatccatggcatcgctgaaggtgtggtggctctgcctcgagctgaaggcggcggcgacatactgatcccgcacacggagctgcctgagttcgtgaggagccagaaaatcatggatggccccgtcatggatcgggtcagctcaagcatggtaaggtgtgccggccgggccgtgaacaccttcttcgacggggagc

SEQ ID NO: 41791 - protein, 233 aa, Panicum virgatum
  misc_feature: Ceres CLONE 2009058
  misc_feature: SWISSPROT Homolog: EC 2.4.1.238 Anthocyanin 3'-O-beta-glucosyltransferase
MASPVKSRKLRILLMPFFATSHIGPFTNFAVHLTAARPDIVEATIAVSTANAAVVQSALARQQSPGSVTAVRVATYPFPVVDGLPPGVENLSTVKAADGWRIAVAAFDETLMRPGQEGLIREHSPDVIITDAHFFWNTDVAADLGVPCVAFQVIGTFAATAMTHLRDIGIHGIAEGVVALPRAEGGGDILIPHTELPEFVRSQKIMDGPVMDRVSSSMVRCAGRAVNTFFDGE

SEQ ID NO: 41792 - DNA, 701 bp, Panicum virgatum
  misc_feature: Ceres CLONE 2009062
  misc_feature: Encodes the peptide sequence at SEQ ID NO. 41793
attaaccaaccagagctctctcacacgctcgccgctccgggaggccacccaaccacctccgcagagagagaaccgcagcgccggacatgcagcgcctcgcctcctcccggaggctcctccgggccgcgctcgcccccgcccgggccaactccagcctctccgcggccgccgccgtcgccgcgccggcgccggagaatggcgccgcgttgccgaagatgccggtcttcgactacgcgccgccgccctacgacgggccgcgggcagatgagatcttcaggaagcgggccgagttcctcagcccgtcactcttccacttctacgaccgtcctttgaacatagttgatggaaagatgcagtacctatttgatgaggatggccgtcgttatctggatgcttttggtggcatcgcaacagtttgttgtgggcactgccatcctgatgtggttgaagccatagtaaaccaagcaaagagaatccaacactccacagttctgtatctcaatcacgccattgcggactttgcagaggcattgacatccaaaatgcctggtgatcttaaggtagttttcttcacaaattcaggcactgaggcgaatgagctagcactgatgattgcgcggctttacactggttgcaatgacattatctcgctcaggaatggataccacgggaatgctgctgggaacatgggtgctactgct

SEQ ID NO: 41793 - protein, 204 aa, Panicum virgatum
  misc_feature: Ceres CLONE 2009062
  misc_feature: SWISSPROT Homolog: EC 2.6.1.44 Alanine--glyoxylate transaminase
MQRLASSRRLLRAALAPARANSSLSAAAAVAAPAPENGAALPKMPVFDYAPPPYDGPRADEIFRKRAEFLSPSLFHFYDRPLNIVDGKMQYLFDEDGRRYLDAFGGIATVCCGHCHPDVVEAIVNQAKRIQHSTVLYLNHAIADFAEALTSKMPGDLKVVFFTNSGTEANELALMIARLYTGCNDIISLRNGYHGNAAGNMGAT

SEQ ID NO: 41794 - DNA, 1103 bp, Panicum virgatum
  misc_feature: Ceres CLONE 2009078
  misc_feature: Encodes the peptide sequence at SEQ ID NO. 41795
gccactgaactttccgcttgcttcgaggtgctagcacacagagtgagagtgatcagtagttgctctgttttcatggccactgtgactgaggaggctgcagcggccgtcaccgtggaggcgccggcgctggagaaggtggctgaggtgaaggaggtgcaggtggaggcggcggcccagccggaggagggcgagaagaaggaggtggacgaggcgccgaagccggaggaggaagagaaggaggaggatgcgccgaaggcagaggagggcgagggcaagaaggcggagaagaagcagcggaaaaggaagcccaggtccgccgggccgcaccacccgccgtactttgagatgatcaaggaggcgatcctggcgctggacggcaagtcggggtcgagcccgtacgcgatcggcaagtacatgggcgagaagcaccgcgacgtgctcccggccaactaccgcaaggtgctggccgtgcagctgcgcaacttcgccgccaagggcaggctcgtcaaggtcaaggcctccttcaagctcgccgcggccgaggaggagaagatgaagaagcagcccgttcctgccgcgaagaaggccgcggcggcggcgcccgccgccaagcgcaagaggacggcccgcgcgcccgccaagaagccggtggccgccgcgccggcgcccaaggaggcgaggaaggcgcgcgcgaagcgggcgaggaaggcggcccccgcgccggcgcagcccaagccgaagcagcacagggctgtccgtgccgctggcacaaccaagagggccaacaaggccagcgcctgagcgccgccgtgtcctgttttctttccagtgtatgcgtcgccgtgtatagctggtactgtagcaagtactagtagtagcagaagtagcgctccagtgcagtgcactggtcgtcatctccgccggcgcgatcgagcggtgtgctcccccgccgtgtgatgtaaatacagccgcaagacctgtgtgatcgcaataagctagaacgcgcgctttagcttctgccgtgatgttgggaagcttttgatctcaccgtagtgatgatgtactagttgatgtaaaatatctgacgacgcacctgttcatct

SEQ ID NO: 41795 - protein, 242 aa, Panicum virgatum
  misc_feature: Ceres CLONE 2009078
  misc_feature (85)..(155): Pfam Name: Linker_histone Pfam Description: linker histone H1 and H5 family
MATVTEEAAAAVTVEAPALEKVAEVKEVQVEAAAQPEEGEKKEVDEAPKPEEEEKEEDAPKAEEGEGKKAEKKQRKRKPRSAGPHHPPYFEMIKEAILALDGKSGSSPYAIGKYMGEKHRDVLPANYRKVLAVQLRNFAAKGRLVKVKASFKLAAAEEEKMKKQPVPAAKKAAAAAPAAKRKRTARAPAKKPVAAAPAPKEARKARAKRARKAAPAPAQPKPKQHRAVRAAGTTKRANKASA

SEQ ID NO: 41796 - DNA, 621 bp, Panicum virgatum
  misc_feature: Ceres CLONE 2009089
  misc_feature: Encodes the peptide sequence at SEQ ID NO. 41797
cgatcgaagcagagaaaaatcggtaggggtcgggacagcagcagtagcgctgccgccgccgccgcgggggaggtagcatctagccccactccgccgccgctgtctccggtctggaatggcttcggcggtggagaggcggagggaggagcactcccgaagatcgcgctccccggccagggagagggagcggaggggcacgcccccacgcaggcggagcccccatgagcggaggaagagttcgcctgttagggcacggtccccacctgctaagcccagcgcgtcgcacagggacagggagaggtcgcctccgagggagaaggcgaaggagcgtgccaggtcgccgcggtctcctgctaaggccagcctgtcacagagggagaggtcgcctccgagggagaaggcgaaggaccagcgtgtcaggtcaccgaaacacgcgagagagcagtcacgatcaccgtcgcctgccaggaggcgcggttctaggtcgccatcaccgcgcacgaagaggctgaggagagcccatggcgagcgggaggctgagcaggtgactgacagggatcgccgcaagtccagccacagggaggagcgggacaccgggaggcacagggaacttgatgaagg

SEQ ID NO: 41797 - protein, 168 aa, Panicum virgatum
  misc_feature: Ceres CLONE 2009089
  misc_feature: SWISSPROT Homolog: EC 5.2.1.8 Peptidylprolyl isomerase
MASAVERRREEHSRRSRSPARERERRGTPPRRRSPHERRKSSPVRARSPPAKPSASHRDRERSPPREKAKERARSPRSPAKASLSQRERSPPREKAKDQRVRSPKHAREQSRSPSPARRRGSRSPSPRTKRLRRAHGEREAEQVTDRDRRKSSHREERDTGRHRELDE

SEQ ID NO: 41798 - DNA, 943 bp, Panicum virgatum
  misc_feature: Ceres CLONE 2009112
  misc_feature: Encodes the peptide sequence at SEQ ID NO. 41799
ataccccccagcgagagtacacggcgcacgcactttttgggtttagcacatcatggctgttgggaagaacaagcgtatttccaaaggaggcaaaaaaggccaaaagaaaaaaatcaccgaccctttcgccaagaaggattggtatgacatcaaggcccctggcatgttccgcaaccgcagtgtcggcaagactcccgtcagcaagacacagggcaccaagttggcccgtgatggtttgatgggtcgtgtcttcgagatcaacctcgctgacttgcagaaagacgagggtcaagcccaccgtaagatcaagttaaaggttgtggacgtacaaggcaaggcctgccttacaaatttctggggcatgaacctcacaacggacaagcttcgttcccttgtccgcaagtggcaaaccctcattgaggcccacgttgacgtcaagaccgctgacggcttcttgatccgcatgtttgccattggtttcaccaagcgaaggaccaaccagaccaagaagacctgttacgctcagacatctcaaatcaagcagatccgcgctaagatgatggaaatcatgacccgcgaggctaccacttgcgatctcaagtcgttggtggtcaaattcatccccgaggccattggtaccaggatcgaaaaggagtgtaacggaatctaccccctccagaacgtatttatcaggaaggtcaagatgctcaaggcccccaagtttgatgcccagaagatcaccgagctttatggtgctggttccctggtcgaggacattggagctccagtagagagagatgaggccgctcctgcccccgaagccaccgagagctcttaaactcggttgatgctttttttcttctccctttgcttgctaaccctttttcggaggttaattgtcccttttgccttcgtcctccaatataaactagtcgtgcgcccc

SEQ ID NO: 41799 - protein, 261 aa, Panicum virgatum
  misc_feature: Ceres CLONE 2009112
  misc_feature (12)..(223): Pfam Name: Ribosomal_S3Ae Pfam Description: Ribosomal S3Ae family
MAVGKNKRISKGGKKGQKKKITDPFAKKDWYDIKAPGMFRNRSVGKTPVSKTQGTKLARDGLMGRVFEINLADLQKDEGQAHRKIKLKVVDVQGKACLTNFWGMNLTTDKLRSLVRKWQTLIEAHVDVKTADGFLIRMFAIGFTKRRTNQTKKTCYAQTSQIKQIRAKMMEIMTREATTCDLKSLVVKFIPEAIGTRIEKECNGIYPLQNVFIRKVKMLKAPKFDAQKITELYGAGSLVEDIGAPVERDEAAPAPEATESS

SEQ ID NO: 41800 - DNA, 739 bp, Panicum virgatum
  misc_feature: Ceres CLONE 2009120
  misc_feature: Encodes the peptide sequence at SEQ ID NO. 41801
gaaaatcgaacaaaaatcaaacaaacaaataaagaagggaagggaagccaccggcaccgtccccccaccgttcccttcccttcccgatcctcctcgcagatctccggcaccggccgccatgaactcctactccggcgaaagggaggacatttttgggaagcaagtgtttccgaggaattttcagaatgggactctgattggtgggggcacacttgacccaagaatacctctgagcaggcaggaggacctgatcgtctggatgcgaaccgcggcgctgccaacgttccggaagctgtacgggaggatcgaggtggacctccacgccgacgagctcaccgtgactctgcagaacaactacaacacgtacagcttcggcgggaagaagacgctggtgctgtcgaccgccggcgtgctgggaggcaagagcgacttcctcggccgcgggtacgtggtcatcggcatcgcctgcctcgcgctggcgatgctcctgacgctgctctgcctcgccttcccactgaaagaggagcatctggcgctgcctagatcacgtacagattgaagccgtttctttttcaggcttggattcggttggtgattccttgcagggatccaacgaagaataacagctacagagttgcgtcgtgtatatatgcatccgacagtatatttacatgccactgccgcgcgtgcggtttgtacatgtctgaagttggtttgcttcccgtacattcagattcag

SEQ ID NO: 41801 - protein, 146 aa, Panicum virgatum
  misc_feature: Ceres CLONE 2009120
  misc_feature (1)..(139): Pfam Name: CDC50 Pfam Description: LEM3 (ligand-effect modulator 3) family / CDC50 family
  misc_feature: Functional homolog of the protein sequence given in SEQ ID NO 50291
  misc_feature: Useful for making plants with modulated nitrogen use efficiency
MNSYSGEREDIFGKQVFPRNFQNGTLIGGGTLDPRIPLSRQEDLIVWMRTAALPTFRKLYGRIEVDLHADELTVTLQNNYNTYSFGGKKTLVLSTAGVLGGKSDFLGRGYVVIGIACLALAMLLTLLCLAFPLKEEHLALPRSRTD

SEQ ID NO: 41802 - DNA, 737 bp, Panicum virgatum
  misc_feature: Ceres CLONE 2009122
  misc_feature: Encodes the peptide sequence at SEQ ID NO. 41803
atcgaaaaaagaaatgaactatcctatctgaacctttcttcttcctcccgtgctctcctcttctctctagcgttcttcctctgaactttccctccgatctctctccctagctcaaattcagctatcgtagtgctctgatcgctctcaacagagatcgggacactacacaccgaccgaggcagcggatccgaccggctccggcggggtctggagaaggcgagggcggcgaccaaacgggtccttggaggtagcgccggcggcgacgaggtactctcgaccgccggagatggggatgcgggagtttgcgcgcgcgcaccacgtggcgttcttcgacgccatggccaccgagctccccgacgactacgccccgcaggaggtcaaccacctcaccctcggctacttcgccgtcggcggcctctcgctccttcgggagctcgaccgggttaacaaggatgaaatagccaaatgggttttgtcttttaaagttcatccagaggcacctggtgatgaggataatgggtcattttatggattctgtggttctagatcaactcaatttccgttgcctaatgtgaaggactcttgccacaacagtagtcatcttgcaagcacttattctgccctcgccatcctggagattgtaggctacgatctagcaaatattgatagcaatgcacttttatcgtctatgaaaaagctccaacaaccagatggaaggtaggtatttagcttttggt

SEQ ID NO: 41803 - protein, 144 aa, Panicum virgatum
  misc_feature: Ceres CLONE 2009122
  misc_feature: SWISSPROT Homolog: EC 2.5.1.59 Protein geranylgeranyltransferase type I
MGMREFARAHHVAFFDAMATELPDDYAPQEVNHLTLGYFAVGGLSLLRELDRVNKDEIAKWVLSFKVHPEAPGDEDNGSFYGFCGSRSTQFPLPNVKDSCHNSSHLASTYSALAILEIVGYDLANIDSNALLSSMKKLQQPDGR

SEQ ID NO: 41804 - DNA, 600 bp, Panicum virgatum
  misc_feature: Ceres CLONE 2009135
  misc_feature: Encodes the peptide sequence at SEQ ID NO. 41805
agagagcggcgcaacgcagcatcgaggggcggcggcggcggcggcgatacctatctagagggagcagaggccgggcgcgcgcagggatgggcgcgccggtgcgcggctcccttctcctctgcctcctgctcctggcgggggcggcgggggggcagcggcagcagcgtgccacggaatgccgctggcgccgtcgtgccggcgttgctgctggcggcggccatggggatggcagccttccccggcgccggcgcgcacccgtccccggggtactacccgagctcgaggatcaggcccatcccgttctaccgcgggtacaccaacaagtggggcccgcagcaccagacgctctcctgcgaccactccgccctcaccatctggctcgacaagacctgcgggagtggcttcaagtcgaagcacgcgtaccggaatggctacttctccacccgcatcaagctcccccccggctacaccgccggcaccaacaccgacttctagctttcgaacaacgaggcgccccctgggttccacgacgagatcgacatggagttcttgggcatcatcccgggggagctctacaccctgcagaccaacgtgtacgtc

SEQ ID NO: 41805 - protein, 164 aa, Panicum virgatum
  misc_feature: Ceres CLONE 2009135
  misc_feature: SWISSPROT Homolog: EC 2.4.1.207 Xyloglucan:xyloglucosyl transferase
RERRNAASRGGGGGGDTYLEGAEAGRAQGWARRCAAPFSSASCSWRGRRGGSGSSVPRNAAGAVVPALLLAAAMGMAAFPGAGAHPSPGYYPSSRIRPIPFYRGYTNKWGPQHQTLSCDHSALTIWLDKTCGSGFKSKHAYRNGYFSTRIKLPPGYTAGTNTDF

SEQ ID NO: 41806 - DNA, 683 bp, Panicum virgatum
  misc_feature: Ceres CLONE 2009156
  misc_feature: Encodes the peptide sequence at SEQ ID NO. 41807
gcatcagccaccaagcattcagccatgtccaaggccttcgccaagtccctctcccagctcaacaaggccctcagcaggaggctcaacgccctcgtcatccgcgcgcagcccccgccggcgaggccggagccggacgggcgcgtggtgccgacgacgcgggacgcgctccccgcggagcgcggcggcgtcgccgtgtgcaaggtcgagggcggcctgctcaggtcgtcctccgccttcccctacttcatgctcgtggcgctggaggctggcggcctcctcagggtcctcctcctgctgctgctctacccggccctgcgcctgatcggccacggccgcgcgatcaaggccatggccgtcgtgagcttcatcgggctgcaaagggacgcgttccgggcgggcagggcggcgctgccctggctgctcctggaggacgtgagcgccgaggtgttcgacgcggcggtggcgtcccgccggtgcgtcgtgtgcgtgagcgccatgccgcgggcgatggtggagccgttcctgagagagtacctcggcgccgacggcgtcgtggcgccggagatgagggagttcagggggcgctacctgggcgtcatgcaggatgaaagcgaggtgctgcgagggctggacgtggagaaggtgatcgccagggaggagaagggcggtgacagggaccacct

SEQ ID NO: 41807 - protein, 219 aa, Panicum virgatum
  misc_feature: Ceres CLONE 2009156
  misc_feature: SWISSPROT Homolog: EC 2.3.1.15 Glycerol-3-phosphate O-acyltransferase
MSKAFAKSLSQLNKALSRRLNALVIRAQPPPARPEPDGRVVPTTRDALPAERGGVAVCKVEGGLLRSSSAFPYFMLVALEAGGLLRVLLLLLLYPALRLIGHGRAIKAMAVVSFIGLQRDAFRAGRAALPWLLLEDVSAEVFDAAVASRRCVVCVSAMPRAMVEPFLREYLGADGVVAPEMREFRGRYLGVMQDESEVLRGLDVEKVIAREEKGGDRDH

SEQ ID NO: 41808 - DNA, 698 bp, Panicum virgatum
  misc_feature: Ceres CLONE 2009158
  misc_feature: Encodes the peptide sequence at SEQ ID NO. 41809
gtgaacgcttcacgccccgccgccacctccgccctcctcctcctcccccgcacgcctcgctccaccgcttccgcgcccccgaaaggcaaaccccccccccccgcatccgcctcggtcaaaccctagcagacgtgcgcgcagacacccaccgcacccattccccatctcgctatggcggcgctctccgtgcccctccgcgccgcggccgccggatcccgcgccgccgtggaccccatcaaggtctcacgcgtgaggagcaccggctcagcacacttcagctgcagcttcccttccatcaaggcctcctcgtcatctgctaggaacatcgggccgctgagggcgattgctacagagtcaccccctgctgtcccacaatattcgagtggggagaagacgaagattggcatcaacgggtttggacggattggcaggttggtcctgcgaattgcaaccagcagagacgatattgaagttgttgctgtgaatgatcctttcattgatgctaagtacatggcctatatgttcaagtacgactccactcacggtccatttaaaggttctattcatgttgtggatgattcgaccctggagatcaatgggaagaagatcacaattacaagcaaaagagatcctgctgagattccatggggtaactatggagcagaatatgttgttgaatcttctggtgtttttacgac

SEQ ID NO: 41809 - protein, 175 aa, Panicum virgatum
  misc_feature: Ceres CLONE 2009158
  misc_feature (75)..(175): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAALSVPLRAAAAGSRAAVDPIKVSRVRSTGSAHFSCSFPSIKASSSSARNIGPLRAIATESPPAVPQYSSGEKTKIGINGFGRIGRLVLRIATSRDDIEVVAVNDPFIDAKYMAYMFKYDSTHGPFKGSIHVVDDSTLEINGKKITITSKRDPAEIPWGNYGAEYVVESSGVFT

SEQ ID NO: 41810 - DNA, 782 bp, Panicum virgatum
  misc_feature: Ceres CLONE 2009161
  misc_feature: Encodes the peptide sequence at SEQ ID NO. 41811
actcccacccctgccgcgcgccagtctagtcttctcctggcccgaccacgagctcgtctcctccatggcctccccctcccctctcctcctcgccctcgtgtcggcggcgctcctcctccgcacgcccggcgccgccgccgcgcccgaggagcacctcgtcaccggcctccctggattccacggctccttcccctccagccactactccgggtacgtgacggtggacgaggccagcgagcggagcctcttctactacctggcgctgtcggagcgcgacccggccgccgaccccgtcgtgctctggctcaacggcggccccgggtgctccagcttcgacggcttcgtctacgagaacgggcccttcaacttcgagcccgggagcaccctgcccaggctgcagctcaacccctacagctggtcaaaggtatcaaacatcatgtacctggactctcctgctggcgtcggaatgtcctattcgttgaacaaatcggattatacgacaggtgacctgaaaactgcagctgatgcgcacacgttccttctgaagtggttcgaattataccccgagtttcagtcgaacccgttctacatttctggggagtcatacgcaggggtttatattcccacgcttgctgatgaagttgtcaaagggatagaaaaaggtgtgcagccaagaatcaatttcaagggctatctgattggcaatgcattcacagacgtcgactatgactacaattccttttgtgcctcttgcgcatgggatgggccctcatcctcaactg

SEQ ID NO: 41811 - protein, 239 aa, Panicum virgatum
  misc_feature: Ceres CLONE 2009161
  misc_feature (36)..(238): Pfam Name: Peptidase_S10 Pfam Description: Serine carboxypeptidase
  misc_feature: SWISSPROT Homolog: EC 3.4.16.5 Carboxypeptidase C
MASPSPLLLALVSAALLLRTPGAAAAPEEHLVTGLPGFHGSFPSSHYSGYVTVDEASERSLFYYLALSERDPAADPVVLWLNGGPGCSSFDGFVYENGPFNFEPGSTLPRLQLNPYSWSKVSNIMYLDSPAGVGMSYSLNKSDYTTGDLKTAADAHTFLLKWFELYPEFQSNPFYISGESYAGVYIPTLADEVVKGIEKGVQPRINFKGYLIGNAFTDVDYDYNSFCASCAWDGPSSST

SEQ ID NO: 41812 - DNA, 564 bp, Panicum virgatum
  misc_feature: Ceres CLONE 2009171
  misc_feature: Encodes the peptide sequence at SEQ ID NO. 41813
actaccatcccctcgcgaaaaccctagcagctcggcgccgcctccccgctctccaacgccccctcaggtggcggcgcgttccttcaccctcccgctccccccccccccaaaccccccctttcctgatctcgtctgtcaatggccactgacgtttcgttccgcttgctcgctccaggtttttaacccccccttcgcggtcggccgggccctcgcagcgcgggagatggcggatcaggagaccccggttgcagtggaggcaccgacccctgttcttggggagccgatggacttgatgactgctctgcagctcgtcatgaaaaagtctggtgcccatgatggcctcgtaaagggtcttcgtgaggctgccaaggctattgaaaaacatgctgctcagctctgcgtgcttggtgaagactgtgaccagcctgattatgtcaagctggtgaaggctctctgtgctgagcacaatgttcacctggttactgtgcctaatgctaaaactcttggcgagtgggcagggctttgcaagattgactctgacgggaaggcaaggaaggttgtagg

SEQ ID NO: 41813 - protein, 113 aa, Panicum virgatum
  misc_feature: Ceres CLONE 2009171
  misc_feature (25)..(113): Pfam Name: Ribosomal_L7Ae Pfam Description: Ribosomal protein L7Ae/L30e/S12e/Gadd45 family
MADQETPVAVEAPTPVLGEPMDLMTALQLVMKKSGAHDGLVKGLREAAKAIEKHAAQLCVLGEDCDQPDYVKLVKALCAEHNVHLVTVPNAKTLGEWAGLCKIDSDGKARKVV

SEQ ID NO: 41814 - DNA, 673 bp, Panicum virgatum
  misc_feature: Ceres CLONE 2009178
  misc_feature: Encodes the peptide sequence at SEQ ID NO. 41815
gccgccttgcagaaaccctagagaccgctcgaggccgccgccgccgctctcgctctgctcttcttctccggctctctctccctcccggatcaaggatgaagtttgttgctgcctatctgcttgctgtcctcgctggcaaccccagcccgtctgccgaggatctatcgtccattctggaatcagttggctgtgaaattgacaatgaaaagatggagctgctgctgtcccaactgagcggcaaggacattaccgagctcattgctgctggcagggagaagtttgcttcggtcccatgcggtggtggtggagtggctgtggcagcaactgcccctgctgctggtggagctgctcctgcagctgaggccaagaaagaagagaaggtggaggagaaggaagagagtgatgatgacatgggcttcagcctcttcgactaagctgtgtggtcatcagagttgtgtcttttcggcaggaaaactagagtcgccatgtttggattttaactttgttttatgctgcaaagcacctgaaaagattgctactgccttgatatgtagtatttcagccgtaggttgctaggctggttggtgtttactggtgaaccagagtttatgcatcatatattgagaatcggttacccaattcattgctgttctctactgtgttgctctacggc

SEQ ID NO: 41815 - protein, 112 aa, Panicum virgatum
  misc_feature: Ceres CLONE 2009178
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MKFVAAYLLAVLAGNPSPSAEDLSSILESVGCEIDNEKMELLLSQLSGKDITELIAAGREKFASVPCGGGGVAVAATAPAAGGAAPAAEAKKEEKVEEKEESDDDMGFSLFD

SEQ ID NO: 41816 - DNA, 590 bp, Panicum virgatum
  misc_feature: Ceres CLONE 2009180
  misc_feature: Encodes the peptide sequence at SEQ ID NO. 41817
atccagctcaaacccacctgatctctgagctctcgagcacctttgtggcattgacattgccgtcctcctttggaggagctcgagctctgttggtgagcagaggggagggccgttgctgcgatcgccatggcggggcgcggcgcgttcgtggagaaggccaagccctacatcgccatgatctcgctgcagttcggctacgccggcatgaacgtgctcaccaaggtctcgctcaaccagggcatgagccactacgtgctcgtcgtctaccgccacgccttcgccacgctctccatcgccccgttcgccctcatcctcgagagaaaggtgaggcccaagatgacgtggtccatcttctggcagatcttcgtccttgcgatgctcggaccggtgatcgaccagaacttctactacgccgggctcaagttcaccggcccgaccttcgcctgcgcgatgagcaacatcctgccggccatgaccttcgtcatggcggtgatcttcaggatggagaagctggacatgaagaaggtgaggtgccaggccaaggtcgccgggacgctggtgacggtcgccggcgcgatgctgatgacgct

SEQ ID NO: 41817 - protein, 154 aa, Panicum virgatum
  misc_feature: Ceres CLONE 2009180
  misc_feature: Functional homolog of the protein sequence given in SEQ ID NO 50933
  misc_feature: Useful for making plants with modulated biomass
  misc_feature: Useful for making plants with modulated flowering time
MAGRGAFVEKAKPYIAMISLQFGYAGMNVLTKVSLNQGMSHYVLVVYRHAFATLSIAPFALILERKVRPKMTWSIFWQIFVLAMLGPVIDQNFYYAGLKFTGPTFACAMSNILPAMTFVMAVIFRMEKLDMKKVRCQAKVAGTLVTVAGAMLMT

SEQ ID NO: 41818 - DNA, 565 bp, Panicum virgatum
  misc_feature: Ceres CLONE 2009180-R
ctgaaagcaaaagggagccaaaacagcatgctccttcagaccctgcatcagcgccattgaaggtcgccccgaccacctctatgggacccaacagccccccttcaagaggcacattgagtgaatcatctggtggggctggaagcccaccaccactgcatcaaggcatggctgctagcaacagtaatcaaccaccaatcatgtccagcatgccctggaaatgatctctgcatccttgaccaaatccaggcaggctcagatctagattggcgaactgccttccaggaggaagtagcaatttgcgcttcaatagtgctcgttctctgactagcttatatgtagtgtaattcggagcttgagtagtgagagtactgtagccagaagtttgtagctctattgtaggtttcaccctgaattcatgtgctaggagctgtctgtcatctagagatgatgtactgagctttgtccatgtgatccttggcagtgttatcaaatgtttatttagttctatgttcaatcaaatgttataaagtcctatgttctaccaattcaaattgatttggggtgg

SEQ ID NO: 41819 - DNA, 678 bp, Panicum virgatum
  misc_feature: Ceres CLONE 2009188
  misc_feature: Encodes the peptide sequence at SEQ ID NO. 41820
agacttccagtcaattcgcccaattcgtctccgccgcctccgtcccgcgcacaagctgacaagcacaaaccccccttaaaccctaggccaaccggcggcgagcggcggacaccaccaatggaccccgacggcgtggcgagggcgttcgtggaccactactacacgacgttcgacaccaaccgggcggcgctggtggggctctaccaggagggctccatgctcaccttcgagggcgacaagttcatgggcgccgccgccatcacccaaaagctcacctcccttccgttcgccgcgtgcaaacaccaggtcaccaccgtcgactgccagccgtccggcggcggcggcggcatgctcgtcttcgtctccggcgcactgcaggtcggcgagggtgagcaccccctcaagttctctcagatgttccatttgatgccagttggaccagggaacttctacgtgcagaacgacatgttccgcctgaattatggctaagagccacgttcagaattttcgcgtagtttttctctttacgacggaagtcttagagaactttttggagaaacaatcaagttttgttatcgtgtcagatgatgtactgttttagtttagtttcagtgattttgtgatccattgcaaggaattttggattccaatacggatcagcacttcagaatgcccatt

SEQ ID NO: 41820 - protein, 123 aa, Panicum virgatum
  misc_feature: Ceres CLONE 2009188
  misc_feature (6)..(120): Pfam Name: NTF2 Pfam Description: Nuclear transport factor 2 (NTF2) domain
MDPDGVARAFVDHYYTTFDTNRAALVGLYQEGSMLTFEGDKFMGAAAITQKLTSLPFAACKHQVTTVDCQPSGGGGGMLVFVSGALQVGEGEHPLKFSQMFHLMPVGPGNFYVQNDMFRLNYG

SEQ ID NO: 41821 - DNA, 611 bp, Panicum virgatum
  misc_feature: Ceres CLONE 2009207
  misc_feature: Encodes the peptide sequence at SEQ ID NO. 41822
gtgatgtgttccaacctaatagtttggggttatgtatactttttcccttcttccgctcctcctttccccctctgctccattccattccccgaaaccaacccaaaccaccccaccgccaccgcctccgcctcgccgccggcgccatgaccggcgccgcggcccacgcggtggagccccgaggtggcgcctccgcgccccagccccccgctgcagcgaccgcggccgcggccaagggggcgggcgggcgcgagccggcgcggaaggcggcgcccgtgaccatggagcacgtcctcctcgcgctccacgagacggaggccgagcgggaggcgcggatccgggacatgttcgccttcttcgacgccgcggggcgcgggcagctcgactacgcgcagatcgaggcgggcctcgccgcgctgcaggtgcccgccgagtgcaagtacgcccgcgagctgttccgcgcctgcgaccgcgaccgcgacggccgcgtcggctacgacgacttccgccgctacatggacgacaaggagctcgagctctaccgcatcttccaggccatcgacgtcgagcacaacggctgcatcctccccgaggagctctgggacgcgctcgtc

SEQ ID NO: 41822 - protein, 155 aa, Panicum virgatum
  misc_feature: Ceres CLONE 2009207
  misc_feature (99)..(127): Pfam Name: efhand Pfam Description: EF hand
MTGAAAHAVEPRGGASAPQPPAAATAAAAKGAGGREPARKAAPVTMEHVLLALHETEAEREARIRDMFAFFDAAGRGQLDYAQIEAGLAALQVPAECKYARELFRACDRDRDGRVGYDDFRRYMDDKELELYRIFQAIDVEHNGCILPEELWDAL

SEQ ID NO: 41823 - DNA, 699 bp, Panicum virgatum
  misc_feature: Ceres CLONE 2009215
  misc_feature: Encodes the peptide sequence at SEQ ID NO. 41824
gcccgcccagcggccgccgcgcgagcgagcgatccgagccacggcgacatcgagcgatcctctcccacggaaccgcggacccatctccgagacagcggaggcatgctcgcccggctcgccgcggggcggcggcacctgcacctgcacccgcgcgccgccccggcgtacagttcgtcagcggcggcggcgcccgcctccgcctccgtgctcccggacacgctcgaccggggctccgacgcctacgcgcgcaacgccgccgccgtcgccgcgctgctcgccgacctgcgcgcccgcgtctcccaggtgctgcgcgggggtggcccggaggcggtgcggcggaacgcgtcgcgggggaagctgctcccgcgggaccgcatcgaccgcctgctcgaccccggcgcgtccttcctcgagctctcgcagcttgcaggttcggatgtttatgaagaagcattaccatcagcgggtataataactggcataggacctgttcatggacgattatgtatgtttgtggccaatgacccaattacaaaagggggcacatactatcctcttactgtaaaaaagcatctgcgagcacaggaaattgcttctgaatgcaaattgccttgcatatatctcgttgacagtggaggtgctaatctccccaggcaggctgaagttttccctgaccgtgataattttggtcgaatattc

SEQ ID NO: 41824 - protein, 198 aa, Panicum virgatum
  misc_feature: Ceres CLONE 2009215
  misc_feature: SWISSPROT Homolog: EC 6.4.1.4 Methylcrotonoyl-CoA carboxylase
MLARLAAGRRHLHLHPRAAPAYSSSAAAAPASASVLPDTLDRGSDAYARNAAAVAALLADLRARVSQVLRGGGPEAVRRNASRGKLLPRDRIDRLLDPGASFLELSQLAGSDVYEEALPSAGIITGIGPVHGRLCMFVANDPITKGGTYYPLTVKKHLRAQEIASECKLPCIYLVDSGGANLPRQAEVFPDRDNFGRI

SEQ ID NO: 41825 - DNA, 707 bp, Panicum virgatum
  misc_feature: Ceres CLONE 2009226
  misc_feature: Encodes the peptide sequence at SEQ ID NO. 41826
agctctactccaagagcactgtaccaccacgcactataatctaaaacctcaaacggaaaggaaaaaaaaggtgtcgctgatcatggtggccgtgcccaagatcgcgatggagtggctccaagaccctctgagctgggtgttgctggcgtctctggccttcgtcctcctgcagctgcggcggcggggcaaggcgccgctgccgccgggcccgaagccgctgccgatcatcgggaacatgatgatcatggaccagctgacccaccgcgggctggcggcgctggccgacctctacggcgggctgcttcacctccggctcggccagctgcacgcgttcgccgtgtcgacgcccgagtacgcgcgcgaggtgctgcaggcgcaggacggcgccttctccaaccgccccgccaccatcaccgtctcgtacctgacctacgaccgcgccgacatggcgttcgccaactacgggcccttctggcggcagattcgcaagctgagcgtgatgaagctcttcagccggcggcgcgccgagacgtgggcggcggtgcgcgacgagttggcggcgctggtccgcgccgtggcgtccgccggcgccggcgaggccgtgaacctgggcgagctcatcttcaacctgaccaagaacgtcaccttccgcgcggcgttcggcacccgcgacggcgaggaccaggaggagttcatcgccatcctcc

SEQ ID NO: 41826 - protein, 208 aa, Panicum virgatum
  misc_feature: Ceres CLONE 2009226
  misc_feature: SWISSPROT Homolog: EC 1.14.13.88 Flavonoid 3',5'-hydroxylase
  misc_feature: Functional homolog of the protein sequence given in SEQ ID NO 50717
  misc_feature: Useful for making plants with altered lignin content
  misc_feature: Functional homolog of the protein sequence given in SEQ ID NO 50718
  misc_feature: Useful for making plants with altered cell wall content and/or composition
MVAVPKIAMEWLQDPLSWVLLASLAFVLLQLRRRGKAPLPPGPKPLPIIGNMMIMDQLTHRGLAALADLYGGLLHLRLGQLHAFAVSTPEYAREVLQAQDGAFSNRPATITVSYLTYDRADMAFANYGPFWRQIRKLSVMKLFSRRRAETWAAVRDELAALVRAVASAGAGEAVNLGELIFNLTKNVTFRAAFGTRDGEDQEEFIAIL

SEQ ID NO: 41827 - DNA, 668 bp, Panicum virgatum
  misc_feature: Ceres CLONE 2009226-R
  misc_feature: Encodes the peptide sequence at SEQ ID NO. 41828
acgagaccgccgaggactgcgtcgtgggcggctactccgtgccccggggctcccgcgtcatggtcaacgtctgggccatcggccgcgaccgcggctcgtggaaggacgccgacgcgttccggccgtcgcggttcgcgccggggggcgacgccgcggggctcgacttcaagggcggctgcttcgagttcctgcccttcggctccggccgccgctcctgccccgggatggggctcggcctctacgcgctggagctcgccgtcgcgcagctcgcgcacggcttcagctggtcgctgcccgacggcatgaagccctcggagctcgacatgggcgacatcttcgggctcaccgcgccgcgcgccacgcggctctacgccgtgcccacgccccgcctcaactgccccttgtactgaatgacgagcgagctcgtggaggtacgggagtagcaagcgggtggacgcggcagactggatgttatttctattgtttttgtgtgtgtgttttcccttccctttggcttaaatcatgtctgatgctatgtatagggcaaacaataagggaattcttgcatgttcatggatagccgcgcgcatgcctagtagtgtaagaactcaagttgtataaattaaaatggatgctggtcactagttcgtggatttattttcatgtat

SEQ ID NO: 41828 - protein, 135 aa, Panicum virgatum
  misc_feature: Ceres CLONE 2009226-R
  misc_feature: SWISSPROT Homolog: EC 1.14.13.21 Flavonoid 3'-monooxygenase
  misc_feature: Functional homolog of the protein sequence given in SEQ ID NO 50717
  misc_feature: Useful for making plants with altered lignin content
  misc_feature: Functional homolog of the protein sequence given in SEQ ID NO 50718
  misc_feature: Useful for making plants with altered cell wall content and/or composition
  misc_feature: Functional homolog of the protein sequence given in SEQ ID NO 50304
  misc_feature: Useful for making plants with altered carbohydrate content
ETAEDCVVGGYSVPRGSRVMVNVWAIGRDRGSWKDADAFRPSRFAPGGDAAGLDFKGGCFEFLPFGSGRRSCPGMGLGLYALELAVAQLAHGFSWSLPDGMKPSELDMGDIFGLTAPRATRLYAVPTPRLNCPLY

SEQ ID NO: 41829 - DNA, 614 bp, Panicum virgatum
  misc_feature: Ceres CLONE 2009229
  misc_feature: Encodes the peptide sequence at SEQ ID NO. 41830
catctcctcagtagtacactcgctagctagctaagctgctatataaattaaattaaagctagtagtactgatcgatcggcatcgccggccggagatcgacatgacgacgatgatgaagaagcagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatctgtatctatacatacatacatacatacatatgatcgctcgctcgctcgatcgatcttagtcgtctacgtgtggcttgctgctgttcatccagccgctcgctacgtgtgtgtgtgtgcgcgtatacacacacacacgacggataaataaaagatgcatgggttgcctccgggccgctccct

SEQ ID NO: 41830 - protein, 95 aa, Panicum virgatum; identical to SEQ ID NO: 40288
  misc_feature: Ceres CLONE 2009229
  misc_feature (30)..(95): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass

SEQ ID NO: 41831 - DNA, 619 bp, Panicum virgatum
  misc_feature: Ceres CLONE 2009234
  misc_feature: Encodes the peptide sequence at SEQ ID NO. 41832
gcaacaacttgttgagagagatggtggccgccccgctccagctccgcaccagcaccggccgcctcagcttctcctcctcctcccccagcgcagcagccaggcggcgattcgcggcggtgcgggcgtcggcggaggcgatggccacggagaagctgggtatcagggtggagcgcaacccgcccgagtcccgcctctccgagctcggcgtccgccagtggcccaagtgggggtgcgagaagagcaagttcccgtggacctactcggccaaggagacgtgctacctgctgcaggggaaggtgaaggtgtacccggagggccacggggaggacttcgtggagatcgccgcgggggacctggtcgtcttccccaagggcatgagctgcacctgggacgtcgccgaggccgtcgacaagcactacaacttcgagtagccgcctgccgccgccgcccgcccatgccggactagcctggtatggaacgcagtagcagtaatttggtgaccgcctggtggggatgtttgaattgctcctgcttttccattcctgcctgcctgtagaccttctgtgctctgaaccagtgatgctccagtccagtgttaaacatcataataaagctctgg

SEQ ID NO: 41832 - protein, 136 aa, Panicum virgatum
  misc_feature: Ceres CLONE 2009234
  misc_feature (58)..(133): Pfam Name: Cupin_3 Pfam Description: Protein of unknown function (DUF861)
  misc_feature: Functional homolog of the protein sequence given in SEQ ID NO 50187
  misc_feature: Useful for making plants with modulated cold sensitivity
MVAAPLQLRTSTGRLSFSSSSPSAAARRRFAAVRASAEAMATEKLGIRVERNPPESRLSELGVRQWPKWGCEKSKFPWTYSAKETCYLLQGKVKVYPEGHGEDFVEIAAGDLVVFPKGMSCTWDVAEAVDKHYNFE

SEQ ID NO: 41833 - DNA, 677 bp, Panicum virgatum
  misc_feature: Ceres CLONE 2009236
  misc_feature: Encodes the peptide sequence at SEQ ID NO. 41834
acaacagtggcactaacagatcccagaaagtctagctacagcacttctccaacgaccccatagctccaagagatatccagatagggcgaagctgccattaattctcccggccggagctccaagatcgatggaggagctcggagaacatatggccggaccgccgtggcgtcttcggcatcgccggctcatggacatagcgccggcaagcccaagcgattcagggcattccggctccaaggggatgaccatcatggtgtcgatcctggtggtggtcatcgcctgcaccctcttctactgcgtctactgctggagatggaggaagcgcaacgctgtcaggagggctcagatagagaggctgcggccgctgtccaactcggacctgcccatcatggacctctcctccatccatgaggccaccaacagcttctccaaggagaacaagctcggcgaaggcggcttcgggcccgtttaccggggtgttcttgccggcggcgcggagatcgccgtgaagcggctgtcggcgaggtcccggcagggcgcggcggagttccggaacgaggtggggctgatcgccaagctgcagcaccggaacctggtccggctgctgggctgctgcgtcgagcgggacgagaagatgctcgtctacgagtacctccccaaccggagcctcgacgcct

SEQ ID NO: 41834 - protein, 183 aa, Panicum virgatum
  misc_feature: Ceres CLONE 2009236
  misc_feature: SWISSPROT Homolog: EC 2.7.11.1 Non-specific serine/threonine protein kinase
MEELGEHMAGPPWRLRHRRLMDIAPASPSDSGHSGSKGMTIMVSILVVVIACTLFYCVYCWRWRKRNAVRRAQIERLRPLSNSDLPIMDLSSIHEATNSFSKENKLGEGGFGPVYRGVLAGGAEIAVKRLSARSRQGAAEFRNEVGLIAKLQHRNLVRLLGCCVERDEKMLVYEYLPNRSLDA

SEQ ID NO: 41835 - DNA, 704 bp, Panicum virgatum
  misc_feature: Ceres CLONE 2009280
  misc_feature: Encodes the peptide sequence at SEQ ID NO. 41836
accaccgcgaaagcgaggaataacgagcaagcacagcaccccaaaggaaatggccacacggcccctcgcctccgcgctccccctctccaaaaccccaggcgccccctcctccggctcccaccactccccacctgcgctcgtccgccgcctccaaaccctagcccgcgcgctcgcgtcctcgcccccccaggccatggcgtcggccccggccccaaagaaggtgctggtccccatcgcgaacgggacggacccgatggaagcggtcatcaccatcgacgtgctccggcgcgcgggtgccgacgtcgccgtcgcatccgtcgagccgggctccgccaccgtcgcggcggcgtggggcgtcaagctcgccgccgacgcgctcctcgccgacatcgccgacgccgaattcgacctcatctctctccccggggggatgcctggggcctccacttttagagactgcaaacttttggagaatgtggttagaaaacatgtagagaagggcaagctttatgctgcgatatgtgctgcaccagctgtggctctaggaacatggggtttgcttaatggcttaaaggcaacatgttatccttcattcatggataaacttccttcagaggtgcatgctgtggaatcaagggtgcagattgatgggaagtgtgttaccagccgcgggccaggaacagccatggagtggtctgttgttt

SEQ ID NO: 41836 - protein, 170 aa, Panicum virgatum
  misc_feature: Ceres CLONE 2009280
  misc_feature (36)..(170): Pfam Name: DJ-1_PfpI Pfam Description: DJ-1/PfpI family
MASAPAPKKVLVPIANGTDPMEAVITIDVLRRAGADVAVASVEPGSATVAAAWGVKLAADALLADIADAEFDLISLPGGMPGASTFRDCKLLENVVRKHVEKGKLYAAICAAPAVALGTWGLLNGLKATCYPSFMDKLPSEVHAVESRVQIDGKCVTSRGPGTAMEWSVV

SEQ ID NO: 41837 - DNA, 634 bp, Panicum virgatum
  misc_feature: Ceres CLONE 2009286
  misc_feature: Encodes the peptide sequence at SEQ ID NO. 41838
tataatttggaacggagggagtagtcgcaaggtatagtcgtcggctcgcctaagcttcaagccatcagccaagtgcactactgctttgttgcttctcgggtcgccattgaaagtctcgccccagctccagcataaaaggggtaaaaacaacaccatcttctcggaagaatcagaggaaagctcatctcgccatggggaagctgctggcggagaggctgagggccttctccaggagccgatggctggtgctcgtggcggcagtgtgggtgcagtccatggccggcgtcgggtacctcttcggcgccatctcgccggcgctcaaggccgccctcgggtacgaccagcggcagctggccgcgctggccgtcgccaagaacctcgggggctacgtcggcgtcgtcgccggcacgctctcggccgcgctgccggcgtgggcgatgctgctcatgggcgccgcgcagaacctcctcggctacggctggctctggctcatcgtcgacggccgggcgccggcgctgcccatctcgatgatgtgtgttctcatatttgttggaaccaacagcgcgacgtacttcaacacagcttcgctcgtcacatgcatccagaacttcccaacgagcaggggcccaatggt

SEQ ID NO: 41838 - protein, 147 aa, Panicum virgatum
  misc_feature: Ceres CLONE 2009286
  misc_feature (16)..(147): Pfam Name: Nodulin-like Pfam Description: Nodulin-like
MGKLLAERLRAFSRSRWLVLVAAVWVQSMAGVGYLFGAISPALKAALGYDQRQLAALAVAKNLGGYVGVVAGTLSAALPAWAMLLMGAAQNLLGYGWLWLIVDGRAPALPISMMCVLIFVGTNSATYFNTASLVTCIQNFPTSRGPM

SEQ ID NO: 41839 - DNA, 643 bp, Panicum virgatum
  misc_feature: Ceres CLONE 2009286-R
ctctgagatcattgtcagggagtatgggtacccgaggcacatagcactggcaatcgctcagatcctgattgctgccgcgcatttcctcttcgccatggcttggcctggaacgatgcacatcgggaccttcctggtcggactcggatacggagctcattgggcgatcgtgccggctgctgtctctgaactcttcggcgcaaaacacttcggcgccatgtacaattttctcgcactggcgaaccccacgggatcgctcatcttctcaggtctcattaccagcaccctgtatgactacgaagccgagaaacaagctcgccagcatcaggtcacggcgttgctgtctccaagattgtttcagggtacgggatttcttacaggtggatcactgaagtgtgaaggggccgtttgcttctttgtcagctcgttgataatgtcagggctctgcattgttggagccgggttgagcctcatcgttgtccacagaaccagacgggtttatgctgacctctatcggcctgtccgaacatgaaattttcatggatagaagatactgccaaaccctcgtgctgctgttctatgtacaatataatatccttcgtagagaaaaacctgcatataatggcatgcacacagatttatgatc

SEQ ID NO: 41840 - DNA, 685 bp, Panicum virgatum
  misc_feature: Ceres CLONE 2009300
  misc_feature: Encodes the peptide sequence at SEQ ID NO. 41841
tcctttccaagaagaaaaagagagagagagagataaagtagtcgcccggtcgccctcttcccctctctctgttagtcgtccccaacctcctcagctagggtttccacccatggcggcgcccaccacctcccgccgcggccccggcgccgcccgcaacatggacgacgaaaacctcaccttcgagacctccccgggggtcgaggtcgtcagcaccttcgaccagatgggaatcaaggacgacctcctccgcggcatctacggctacggcttcgagaagccctccgccatccagcagcgcgccgtcctccccatcatcaacggccgtgacgtcatcgcgcaggcccagtccgggacgggcaagacgtccatgatctccctcaccgtctgccagatcatcgacaccgccgtgcgcgaggtgcaggctttgatcctctcacctactagggagcttgcttcacagacggagaaagttatgctggctattggtgactacctcaacatccaagtgcatgcttgcattggtggaaaaagtattggtgaggatatcaggaggctggagaatggggtgcatgttgtctcaggaacaccaggcagagtctgtgatatgatcaagagaaggaccctgcgaacaagagccatcaagcttctagttctggatgaggctgatgagatgttgagcagaggc

SEQ ID NO: 41841 - protein, 191 aa, Panicum virgatum
  misc_feature: Ceres CLONE 2009300
  misc_feature (58)..(191): Pfam Name: DEAD Pfam Description: DEAD/DEAH box helicase
  misc_feature: Functional homolog of the protein sequence given in SEQ ID NO 51085
  misc_feature: Useful for making plants with altered alkaloid content
  misc_feature: Useful for making plants with altered lignin content
MAAPTTSRRGPGAARNMDDENLTFETSPGVEVVSTFDQMGIKDDLLRGIYGYGFEKPSAIQQRAVLPIINGRDVIAQAQSGTGKTSMISLTVCQIIDTAVREVQALILSPTRELASQTEKVMLAIGDYLNIQVHACIGGKSIGEDIRRLENGVHVVSGTPGRVCDMIKRRTLRTRAIKLLVLDEADEMLSR

SEQ ID NO: 41842 - DNA, 701 bp, Panicum virgatum
  misc_feature: Ceres CLONE 2009308
  misc_feature: Encodes the peptide sequence at SEQ ID NO. 41843
agcattaaccagcagctcgcacacacgcgccgcggccggccactccgtgaggcccccccccccccccccgcccgcccgcgccgcgcgagagagaacagccgggcatgcagcgcctcgcctcctcccggaggctcctccgggccgcgctcgcccccgccagggccaactccagcctctccgcggccgtcgccgcggcgcccgcggtggagaatggcgccgccgcgcccccgaagatgccggccttcgactacacgccgccgccctacgacggcccgcgggccgaggagatcttccggaagcgggccgagttcctcagcccgtccctcttccacttctacgaccgccccttgaacatagttgatggaaagatgcagtacctatttgatgaggatggtcgtcgttacctggatgcttttggtggcattgcaacagtttgctgtggccactgccatcctgatgtggttgaagccatcgtaaaccaggcaaagaggatccaacactccacagttctgtatctcaatcatgccattgcggattttgcagagtcattggcatccaaaatgcctggggatttgaaggtagttttcttcacaaattcaggcacggaggcgaatgagctcgcactgatgattgcacgtctttacactggttgcaatgacattatctcccttaggaatggataccatgggaatgctgctggg

SEQ ID NO: 41843 - protein, 198 aa, Panicum virgatum
  misc_feature: Ceres CLONE 2009308
  misc_feature: SWISSPROT Homolog: EC 2.6.1.44 Alanine--glyoxylate transaminase
MQRLASSRRLLRAALAPARANSSLSAAVAAAPAVENGAAAPPKMPAFDYTPPPYDGPRAEEIFRKRAEFLSPSLFHFYDRPLNIVDGKMQYLFDEDGRRYLDAFGGIATVCCGHCHPDVVEAIVNQAKRIQHSTVLYLNHAIADFAESLASKMPGDLKVVFFTNSGTEANELALMIARLYTGCNDIISLRNGYHGNAA

SEQ ID NO: 41844 - DNA, 745 bp, Panicum virgatum
  misc_feature: Ceres CLONE 2009330
  misc_feature: Encodes the peptide sequence at SEQ ID NO. 41845
tgattgcaccttgtgatttactagtttaattcgtttattctgctgatgatgtcttgcatgcgattcctggagatgatgccagttttcctgattgtttataggaagcaatccaaccgagaatcagctaggcgttcaagaagcagaaaggcagctcacttgaatgaactggaggcacaggtagcacagctaagagttgaaaactcttcactgttaaggcgccttgcagatgttaatcagaagtttaatgaggctgctgttgacaatagggtgctaaaggcagacgttggaaccttaagagcaaaggtgaagatggcagaggactcggtgaagcgggtgacaggcatgaacgctttgttccctgccggatctgatatgtcatccctcagcctgccattcaacggctccccatctgactccacctccgacgctgctgtccccatccaagatgacccgaacagttactttgctagtccaagtgagattggaggtaacaacggttacatgccagagatggcttcctcggctcaagaggatgacgattttgtcaacgcagccctggctgctggcaagatggacagaacagcctcactgcagcgggtggcgagcctggagcacctccagaagaggatgtgcggagggccagcttcatctgggtcaacctcctagacgtatgctccattgggataatttgacaatttcaacatacattgtagtggacattgatgttgatttgttcgttgtggac

SEQ ID NO: 41845 - protein, 205 aa, Panicum virgatum
  misc_feature: Ceres CLONE 2009330
  misc_feature (18)..(73): Pfam Name: bZIP_1 Pfam Description: bZIP transcription factor
  misc_feature: Functional homolog of the protein sequence given in SEQ ID NO 50961
  misc_feature: Useful for making plants with modulated endosperm cell number
  misc_feature: Useful for making plants with modulated endosperm size
  misc_feature: The sequence is a functional homolog of SEQ ID NO 1232 in the 10/412,699 US patent application
  misc_feature: The sequence is a functional homolog of SEQ ID NO 926 in the 10/374,780 US patent application
  misc_feature: Functional homolog of the protein sequence given in SEQ ID NO 51607
  misc_feature: Useful for making plants with altered alkaloid content
  misc_feature: Useful for making plants with altered terpenoid content
  misc_feature: The sequence is a functional homolog of SEQ ID NO 1120 in the 11/479,226 US patent application
  misc_feature: The sequence is a functional homolog of SEQ ID NO 486 in the 10/412,699 US patent application
  misc_feature: The sequence is a functional homolog of SEQ ID NO 812 in the 10/412,699 US patent application
MSCMRFLEMMPVFLIVYRKQSNRESARRSRSRKAAHLNELEAQVAQLRVENSSLLRRLADVNQKFNEAAVDNRVLKADVGTLRAKVKMAEDSVKRVTGMNALFPAGSDMSSLSLPFNGSPSDSTSDAAVPIQDDPNSYFASPSEIGGNNGYMPEMASSAQEDDDFVNAALAAGKMDRTASLQRVASLEHLQKRMCGGPASSGSTS

SEQ ID NO: 41846 - DNA, 673 bp, Panicum virgatum
  misc_feature: Ceres CLONE 2009332
  misc_feature: Encodes the peptide sequence at SEQ ID NO. 41847
accacacgccgaggcttgctcttcttcttcttcttgttgttgttgatagaaaaatagaattcaggggcagccggggcccgagatcggcgaggccggccgtgcttgctgctcgcgccattgacacatcgtccatctgctagcgcagaggtagcgaggtaggtagcaatggagacccgggacagcgccccctccaccacgccgctcccctactcctactcgccgctgccggccgccgaggtctccggcgcccgcgcccgccggaggccgctctgcgccgccgcgctcgtgctgtccgccgcgctgctgctcctcgccgtcgcggcgctggccggcgtccgcatcgcgcccccgcggcccatcgcggtgggagagacggcggcggcggcgaggagcaggggccccgcggccggcgtgtcggagaagacgtccggcgcgtcgggggtgctgcttggcgagggcggcggcaacgccttcccctggagcaacgcgatgctgcaatggcagcgcacgggattccacttccagccgcacaagaactggatgaacgatcccaacggccctgtgtactacaagggttggtaccacctcttctaccagtacaaccccgacggcgccatctggggcaacaagatcgcgtggggccacgccgtgtcccgcgacctggtccactggc

SEQ ID NO: 41847 - protein, 169 aa, Panicum virgatum
  misc_feature: Ceres CLONE 2009332
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
METRDSAPSTTPLPYSYSPLPAAEVSGARARRRPLCAAALVLSAALLLLAVAALAGVRIAPPRPIAVGETAAAARSRGPAAGVSEKTSGASGVLLGEGGGNAFPWSNAMLQWQRTGFHFQPHKNWMNDPNGPVYYKGWYHLFYQYNPDGAIWGNKIAWGHAVSRDLVHW

SEQ ID NO: 41848 - DNA, 675 bp, Panicum virgatum
  misc_feature: Ceres CLONE 2009338
  misc_feature: Encodes the peptide sequence at SEQ ID NO. 41849
gtcccgaaccgaaccaaatcttagcagtacacgccacacgcccacaccaccacagagttgctgcgcaaccctagctagagcaccctcgctcgcagtgtctcccacgatggcatcgtcgctctgtgtattcgcggcgatgtccggcggcgccgccgggcggcctggcagtggcggggcggtgcccggtcgtctggcgaccggccagcaggggggcagcaagggcaagcgggccgtggcgcagcctctcgcggctagcgccgcgacggagacgccgacgccggccgtagtagccccggccccgccaggtcggcccgccgtcttcgacgccccgcgccgccgtggaggccgcggcgccggcagcgggcacgcggcgtggaagagcgtccggcaggagaggtgggagggggccctggagctggaaggggagctgccgctctggctggacggcacgtacctgaggaacgggccgggcctgtggaacctcggcgactacggcttccggcacctgttcgacgggtacgcaacgctggtgcgcgtctcgttccgcaacgggcgcgcggtgggcgcgcaccggcagatcgagtcggaggcgtacaaggcggcgcgcgcgcacggcaaggtgtgctaccgcgagttctccgaggtgcccaagccggacagcttcctctccggcgt

SEQ ID NO: 41849 - protein, 189 aa, Panicum virgatum
  misc_feature: Ceres CLONE 2009338
  misc_feature: SWISSPROT Homolog: EC 1.14.99.36 Beta-carotene 15,15'-monooxygenase
MASSLCVFAAMSGGAAGRPGSGGAVPGRLATGQQGGSKGKRAVAQPLAASAATETPTPAVVAPAPPGRPAVFDAPRRRGGRGAGSGHAAWKSVRQERWEGALELEGELPLWLDGTYLRNGPGLWNLGDYGFRHLFDGYATLVRVSFRNGRAVGAHRQIESEAYKAARAHGKVCYREFSEVPKPDSFLSG

SEQ ID NO: 41850 - DNA, 727 bp, Panicum virgatum
  misc_feature: Ceres CLONE 2009354
  misc_feature: Encodes the peptide sequence at SEQ ID NO. 41851
aaaaagctccagaaacaactaaccgcgaagcaacaagttgaaggcggcggcggcgatggggagcgacacggagacggagaagaagaagaccccgctggcgctagcacccatcgcgaagcccctcgcaggcaagaagctctgcaagcggaccctaaagctcgtgcgccgagcctccgaggccaagtgcctgaagcggggagtcaaggaggtggtcaagagcatccgccgtgggaacaaagggctttgtgtgatcgctggaaatatttctcctattgatgtgattacacatgttccaatactttgtgaggaagctaatgttccttacatatatgttccgtcgaaagaggaccttgcgaccgcaggaaccactaagaggccaacttgttgcgtcttggttctgaccaaaccaaccaagggggagctcagtgaagaggtgaaggagaagctgaagtcagactatgaccaggttgtgacggaagtcgctgaggctacatctgcaatgttctgagaacaattccaggaccacagtatctgagaatcaggcaacatatttgcatagtatgtaacatcatgacaagcctgcctttcttgtgaactgcaccggtgtgttatcaagggtacagctggagagttgatcatctatgttatggactacccttggggatagtacaattattatataaattaggcaatttataatgatttggggagcagattggttcccagt

SEQ ID NO: 41851 - protein, 150 aa, Panicum virgatum
  misc_feature: Ceres CLONE 2009354
  misc_feature (30)..(124): Pfam Name: Ribosomal_L7Ae Pfam Description: Ribosomal protein L7Ae/L30e/S12e/Gadd45 family
MGSDTETEKKKTPLALAPIAKPLAGKKLCKRTLKLVRRASEAKCLKRGVKEVVKSIRRGNKGLCVIAGNISPIDVITHVPILCEEANVPYIYVPSKEDLATAGTTKRPTCCVLVLTKPTKGELSEEVKEKLKSDYDQVVTEVAEATSAMF

SEQ ID NO: 41852 - DNA, 1754 bp, Panicum virgatum
  misc_feature: Ceres CLONE 2009355
  misc_feature: Encodes the peptide sequence at SEQ ID NO. 41853
attctcgcagcaaagttttgagtcgacagcgataaccaggaatacaaccccatcgccacgaacacttcgaccaacaaactagtcaccatgtctcaccttgccagcgagcccgagtttgagcaggcctacaaggagctcgtccttactctcgaaaacagctccctcttccagaagaaccccgagtaccgcactgcgctcaaggtcgtctcgatccccgagcgtgtcatccagttccgcgtcgtttgggaggatgatgccggcaacctccaagccaaccgtggctaccgtgtgcagttcaactcggctctcggcccttacaagggcggcctgaggttgcacccctctgtcaacctgtcgatcctgaagttcctcggtttcgagcagatcttcaagaatgcgctcacaggcctgatgatgggtggtggcaagggtggagccgacttcgaccccaagggaaagagtgacgccgagatccgccgcttctgcgtcgccttcatgcgcgagctctccaggcacattggtgccgacaccgacgttcccgccggcgatattggtgtgtcgggccgcgaaatcggctacatgttcggcgcctaccgccgcgagcgtaacaagttcgagggtgtcctcaccggcaagggcctcgactggggtggatcgctcatccgccccgaggctmccggctacggtttggtgtactatgtcacccacatgctcgagctcgctggcgtcggcaactgggaaggcaagcgcgtcgccatctcgggctccggcaatgttgcgcagtacgctgctctgaagtgcatcgagctcggcgccaccatcgtctcgctttccgactccaagggctcgcttgtggcggttggcgacggccacgtcacggttgaggatatcgagtccatcatggacttgaaggtgaagcgccagtcgctttcttcctacaccaccaagggcaacctccagtacatcgagggcgtccgcccgtggctccacgttggccaggttgacgttgctctcccctgcgcgacccagaacgaggtcagcaaggaggaggctgagggcctggtcgccgctggcgccaggttcgttgccgagggctccaacatgggctgcacgctcgaggccatcgaggtgttcgagaacgagcggcgggcgaagaagggcaatgccatctggtacgcccccggcaaggccgccaactgcggtggtgtcgccgtctcaggtctcgagatgtcgcagaacagccagcgcctggcgtggaccaaggaggaggtcgaccagaagctgaaggacatcatgaagaacgccttcgacctcggtgtcgcgaccgccaagaactacgtcgagtcgagcgagggcgagctccccagcttggtcgccggtagcaacattgccggtttcgtcaaggtcgcccaggccatgcacgagcacggtgactggtggtgaacgggcggtggcaatcaatcggatttggcggagtgcggcgtctctgatgctccagtgctttctcagaccggtcgatgaaccgttttcccgtattttttctgctttctttttccctttactgcacttttctttcggtcggcgttttttggggtgttcccatcaggatggagttgggatcggacgagttaacgacatgattccctgggttaactggctgtgggttgtcgataccttggtttcttgattcaagcgagagagcgaatggaggtatagagggatctgctttttacatagcaatgaaaccatttatt

SEQ ID NO: 41853 - protein, 451 aa, Panicum virgatum
  misc_feature: Ceres CLONE 2009355
  misc_feature (188)..(448): Pfam Name: ELFV_dehydrog Pfam Description: Glutamate/Leucine/Phenylalanine/Valine dehydrogenase
  misc_feature (43)..(173): Pfam Name: ELFV_dehydrog_N Pfam Description: Glu/Leu/Phe/Val dehydrogenase, dimerisation domain
  misc_feature: SWISSPROT Homolog: EC 1.4.1.4 Glutamate dehydrogenase (NADP(+))
  misc_feature (197)..(197): Xaa is any aa, unknown, or other
MSHLASEPEFEQAYKELVLTLENSSLFQKNPEYRTALKVVSIPERVIQFRVVWEDDAGNLQANRGYRVQFNSALGPYKGGLRLHPSVNLSILKFLGFEQIFKNALTGLMMGGGKGGADFDPKGKSDAEIRRFCVAFMRELSRHIGADTDVPAGDIGVSGREIGYMFGAYRRERNKFEGVLTGKGLDWGGSLIRPEAXGYGLVYYVTHMLELAGVGNWEGKRVAISGSGNVAQYAALKCIELGATIVSLSDSKGSLVAVGDGHVTVEDIESIMDLKVKRQSLSSYTTKGNLQYIEGVRPWLHVGQVDVALPCATQNEVSKEEAEGLVAAGARFVAEGSNMGCTLEAIEVFENERRAKKGNAIWYAPGKAANCGGVAVSGLEMSQNSQRLAWTKEEVDQKLKDIMKNAFDLGVATAKNYVESSEGELPSLVAGSNIAGFVKVAQAMHEHGDWW

SEQ ID NO: 41854 - DNA, 624 bp, Panicum virgatum
  misc_feature: Ceres CLONE 2009359
  misc_feature: Encodes the peptide sequence at SEQ ID NO. 41855
ctctgtaaccgagtcctgaacccgatctcctgctcctcccctgcagctaacgcccacccacctgtcccgatggccgccgcctccgagctggtcacccccctgaaacgcccgttcgggagcgacgggctcggcgacggcaacaacatcaacggcggcctcaacatcggcgggggcgtcgcgctgggctgtgacgacgacaaacctaaggtgcggtggcgcgaggcggacccggcggcggcgctggccgtggcgcggctcgaattcggagagcacagcggcgtgaacgtgtccatcttggcatcggcgacgttcacagtgatggagccggacactatgcggcggttgttagcgggggagatggggcccgaccgcggcgacatgtacatctaccgccggcacttcaacccgactgagctggtgctggggcggtatatggcgtctctggagggcatcgacgccgcctactgcacggtgtctgagatgtcctccatctcctctgtgctgatgcagctggtgggcgcgggcgggcacgtggtggagacgaggtgcctgtacagctgcactcacgctctgctgtcctggttcgtgccgcgggcgtccagggtgcgctttcacgttcgtgga

SEQ ID NO: 41855 - protein, 184 aa, Panicum virgatum
  misc_feature: Ceres CLONE 2009359
  misc_feature: SWISSPROT Homolog: EC 4.4.1.11 Methionine gamma-lyase
MAAASELVTPLKRPFGSDGLGDGNNINGGLNIGGGVALGCDDDKPKVRWREADPAAALAVARLEFGEHSGVNVSILASATFTVMEPDTMRRLLAGEMGPDRGDMYIYRRHFNPTELVLGRYMASLEGIDAAYCTVSEMSSISSVLMQLVGAGGHVVETRCLYSCTHALLSWFVPRASRVRFHVR

SEQ ID NO: 41856 - DNA, 697 bp, Panicum virgatum
  misc_feature: Ceres CLONE 2009360
  misc_feature: Encodes the peptide sequence at SEQ ID NO. 41857
gcgtttctgaagctcccaaaggccaaatccgaatccacccattcccaaccctagatccctccccgcttccggcgaagcccacctccgatcctttgctatctggaagcgcccgacagaagggcccgtctctgcgttcgccgaggatgagttctaaatgcaggaggagccatagtccagttgaatgcaaggaaggtcgtgataaatattatgaaagttcgggaaggaatgatgactcaagcaatgccagaccagtcagaggttatgaatccaggcacagtgataggactttctatggaccatcacgtgaatcaaggaggcatgatgatgatgatgatgataggaggtatcatgataagcatgctggtgattatgggaggagtcattcaagagcctctcggtcagattgtgaaccaaaggctgatacctactatgatcgttctaagcgtgacagcacatctggtagacctcgtggggatcagcgagatgctgacagtaggtatggagagagatctgtttatcgagagccgaggagcatgagtgatggaaagcaagcgtcccctcgtaaccataaaaagtatgatggtcgagagtatgatagatatgcagatgcaagaaagcctgttgagaaaagagattattatagggctggtgataaggacagggaaatcaaggaggaggttgttaagaagagaaacgg

SEQ ID NO: 41857 - protein, 184 aa, Panicum virgatum
  misc_feature: Ceres CLONE 2009360
  misc_feature: SWISSPROT Homolog: EC 2.1.1.56 mRNA (guanine-N(7)-)-methyltransferase
MSSKCRRSHSPVECKEGRDKYYESSGRNDDSSNARPVRGYESRHSDRTFYGPSRESRRHDDDDDDRRYHDKHAGDYGRSHSRASRSDCEPKADTYYDRSKRDSTSGRPRGDQRDADSRYGERSVYREPRSMSDGKQASPRNHKKYDGREYDRYADARKPVEKRDYYRAGDKDREIKEEVVKKRN

SEQ ID NO: 41858 - DNA, 923 bp, Panicum virgatum
  misc_feature: Ceres CLONE 2009379
  misc_feature: Encodes the peptide sequence at SEQ ID NO. 41859
gtaaacggcaccgactcccaaccggaagagccgagccgagccaagtcgcctcgtctcctccccgtctccctcctccccaaacctcccctcgcctctgacccaggctagggttccgccccacccggcccggccccaccccgcccgatccgatccgatggacgccggcgactcctccggcgccggcggagccgacggcgcggcggccgcggcggccaagtggcggagcgacgcgtcgcgggcgttccagtactacctggaccgctccacgccgcacgccacggggcggtggctcgggacgctcgccgccgccgccatctacgcgctgcgggtctacatggtgcagggcttctacatcgtcacctacgggctcgggatctacctcctcaacctcctcatcggcttcctctcccccatggtcgacccggagctcgacccctccgccgccgccgagggcccggccctgcccacccggggctccgacgagttcaagcccttcatcaggcgcctccccgagttcaagttctggtatgcaatcacaaaagcttttgttatagcttttgtgatgactttcttctctgtgtttgatgttcctgtcttctggcccatactcctttgctactgggttgttctcttcgcccttacgatgaagcgccagattgtgcatatgatcaagtacaaatatgtgcccttcagtattgggaagcagaaatatggtgggaagaagagtggcccaagcagtggttccccaagagactgatccagacctaccctgtaggaagcatggcaggggaacaaaatacggtggatggtgatatttgatgtgctaaataccaaatgtaatacttcattcatatctagaggtagacggatattcgctcctgtttctgacttgggttcacagtttaatttgatattgcgcgcag

SEQ ID NO: 41859 - protein, 200 aa, Panicum virgatum
  misc_feature: Ceres CLONE 2009379
  misc_feature (5)..(189): Pfam Name: Rer1 Pfam Description: Rer1 family
MDAGDSSGAGGADGAAAAAAKWRSDASRAFQYYLDRSTPHATGRWLGTLAAAAIYALRVYMVQGFYIVTYGLGIYLLNLLIGFLSPMVDPELDPSAAAEGPALPTRGSDEFKPFIRRLPEFKFWYAITKAFVIAFVMTFFSVFDVPVFWPILLCYWVVLFALTMKRQIVHMIKYKYVPFSIGKQKYGGKKSGPSSGSPRD

SEQ ID NO: 41860 - DNA, 691 bp, Panicum virgatum
  misc_feature: Ceres CLONE 2009392
  misc_feature: Encodes the peptide sequence at SEQ ID NO. 41861
aaaccctccgcccccgagcgcgccgccgccatgaggccgctcgacgagaaggagacgacgcaggttttcgagaagctcttcaagttcacgggccccaacctgaagcacctcctggagcggcccgccgtggaggggcccgacccggagccgggccgctactgcctccgcctccacaagaaccgcgtctactacgcctccgaggcgctcgtgcgccgcgccaccgccgtcgcccgcccgcgcctcgccgccgtgggcacccccatcggcaagttcacccaccacggcgcgttccacctcaccgtccacgcgctcgacctcctggcggcgcacgcgcgccgccgcgtctggctcaagcccgacagcgagcgctccttcctcttcgggaactccgtgcccaagtcctccctcgcccgcatcaccgagaacaccaaggcaggcgacggcgtcgtcgtcatgtccatggccgacgtgcctctcggcttcggcatcgccgcgaggtccgcgcaggactgcaggaaagccgacaccaacgccgtcgtcgtgctgcaccaggctgacgccggggagtacctccgcaaggaggaggagctcatgtgaggtgatatgtctggtgagccttattcagaatttgaggtctcctgtaagttttggagcttttcaactagttcaacgaaaagtggagatgaatatc

SEQ ID NO: 41861 - protein, 188 aa, Panicum virgatum
  misc_feature: Ceres CLONE 2009392
  misc_feature: Functional homolog of the protein sequence given in SEQ ID NO 51641
  misc_feature: Useful for biocontainment applications
  misc_feature: Useful for making plants with modulated biomass
MRPLDEKETTQVFEKLFKFTGPNLKHLLERPAVEGPDPEPGRYCLRLHKNRVYYASEALVRRATAVARPRLAAVGTPIGKFTHHGAFHLTVHALDLLAAHARRRVWLKPDSERSFLFGNSVPKSSLARITENTKAGDGVVVMSMADVPLGFGIAARSAQDCRKADTNAVVVLHQADAGEYLRKEEELM

SEQ ID NO: 41862 - DNA, 684 bp, Panicum virgatum
  misc_feature: Ceres CLONE 2009395
  misc_feature: Encodes the peptide sequence at SEQ ID NO. 41863
tcttgtcctcgccttgccgtcctcaattccctcggcctccttccggccttccctgtgctgtgctgtgcggtgacttgtcctctaccggggggctgccgggctgctgttgactggaggagagatccattcgtccgcacccctcttcttttgccgcatcatgtcggagacgaaggactctaacactgctgctcttgatggaaatcctgaacctatggatcaaagtgaagacaattctatgccatcagctcagcagcaggaagaagcaatcaagaagaagtttggtggactaatgcccaaaaagccaccactcatctcaaaggatcatgagcgggcctactttgattctgctgattgggctctaggaaagcaaggtgttgccaaacccaaaggacccctggaggcacttaggccaaagctgcagccaacacgccaacagcaacaacaacgtgcaaggcgctctatttacacttcgtcagaaaacgaggacggtgatagcgctggtgctgaggatatgaacatcaactgaagtggccctggaatctgcaggacgtgctgcgttgttggagaattcagttacttcgagcaggcagcccgctttcggtcgtcgtgtgggttgatggatataagaaaatcctcgttatcgagtgttgtgttgcgtttcccccattgatggacataggtgac

SEQ ID NO: 41863 - protein, 122 aa, Panicum virgatum
  misc_feature: Ceres CLONE 2009395
  misc_feature (38)..(121): Pfam Name: Lg106 Pfam Description: Lg106-like protein
  misc_feature: Functional homolog of the protein sequence given in SEQ ID NO 50181
  misc_feature: Useful for biocontainment applications
MSETKDSNTAALDGNPEPMDQSEDNSMPSAQQQEEAIKKKFGGLMPKKPPLISKDHERAYFDSADWALGKQGVAKPKGPLEALRPKLQPTRQQQQQRARRSIYTSSENEDGDSAGAEDMNIN

SEQ ID NO: 41864 - DNA, 1871 bp, Panicum virgatum
  misc_feature: Ceres CLONE 2009405
  misc_feature: Encodes the peptide sequence at SEQ ID NO. 41865
acccatccataccttattgctcgctctatagtaccggccggccagctaatactattactctctacagctagcagctagctccttaactgaggatcgacgatggccggcggcgccatcgtgaacacggccgggggcaaggactaccccggcaagctcaccctcttcgtcttcttcacctgcgtcgtggccgccaccggaggcctcatcttcggatatgatatcggtatctcaggcggcgtgacctccatggaccctttcctgaagaagttcttcccggaggtgttccggaagaagcaggaggccaagaccaaccagtactgcaagtacgacaaccagctgctgcagaccttcacctcgtcgctctacctggccgcgctcgtcgcctccttcttcgccgccaccgtcacccgcgtcatgggccgcaagtggtccatgttcggcggcggcctcaccttcctcatcggcgcagcgctcaacggcgctgccaagaacgtcgccatgctcatcgtcggacgcatcctcctcggaatcggagtcggattcgccaatcagtctgttccggtgtacctgtcggagatggcgccggcgcggctccgcggcatgctcaacatcgggttccagctgatgatcaccatcggcatcctggcggcggagctcatcaactacggcaccaacaagatcaaggccgggtacgggtggcgcgtgagcctggcgctggcggcggtccccgccggcatcatcacgctgggctccctcttcctgcccgacacccccaactcgctgctggagcgcgggcacgccgacgaggcccggcgcatgctccgccggatccgcggcacggaggagatcggcgaggagtacgcggacctggtggcggcgagcgaggaggcgcggcaggtgcgccacccgtggcgcaacatcctcaagcgccgctaccgggcgcagctgaccatggcgatcatgatccccttcttccagcagctcaccggcatcaacgtcatcatgttctacgcgccggtgctgttcgagacgctgggcttcaagggcgacgcctccctcatgtcctccatcatcaccggcctcgtcaacgtgttcgccaccgtggtgtccatcttcaccgtcgaccggctggggcggcgcgcgctcttcctgcagggcggcacccagatggtggtctgccaggtggtggtggggacgctgatcgccgccaggttcgggaccagcggcgtcggcgacatgcccaagggctacgcggcggtggtggtgctcttcatctgcgtctacgtggcgggcttcgcctggtcgtggggcccgctggggtggctggtgccgtcggagatcttcccgctggagatccggccggcggggcagagcatcaacgtctccgtcaacatgttcttcaccttctgcatcgcgcaggccttcctcaccatgctgtgccacctcaagttcggcctcttctacttcttcgccggctgggtcgtcatcatgaccgtcttcatcggcctcttcctgccggagaccaagaacgtgcccatcgaggagatggtgctcgtctggaagtcgcactggttctggaaaaggttcatcgccgacgaggacgtgcacgccggcggcagccaactgcagatggcatcctccaacaacggcaacggcaagaagggggccgacgcctgattgatcgatgatgattgtattgtacatgcggatccccctccccttccttctttagacgtacgtacttcgccaatgctgcaaggcaaccaattctctcagttcttcttcttcttggcttgtgatccatccatccatgcttgctcttcccccccttccaagatagattattccatcgagtattaatctgtttgtgc

SEQ ID NO: 41865 - protein, 525 aa, Panicum virgatum
  misc_feature: Ceres CLONE 2009405
  misc_feature (26)..(487): Pfam Name: Sugar_tr Pfam Description: Sugar (and other) transporter
MAGGAIVNTAGGKDYPGKLTLFVFFTCVVAATGGLIFGYDIGISGGVTSMDPFLKKFFPEVFRKKQEAKTNQYCKYDNQLLQTFTSSLYLAALVASFFAATVTRVMGRKWSMFGGGLTFLIGAALNGAAKNVAMLIVGRILLGIGVGFANQSVPVYLSEMAPARLRGMLNIGFQLMITIGILAAELINYGTNKIKAGYGWRVSLALAAVPAGIITLGSLFLPDTPNSLLERGHADEARRMLRRIRGTEEIGEEYADLVAASEEARQVRHPWRNILKRRYRAQLTMAIMIPFFQQLTGINVIMFYAPVLFETLGFKGDASLMSSIITGLVNVFATVVSIFTVDRLGRRALFLQGGTQMVVCQVVVGTLIAARFGTSGVGDMPKGYAAVVVLFICVYVAGFAWSWGPLGWLVPSEIFPLEIRPAGQSINVSVNMFFTFCIAQAFLTMLCHLKFGLFYFFAGWVVIMTVFIGLFLPETKNVPIEEMVLVWKSHWFWKRFIADEDVHAGGSQLQMASSNNGNGKKGADA

SEQ ID NO: 41866 - DNA, 716 bp, Panicum virgatum
  misc_feature: Ceres CLONE 2009407
  misc_feature: Encodes the peptide sequence at SEQ ID NO. 41867
cgataccctgcggccgagctcgcagctgtctggagcgagaccggcgggagcaaaggaagaatggcgacggccggcggcagacgggtcatcacttgttacggcgccgccgtgctgctcgccgcggcgctgctgctctccgcaccggacgccacagaggcttatgattccttggatccaaacggcaacatcactataaaatgggacgtcgtgcaatggactcctgatggatatgttgctgttgtcacaatgtacaattaccaacaattccggcacattggagcacctgggtggcagctggggtggacatgggcaaaggaggaggtcatctggtcgatggctggggctcaggccaccgagcagggtgactgctcacgtttcaagggcaacattccccacagctgcaagaaagatcccgtggtcgttgatttacttccagacactccgtacaacatgcagatagcaaactgctgcaaagcaggagtgataagtgcgtttactcaggacccggcaaatgctgccgcctccttccagcttagtgtaggtcttgttgggactaccactaaggccgttaagctgccaaggaacttcactcttaggactcctggtcccgggtacacctgtgggcgtgctatcgttggcaagcctagtgtgtttttcaccgcggatgggcgcagggcaccccgggcttttaacattctctgcatgtgcagtgacat

SEQ ID NO: 41867 - protein, 218 aa, Panicum virgatum
  misc_feature: Ceres CLONE 2009407
  misc_feature (57)..(218): Pfam Name: Phytochel_synth Pfam Description: Phytochelatin synthetase-like conserved region
  misc_feature: Functional homolog of the protein sequence given in SEQ ID NO 51355
  misc_feature: Useful for making plants with altered carbohydrate content
  misc_feature: The sequence is a functional homolog of SEQ ID NO 4 in US patent 7109001
  misc_feature: Functional homolog of the protein sequence given in SEQ ID NO 51356
  misc_feature: Useful for making plants with altered cell wall content and/or composition
  misc_feature: Functional homolog of the protein sequence given in SEQ ID NO 50602
  misc_feature: Useful for making plants with altered lignin content
MATAGGRRVITCYGAAVLLAAALLLSAPDATEAYDSLDPNGNITIKWDVVQWTPDGYVAVVTMYNYQQFRHIGAPGWQLGWTWAKEEVIWSMAGAQATEQGDCSRFKGNIPHSCKKDPVVVDLLPDTPYNMQIANCCKAGVISAFTQDPANAAASFQLSVGLVGTTTKAVKLPRNFTLRTPGPGYTCGRAIVGKPSVFFTADGRRAPRAFNILCMCSD

SEQ ID NO: 41868 - DNA, 1132 bp, Panicum virgatum
  misc_feature: Ceres CLONE 2009409
  misc_feature: Encodes the peptide sequence at SEQ ID NO. 41869
aaagaggcagcgaaccgcaaccgtctttctcgcgaggcagcctcctccttcctcgtcgccggcgacctcgcccgccgccgctaccgagatgccggtgagggtggtggacaccgcaactccatcgtcgcagccctccccaggccaagagacaaattctgtacacccatctcctcctagctgttcactcctaagtgccggaagatgttttgctggaactcagaatgtttcgagtctgcagaaggatgaagcatggaaagttaatgtgcgcatccatggttgtgatcttgaacagggttatttatgtggaacaatggaagcgcttaatgttccattagcagatactcctgtagtgacattctgggagggggagatagtagatgctaaaaattacacatttttcactggcaaatgggaagcatcaccagaggacgatataagacactggtccaagttcccatcatttacacctcttctgagtcaggttgagacagatggtggcaagtcgttagaccttagcaactatcctcatatatttatgagatggaaggagcaatattttgtcaatgttggagttgactgtgggttaaccatcgctggtttttactacgtctgcttttcttgtagcgatggatccattagtggcttttattatgatccaagtagcagtccatttcagaagcttgaactgaagtgtaccaatgagaaaaattctggattcacattttcgtcctatgagctacagtgacaggcttgatgcatctgatggccgacttcctgttaggaatcagattcatttaggaatacgatgggctggttgtaaactcttctgtcttatcatgtgcagtccatttcaaaagctggaactgaagtgtaccaataagaaaaagaaaaatctggattcaccttttcatcctatgagcttcagggacagggacagagacagggttaatgcatccaatggccgactttcagacaaggctaatgcatcctctgtgtgtgtgtgtgtgtgtgtgttcctagtgttgttgtattaaaagaaatgagactgtatgtgtatgtaacagttatttccagcaagactaagcaaccttttgctttgtgatcttattgaaagcagcatcttttcttgtct

SEQ ID NO: 41869 - protein, 218 aa, Panicum virgatum; identical to SEQ ID NO: 18934
  misc_feature: Ceres CLONE 2009409
  misc_feature: Functional homolog of the protein sequence given in SEQ ID NO 50829
  misc_feature: Useful for making plants with modulated low light sensitivity

SEQ ID NO: 41870 - DNA, 920 bp, Panicum virgatum
  misc_feature: Ceres CLONE 2009412
  misc_feature: Encodes the peptide sequence at SEQ ID NO. 41871
aacgcctcccctctccagtctccactccagtactccaccgcactcctcacccacccacccacctcagcagcctcggcggagcggcgccatcgatccatggagttctacgtcgacgagaagtggaagttctccaagaagagccggaacaacgggagccggcgcgtcccgggcgccggggctggcggcggggaccatttcctcaagcggtcgtccagcatgcgggacggcgtccaggcgatcggcaggcgcgggagcagcgccggcgccgcggcgggcggcgggtgcggcgcgccgcagccgtccttctccagccggtgcgcggggctcgtcaaggagcagcgcgcgcgcttctacatcatgcgccgctgcgtcaccatgctcgtctgctggaaggactgctcgtagccgccgcggccggccggcgaagaagctcggccccgctccctcccctcgtcctcccaccccgcagtttctccgccaagatcagagtgtcacgctcacgcacgggggcacaagcaaagcgagtggcgcggggaagaaggcggattattaggtgatgtgtgtatagatcagtcctgaatcctgatagcgagtcctcctcttcttcttctttttttacctcccgtttctgggatgttttgttgattactagcgctcgattaggtagtactccgtagtgaatagtacagtacttagtgctgcgatgtagatgtggaatcgtggacagttttgggatctcctccttcaaggagatggggatctgggttctttacagctgcagatgcttgctgccaaggagccatccatcacaggcatcaggcaggcagctgaatgaaacctagtggatcttctgttgtaccacgaccacggtgaaaaagaaatgttttcactgcccatgtatagctaaacaaatcagacac

SEQ ID NO: 41871 - protein, 102 aa, Panicum virgatum
  misc_feature: Ceres CLONE 2009412
  misc_feature (79)..(97): Pfam Name: DVL Pfam Description: DVL family
MEFYVDEKWKFSKKSRNNGSRRVPGAGAGGGDHFLKRSSSMRDGVQAIGRRGSSAGAAAGGGCGAPQPSFSSRCAGLVKEQRARFYIMRRCVTMLVCWKDCS

SEQ ID NO: 41872 - DNA, 780 bp, Panicum virgatum
  misc_feature: Ceres CLONE 2009430
  misc_feature: Encodes the peptide sequence at SEQ ID NO. 41873
attggcgcacctttcttctttctgtagacagtctgtaaatctttttcttgctgggggaggggtcagggaggagagaccaagaagcagaacagagaaggagaagaagcttgtgttctcaggccatatggagatccagcagccccggggggttggcaattcgaaggtcgtgaaggttcagagcgaggaggcatgggagctattcaccaatcaagcaagcaacgaagggcgccatgttgttgcccatttcggggcatcatggtgtgtgacatccctgtctatgaactacaagtttgaggagctagctcagacccaccctgagatcttgtttctctatgttgatgttgacgatatccagagtgtttcatccaagtacggagtgaaggccatgccgacatttttcctcatcaagaacaaggaggtggtgaggaagatcgttggggcgaatccagatgagttgaagaagctggtggatgcttctactgattccttcgaaactcagatagtcgtcgaatagccgttcgtcgccatcatgtcctctgaaactgctctgtgagtgaccgtgagcactgcctggtcaggtcttctgaatcgcgtctggatgttccaaactgtacattgtcgtgcttgtgactctgatgggcgtcgctttagtcttgcctgttggtcctgcaactgtgacagcagtagtgtgtgtgactctgatctttttttaaaagaatgtgactctgaatgttgcatgcgtttggggttgaaaaataaaaaataaagatcgcttgaagc

SEQ ID NO: 41873 - protein, 129 aa, Panicum virgatum
  misc_feature: Ceres CLONE 2009430
  misc_feature (14)..(118): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MEIQQPRGVGNSKVVKVQSEEAWELFTNQASNEGRHVVAHFGASWCVTSLSMNYKFEELAQTHPEILFLYVDVDDIQSVSSKYGVKAMPTFFLIKNKEVVRKIVGANPDELKKLVDASTDSFETQIVVE

SEQ ID NO: 41874 - DNA, 689 bp, Panicum virgatum
  misc_feature: Ceres CLONE 2009435
  misc_feature: Encodes the peptide sequence at SEQ ID NO. 41875
agtacccgcacactgccagccagtgctcttccgctgctagagcgagcaccgagcagcagcgcacagcagcgtcgaggggagaggaagtgagctccagcccgctcgctctctccggccggtgcctcgtttccttgccgctgcgcgcctcggcaagctgcagctagtggccatgggtggtggcgcggcggtggcggtgctggccggtgtggcgtcggcggccgtgtacgaggtgggcgacaaggccgggtggaccgtcatgggcaaccccaactacgccgcctgggccagctccaagaagttccatgtcaacgacgtcgtcgtgttcacgtacaacaagcagttccacaacgtggtggcggcgagcaaggcggactacaagaactgcgatgccagcaagccgatcgccacctggtctacgggcaacgactccgtcgtcctcaagaccgcgggccaccactacttcctctgcggcttcccgggccactgcgccgccggccagaaggtggacatccgcatcgccgcctcctctgatgccccttccgcggcgcccacccccgagcccgcagccggcggcggctccaagccctccagtggcgccacggccgcgccggcgccgcaccccaacgccgcgccccaggccctccccgcaggcagctccgtcgccgccaccgtcgccgcgtcgctgctct

SEQ ID NO: 41875 - protein, 173 aa, Panicum virgatum
  misc_feature: Ceres CLONE 2009435
  misc_feature (27)..(110): Pfam Name: Cu_bind_like Pfam Description: Plastocyanin-like domain
MGGGAAVAVLAGVASAAVYEVGDKAGWTVMGNPNYAAWASSKKFHVNDVVVFTYNKQFHNVVAASKADYKNCDASKPIATWSTGNDSVVLKTAGHHYFLCGFPGHCAAGQKVDIRIAASSDAPSAAPTPEPAAGGGSKPSSGATAAPAPHPNAAPQALPAGSSVAATVAASLL

SEQ ID NO: 41876 - DNA, 713 bp, Panicum virgatum
  misc_feature: Ceres CLONE 2009442
  misc_feature: Encodes the peptide sequence at SEQ ID NO. 41877
attttttccggccccctcttcctcgcgcggcgcctgccccccctgccggttggaagcgtgcgaagaagcagcgcggagagatggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaacctgtgcgccatccatgctaagcgtgtgaccatcatgcccaaggacattcagctggccaggaggatccgtggcgagagggcttaatcatgatcatgacaatcaaaatctcgtgtcgtagtagtggtttaatgtggtgccatgttcggacatcagtagggcttgttttgtggatcataagtttctcttctgcagcactatatgttgcgactaccgttgttggggttattactagggtcgtcgaatacttaattgtctcgtctagtgttgttaccgcgttgacagtttgaaaaaaaaaaaaaaaaaaaa

SEQ ID NO: 41877 - protein, 136 aa, Panicum virgatum; identical to SEQ ID NO: 9871
  misc_feature: Ceres CLONE 2009442
  misc_feature (58)..(132): Pfam Name: Histone Pfam Description: Core histone H2A/H2B/H3/H4

SEQ ID NO: 41878 - DNA, 754 bp, Panicum virgatum
  misc_feature: Ceres CLONE 2009444
  misc_feature: Encodes the peptide sequence at SEQ ID NO. 41879
atcgaaagctgcttcacgtacatacaccaatcgatcgattgcaattgcaattgcaagcagcagcggcatcgacgatcgataataatagtaatggagggcaaggaggaggatgttcggctgggcgccaaccggtactctgagcggcagcccatcggcacggaggcgcagggcaccgaggagaaggactacaaggagcctcccccggcgccgctgttcgaggcggaggagctggcgtcgtggtccttctaccgcgccggcatcgccgagttcgtggccaccttcctgttcctctacatcagcatcctgacggtgatgggcgtgagcaagtcgtcgagcaagtgcgccaccgtgggcatccagggcatcgcctggtccttcggcggcatgatcttcgcgctcgtctactgcacggcgggcatctccggcggccacatcaacccggcggtcaccttcggcctcttcctggcgcgcaagctctcgctcacgcgcgcgctcttctacatggtgatgcagtgcctgggcgccatctgcggcgccggcgtcgtcaaggggttccagcaggggctctacatgggcgccggcggcggcgccaacgccgtcaacccgggctacaccaagggcgacggcctcggcgccgagatcgtcggcaccttcgtcctcgtctacaccgtcttctccgccaccgacgccaagcgcagcgcgcgcgactcgcacgtgcccatcctggcgccgcttcccatcgggttccccgtct

SEQ ID NO: 41879 - protein, 221 aa, Panicum virgatum
  misc_feature: Ceres CLONE 2009444
  misc_feature (46)..(221): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANRYSERQPIGTEAQGTEEKDYKEPPPAPLFEAEELASWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQQGLYMGAGGGANAVNPGYTKGDGLGAEIVGTFVLVYTVFSATDAKRSARDSHVPILAPLPIGFPV

SEQ ID NO: 41880 - DNA, 1419 bp, Panicum virgatum
  misc_feature: Ceres CLONE 2009449
  misc_feature: Encodes the peptide sequence at SEQ ID NO. 41881
cccaacgcaaacccactcactcatcccgttcctgagagcggcgccccccgatctctttttctcttctcttctcttcccttccgcatccgccggccgctccgggtccctcccccgccggaaagatcccggctttcttgggttcccgtccggggtttacttccaggatttgtctggctcggaaccagtcctgaagctgcaaagttcccccacatccccaataattgaccctcttctatctccaaatggcagcatgattgcatatgttaaggatgatgaactgcataccttgggtttctctaatggagaaaccaagcaattaactttcggtgcaagagaaagtaggaagatccacggacttgccgagtatattgcacaggaagagatggaaaggaagatgggattctggtggtctcctgatagcaagcaccttgcatttactgaagtggattcaactgagattccactgtatagaattatgcatcagggtaaaagttacgttggtccagatgctgaagaagaccatgcatacccctttgcgggtgcagctaatgttaaagtgcgacttggtgttgttgcttccaatggaggagaagtaacttggatggatctgctttgtggagatccacatggtccccacagtgacgaagaatatctggctagagtcaactggatgcacaataatgctgttgctgttcaagttcttaacagatctcacacaaaacttaaattgcttaagtttgatattaatacgggtaaaagggaactcttactagaagaacaacatgatacatgggtcacattgcatgattgtttcaccccgctagacaaaggagcgaatagtaaacatccaggtggttttatttgggccagtgaaaagacaggattcaggcacttgtatgttcatgacaaaaatggtgtgtgcttagggccccttacacaaggtgagtggatggttgaacaaattgctgctgtcaatgagagtaatgggcttatatatttctgtggcacactggatggaccattggagacaaatttgtaccaaaccaatctctttcccgattggagccttcccttgcaaccctctaaaaggttgactcatggaaccggccggcattcagtaattcttgatcatcagttgctgagatttattgatgtatacgactcaataaaatctccacctgtgatcttactgtgctctttacttgatggaagtgtaattatgcccctttttgagcagccatcgacaattccgtcacttaaaaagttccagcagctgtctccggagatagttgaaattacagcgaaggatgggaccactttatatggcactctctacctgcctgatgagagaaaatatgggccacctccctacaaaacattggttagtgtttatggtggccctggtgttcagcttgttag

SEQ ID NO: 41881 - protein, 472 aa, Panicum virgatum
  misc_feature: Ceres CLONE 2009449
  misc_feature (37)..(393): Pfam Name: DPPIV_N Pfam Description: Dipeptidyl peptidase IV (DPP IV) N-terminal region
  misc_feature: SWISSPROT Homolog: EC 3.4.14.5 Dipeptidyl-peptidase IV
  misc_feature: Functional homolog of the protein sequence given in SEQ ID NO 50528
  misc_feature: Useful for making plants with modulated salt sensitivity
PTQTHSLIPFLRAAPPDLFFSSLLFPSASAGRSGSLPRRKDPGFLGFPSGVYFQDLSGSEPVLKLQSSPTSPIIDPLLSPNGSMIAYVKDDELHTLGFSNGETKQLTFGARESRKIHGLAEYIAQEEMERKMGFWWSPDSKHLAFTEVDSTEIPLYRIMHQGKSYVGPDAEEDHAYPFAGAANVKVRLGVVASNGGEVTWMDLLCGDPHGPHSDEEYLARVNWMHNNAVAVQVLNRSHTKLKLLKFDINTGKRELLLEEQHDTWVTLHDCFTPLDKGANSKHPGGFIWASEKTGFRHLYVHDKNGVCLGPLTQGEWMVEQIAAVNESNGLIYFCGTLDGPLETNLYQTNLFPDWSLPLQPSKRLTHGTGRHSVILDHQLLRFIDVYDSIKSPPVILLCSLLDGSVIMPLFEQPSTIPSLKKFQQLSPEIVEITAKDGTTLYGTLYLPDERKYGPPPYKTLVSVYGGPGVQLV

SEQ ID NO: 41882 - DNA, 703 bp, Panicum virgatum
  misc_feature: Ceres CLONE 2009449-R
  misc_feature: Encodes the peptide sequence at SEQ ID NO. 41883
aagtaagggtatactagtttggaagatgaataatcgtggatccgcaaggagaggactgcattttgagggacatctaaagtacaacattggtcgtgttgatgctgaagatcaattggaaggggccgagtggttaataaagaaaggccttgcaaaacctggccatattggtatatatggttggagctatggcgggtttctgtccgcaatgtgcctcgcaaggtttccagatacattctgttgtgcggtgtctggtgctccagtgacggcatgggatggttacgataccttttacactgagaagttcatgggtctcccctccgagcatcccgatgcttatgagtatgggtcgatcatgcatcacacaaagaacctgaaagggaaactgctcctcatccacgggatgattgatgagaacgtgcattttaggcacacagcgaggcttatcaactcgctgatggcggagggcaaggcttatgagatcctcctcttccctgacgagaggcacatgccacgccggctcggtgaccggatctacatggaggagaggatctgggattttgtagagaggagcctttgaaagaacgcttgtataaattcaattgcccattgtgggctgggattgggatgtttttggcacatgcattcagttcttttttcattcccacctgtaatttatctacaagcgaagttattttgattcttt

SEQ ID NO: 41883 - protein, 191 aa, Panicum virgatum
  misc_feature: Ceres CLONE 2009449-R
  misc_feature (1)..(190): Pfam Name: Peptidase_S9 Pfam Description: Prolyl oligopeptidase family
  misc_feature: SWISSPROT Homolog: EC 3.4.14.5 Dipeptidyl-peptidase IV
  misc_feature: Functional homolog of the protein sequence given in SEQ ID NO 50528
  misc_feature: Useful for making plants with modulated salt sensitivity
SKGILVWKMNNRGSARRGLHFEGHLKYNIGRVDAEDQLEGAEWLIKKGLAKPGHIGIYGWSYGGFLSAMCLARFPDTFCCAVSGAPVTAWDGYDTFYTEKFMGLPSEHPDAYEYGSIMHHTKNLKGKLLLIHGMIDENVHFRHTARLINSLMAEGKAYEILLFPDERHMPRRLGDRIYMEERIWDFVERSL

SEQ ID NO: 41884 - DNA, 697 bp, Panicum virgatum
  misc_feature: Ceres CLONE 2009473
  misc_feature: Encodes the peptide sequence at SEQ ID NO. 41885
acatggcgatgacgccgccgcctcctgctgctgctgatccggccgcagccgcgcacagcgtcttcgtgtacgggagcctcatggcggacgaggtcgtgcgcgccatcctcaagcgcgtcccgcccgccgccccggcgcttctccccaactaccaccggttcaacatcaagggccgtatttatccggcgatcctgcccgccgagagcaagaaagttgcaggaatggttatcatgggtgttactgacgaagagctccggcttctggatgcatttgaagatgtggagtacacgaggacaagagtcgagatatcgttagctgacccttcggagaaaatgctggctgacacatatgtgtggagcgacgcagaggatccaaatctgtatggcgaatgggattttgaggagtggaagaagctacatatgaaggattttctcgctatgaccaatggtttcatgcacgaaatcgaacagcctgaagccaagacccgggtcgagacctaccagtcattcatgcaacaacaggaacagccagcatcggagacccaggttgagggttgagacctgcagttctgctggtcgttctcaggaagaattgtactcctactagcactgggctttactatctgtaataagttgcctgcatgatttgtgaataatatcttttatggatcaccgtataaaatatcataacagttaca

SEQ ID NO: 41885 - protein, 184 aa, Panicum virgatum
  misc_feature: Ceres CLONE 2009473
  misc_feature (20)..(119): Pfam Name: AIG2 Pfam Description: AIG2-like family
MAMTPPPPAAADPAAAAHSVFVYGSLMADEVVRAILKRVPPAAPALLPNYHRFNIKGRIYPAILPAESKKVAGMVIMGVTDEELRLLDAFEDVEYTRTRVEISLADPSEKMLADTYVWSDAEDPNLYGEWDFEEWKKLHMKDFLAMTNGFMHEIEQPEAKTRVETYQSFMQQQEQPASETQVEG

SEQ ID NO: 41886 - DNA, 1275 bp, Panicum virgatum
  misc_feature: Ceres CLONE 2009474
  misc_feature: Encodes the peptide sequence at SEQ ID NO. 41887
gttctgcccacacagcgttgtcataccacgctctctctctctctcggaaagaaaaaactaaaaaaaaaaagagaggggagctccgagctctgtctctctctctcgttcgtggccttgttgcatgcccagttgccgcaaagctacaaagtctcgtgtcggggccggatccctctctcgcgaaccagccagtaaacaactccaccgcagctcggctgcctcttcgaccggtagagcggaggcggcggcgggagtgaggagaggagcatgaggcgggcgccacctccattcccgttccggtgctcttccgtcttgctcctcctgctcctgctgctgctggcgtcctccccgtggtcggccagtgggaggcccgcgccgggggcttcgcctgtcgccgaccacattcgtgccgccgccgctggcgccgccaatgggaccgcctccttcgctccggcggcgccggcgccggctcccgtagtgatcatcgtggagcggcgccaccatttccaccgtgagcttgtcatcgcctccgccctcacctccgtcgccatcgtcgcgatcatcctctccacgttctatgcgtgggtcctctggcggcggtctcgccgcctgccagacggcaaggcctacaggagctcaggcactgcaagggggatcatgctggtgccaatcctgagcaagttcagctcattcaagacgagcaggaaggggcttgtggcgatgatcgagtacccggtgctggaggcggcgacggggaagttcagcgagagcaacgtgctcggtgtcggcggcttcggctgcgtctacaaggcggtgttcgacggcggagttaccgctgcggtcaagaggctggaaggcggtgggccggagtgcgagaaggaattcgagaatgagctggatttgcttggcaggattcggcaccccaacattgtgtccctgctgggtttctgtgttcatgaggggaatcactacattgtttatgagctgatggagaagggatccctggatacacagctgcacgggccttcacatggatcagccctgagctggcacatccggatgaagatcgcgctcgacatggcaaggggattagagtatcttcatgagcactgcagtccaccagtgatccatagggatctgaaatcatctaacatacttttagattcagacttcaatgccaagatttcagattttggtcttgcagtgaccagtgggaatattgacaagggaagtatgaatctttctgggaccttgggctatgtagctcctgaataccta

SEQ ID NO: 41887 - protein, 336 aa, Panicum virgatum
  misc_feature: Ceres CLONE 2009474
  misc_feature (165)..(335): Pfam Name: Pkinase_Tyr Pfam Description: Protein tyrosine kinase
  misc_feature: SWISSPROT Homolog: EC 2.7.11.1 Non-specific serine/threonine protein kinase
MRRAPPPFPFRCSSVLLLLLLLLLASSPWSASGRPAPGASPVADHIRAAAAGAANGTASFAPAAPAPAPVVIIVERRHHFHRELVIASALTSVAIVAIILSTFYAWVLWRRSRRLPDGKAYRSSGTARGIMLVPILSKFSSFKTSRKGLVAMIEYPVLEAATGKFSESNVLGVGGFGCVYKAVFDGGVTAAVKRLEGGGPECEKEFENELDLLGRIRHPNIVSLLGFCVHEGNHYIVYELMEKGSLDTQLHGPSHGSALSWHIRMKIALDMARGLEYLHEHCSPPVIHRDLKSSNILLDSDFNAKISDFGLAVTSGNIDKGSMNLSGTLGYVAPEY

SEQ ID NO: 41888 - DNA, 662 bp, Panicum virgatum
  misc_feature: Ceres CLONE 2009474-R
  misc_feature: Encodes the peptide sequence at SEQ ID NO. 41889
tttggagtagtgcttctgaagctgctaatgggaagaaagcctgtcgagaagatgagtcaaactcagtgccaatcaattgtgacatgggccatgccgcaactgactgacagatcaaaactccccaacatagttgacccagtgatcagggacacgatggacccaaaacacctgtaccaagttgcagcagtggctgttctatgcgtgcaaccagaacctagttacagaccactgatcaccgatgttctccactccctagttcctctagtcccggtggagcttggagggacactgagggttgcagagccgccttccccaaacctaaaacattctccttgttgagatgtcctcatcggttgaagcagagcacacagattcatgctgatgtacttggattgctgtttaccgtataacttattgtcttagttgcgtgcctgagaatgacagttccaacctgctggttgttggttggatcgacagggaattctggtttgaaaagagttgccttctatgttatacaaagaagtgaaagaaaaaacaacactcttttctttagaacttagtgtcctgctgtacaaatcaaagcttctccaaacactgtaactcaaaagaattggagaaagttgtgtttttggctccacatgggtaccaaaacactttggttt

SEQ ID NO: 41889 - protein, 112 aa, Panicum virgatum
  misc_feature: Ceres CLONE 2009474-R
  misc_feature: SWISSPROT Homolog: EC 2.7.11.1 Non-specific serine/threonine protein kinase
FGVVLLKLLMGRKPVEKMSQTQCQSIVTWAMPQLTDRSKLPNIVDPVIRDTMDPKHLYQVAAVAVLCVQPEPSYRPLITDVLHSLVPLVPVELGGTLRVAEPPSPNLKHSPC

SEQ ID NO: 41890 - DNA, 1651 bp, Panicum virgatum
  misc_feature: Ceres CLONE 2009480
  misc_feature: Encodes the peptide sequence at SEQ ID NO. 41891
aaaatcgaaatgtccctctccctgacctcatcgcattaccttgtcttcctgatcctcctacctctgctcctcctcctacccctcatctacctgctgtaccagcgccatgaccgtccctgcaagaagctgcagcctcgcggagaagatgacctcaagtcctacccactcctcgggaggctcccccacctggtcaagaaccagcaccgcctgctcgaatggtcggtccatgtcgcgaggcgaagcccgacgcacaccgcaaccttcaaagccgccggcctgcccggcgttgtcatcaccgccaaccacgagaacctcgagcacatagccaagacaagcttcgccaactaccccaagggcgactacttgctgtccacgatcagggacctgctcggccacggcctcttcaactccgacggcgaccagtggctgtggcagcgcaaggccgccagctatgagttcagcaagcgctcgctgaggaagttcatcgccgacaccgtccggtccgaggtcgtcggccggcttctgccgctgctggaacaggccgccgccgggcggcgcacgctggacatgcagcgcgtcttcgagtgcttcgcgttcgacaacatctgccacgtggccttcggcgaggacccggcgtgcctcggcgccatggagggcacggcggcgacgccgccgccggcctccgtggagttcatgcgcgccttcgacgacgttcagaacgccatggttctccgtttccggccgccggaaagcatgctgtggcgtctgaagaggatgctcggcatcgggtccgagaggcaggtccgtcaggcgctcgacgtcgtccgcggctacgccgacacgatcgtccggaggtgccgggagagaggggggagcagcaggggcgacttcctggcgcacttggtcgccgctcgcggggatgatctcagccaggagagcctccgggacgtcgtcaccaacttcctcctcgccgggcgcgacacgacgtcctccgcgctgacatggttcttctggctggtctccggccggccggacgtcgaggacaagatcgtgcgtgaggtccgcgcgctaagatcctcatccatccatgggggtggcggcggcggcggcacgggcacggcgacgttcagcttggacgagctccgggagatgcactacatccacgccgccatcaccgagtcgatgcggctgtacccgccggtgggcatggggatgcactgcagcaagcgggacgaccgcctgccggacggcacgtacgtggggaaagggtgggtggtgaaccactccatgtacgccatggcgcggctggagagcttgtggggcgaggactgcgaggagttcaggccggagaggtggctccgggaagacggcacgttccagccggagagcccggcgaagtacccggtgttccatgtggggccaaggatgtgcctcggcaaggagatggcctacatccagatgaagtccatcgtgtcctgcgtcttcgagaggttcggcttccggttccttggcggtgaggagcgccccgggctagacttgtccttcacgctgcggatgaaaggcggtttgccgatgcaagtgaccaagcggccggccggaaccagctgagaagctgctgtaacctccgtttcaaattatagtttgtttaatc

SEQ ID NO: 41891 - protein, 532 aa, Panicum virgatum
  misc_feature: Ceres CLONE 2009480
  misc_feature (42)..(524): Pfam Name: p450 Pfam Description: Cytochrome P450
  misc_feature: SWISSPROT Homolog: EC 1.14.14.1 Unspecific monooxygenase
MSLSLTSSHYLVFLILLPLLLLLPLIYLLYQRHDRPCKKLQPRGEDDLKSYPLLGRLPHLVKNQHRLLEWSVHVARRSPTHTATFKAAGLPGVVITANHENLEHIAKTSFANYPKGDYLLSTIRDLLGHGLFNSDGDQWLWQRKAASYEFSKRSLRKFIADTVRSEVVGRLLPLLEQAAAGRRTLDMQRVFECFAFDNICHVAFGEDPACLGAMEGTAATPPPASVEFMRAFDDVQNAMVLRFRPPESMLWRLKRMLGIGSERQVRQALDVVRGYADTIVRRCRERGGSSRGDFLAHLVAARGDDLSQESLRDVVTNFLLAGRDTTSSALTWFFWLVSGRPDVEDKIVREVRALRSSSIHGGGGGGGTGTATFSLDELREMHYIHAAITESMRLYPPVGMGMHCSKRDDRLPDGTYVGKGWVVNHSMYAMARLESLWGEDCEEFRPERWLREDGTFQPESPAKYPVFHVGPRMCLGKEMAYIQMKSIVSCVFERFGFRFLGGEERPGLDLSFTLRMKGGLPMQVTKRPAGTS

SEQ ID NO: 41892 - DNA, 653 bp, Panicum virgatum
  misc_feature: Ceres CLONE 2009486
  misc_feature: Encodes the peptide sequence at SEQ ID NO. 41893
ctaccatttcccctacagccggcggcgagaaatcgaatcgagcgcgagcagccggcggcgatggcgtggcgtggcatcctgtcccggagcgtgaaggagatccgcgtcctcttctgccagtcctccccggccagcgccgccgccagggagttcgtgaagaagaactacggggatatcaagtcgcgcaacccctcgctccccttcctcgtgcgcgagtgctccggcgtccagccccagctctgggcgcgatacgaaatgggtgtggagagatgcgtaaacttggatggcctgacggaagcgcagattgataagaagctggaggagctcgccaaggcgggagagtctgccaaagccaagtaatattgaaggtctgacaatctctctccattaatgttcacaaataagtgaaactttagcagtgggtttcttgctgtcatgacttcggtgctaatactgaaatgaagcctttttttttagaccgagtgaaatgaagtcttgggtttgtataacttgatgcgagaaagactgttcacttgtttgctacgcatttttcttgagtttatgcatatttcattggttcaccagtatccgtgtactgcatagttctatctcgtattcttttataatcgcagaatttagaagtcactattgtt

SEQ ID NO: 41893 - protein, 99 aa, Panicum virgatum
  misc_feature: Ceres CLONE 2009486
  misc_feature (20)..(93): Pfam Name: L51_S25_CI-B8 Pfam Description: Mitochondrial ribosomal protein L51 / S25 / CI-B8 domain
MAWRGILSRSVKEIRVLFCQSSPASAAAREFVKKNYGDIKSRNPSLPFLVRECSGVQPQLWARYEMGVERCVNLDGLTEAQIDKKLEELAKAGESAKAK

SEQ ID NO: 41894 - DNA, 1284 bp, Panicum virgatum
  misc_feature: Ceres CLONE 2009510
  misc_feature: Encodes the peptide sequence at SEQ ID NO. 41895
acctcgcccttcatcccaccactctttccacctcagatccgctccgccgcctcctccccgaccctccatctcgatctcccatcacctcgccctcgcgctgcacctccggctcccgtcaccgccgctccttccgtccccaccctgcccccttccacgctccatcagatccggtggcggcgctcccgccggccggctactgtgcgcgggcccacctctacctccgcctcgccgtgcccctgtccttcgtgctcatcctcgcggtgctgctccgtgcccagcccctcctgggcgtcctcccgccgcaccgccgccccagatccagtttctccccgccgccacccgccctcacctctcttcgagtctctgtccccttctcagatccatagcgcgacatctcagcgcctgcagcccccctaggagtggcggcggttctcctcgccaccaagccaaggcgcctcttgctgcccaactcggcagtgctccctcgcctagcaggtgcggcgacgactccaacacaccaggcagccagacgtcagaggcagcagcttctgcgccaggtgggcaagccagcagcccatcgtcgcgcgcgcggggtggggtgcctctgctccccatcgccgtgcgcatgggggcggcgctcctgctccgtcgtcttcgacacgactgaacaagaaggaagcgaaggaagcttgaaaagagatgtcattgggctacgcggagaagctgtccttcagggaggatgtgggtactgtgggcatgcctgagatcttcgacccacctgaactagtccagaataagatagaagagcttgcagtcatgatgcaaaagagtaagcatttagtggtgtttaccggagcagggatatcaacttcatcagggatacctgattttcgagggcccaagggtgtctggaccttgcagcgtgcaggcaaaggtattcctaatgcatcgctgcctttccatcgagctgttccaagcttgacccatatggcactagttgaattggaaagagcaggaattctgaagttcatcataagccagaacgttgacagtctacatctccgttctggatttccaagggcgaagttgtctgaattacatggaaattctttcaaggagatctgcccatgctgtaaaactgagtaccttcgtgattttgagattgagacaatagggctgaaggatactccgaggcgttgttctgacaagaattgtggagctagattgaaagatacagttcttgactgggaagatgctttaccccttgaggagatgaactctgcc

SEQ ID NO: 41895 - protein, 194 aa, Panicum virgatum
  misc_feature: Ceres CLONE 2009510
  misc_feature (52)..(188): Pfam Name: SIR2 Pfam Description: Sir2 family
  misc_feature: SWISSPROT Homolog: EC 2.4.2.31 NAD(P)(+)--protein-arginine ADP-ribosyltransferase
MSLGYAEKLSFREDVGTVGMPEIFDPPELVQNKIEELAVMMQKSKHLVVFTGAGISTSSGIPDFRGPKGVWTLQRAGKGIPNASLPFHRAVPSLTHMALVELERAGILKFIISQNVDSLHLRSGFPRAKLSELHGNSFKEICPCCKTEYLRDFEIETIGLKDTPRRCSDKNCGARLKDTVLDWEDALPLEEMNS

SEQ ID NO: 41896 - DNA, 1343 bp, Panicum virgatum
  misc_feature: Ceres CLONE 2009529
  misc_feature: Encodes the peptide sequence at SEQ ID NO. 41897
aagccaacgccgagaacccccggccctccctgtccatctctcaatttcttctctcacccgccgcggctggcagcgaggcggggggtgtacactgtacaggggagcgggggcggggcttgccggccggtgaggggggagcgcggccatgtcgcggttcgtggacaagctgccgttctttgaccggaggtcgtcaccgatggaggaggccgaggacatcccgcggaacggcctcctgcacgtgcaccaccaccaccaccagcagcagccgccgcaccacagcggcctgctcatgcagccgcagccgtcgccgccgacgaagcagtcgtcgttcacgctcgcgcagctgctcaagcgcgtcaacgaggcgcgcagcgacgcgtcgtcgcccacgtcctcgcccacgcactcgcactacaccatcgagctgggcggctccgtgccgggctccaccggcagcgacctgagcgagcacatgcacggcggcggcggggacgggccgctgctgccgttcgtgctcaagttcacggacctcacgtacagcgtcaagcagcggaagaagggctcgtgcctgccgttcggccgcgcgggcggggagacggccgagcccgaggtgcccaggatgaagacgctgctggacaacatctccggcgaggcgcgggagggcgagatcatggcggtgctcggcgccagcggctccgggaagagcacgctcatcgacgcgctcgccaaccgcatcgtcaaggagagcctccacggctccgtcacgctcaacggcgagtcgctcgacggcaacctgctcaaggtcatctccgcgtacgtgatgcaggacgacctcctgtacccgatgctcaccgtggaggagacgctcatgttcgccgccgagttccgcctcccgcgctccctgcccaccaaggagaagaagaagcgcgtgcaggcgctcatcgaccagctcggcctgcgcaacgcggccggcaccatcatcggcgacgagggccaccgcggcgtgtcgggcggggagcgccggcgcgtgtccatcggcgtggacatcatccacgaccccatcgtgctgttcctggacgagcccacctccgggctcgactccaccagcgccttcatggtggtcaaggtgctgcagcgcatcgcgcagagcggcagcgtggtggtcatgtccatccaccagccgagctaccgcatcctcggcctcctcgaccgcctcctcttcctctcccgcggccagaccgtgtactacggcccgccgggcgcgctgccgtccttcttcgacgacttcggcaagcccatcccgggcaacgagaacccgacggagttcgcgctcgacctcatcc

SEQ ID NO: 41897 - protein, 399 aa, Panicum virgatum
  misc_feature: Ceres CLONE 2009529
  misc_feature (173)..(363): Pfam Name: ABC_tran Pfam Description: ABC transporter
  misc_feature: SWISSPROT Homolog: EC 3.6.3.28 Phosphonate-transporting ATPase
MSRFVDKLPFFDRRSSPMEEAEDIPRNGLLHVHHHHHQQQPPHHSGLLMQPQPSPPTKQSSFTLAQLLKRVNEARSDASSPTSSPTHSHYTIELGGSVPGSTGSDLSEHMHGGGGDGPLLPFVLKFTDLTYSVKQRKKGSCLPFGRAGGETAEPEVPRMKTLLDNISGEAREGEIMAVLGASGSGKSTLIDALANRIVKESLHGSVTLNGESLDGNLLKVISAYVMQDDLLYPMLTVEETLMFAAEFRLPRSLPTKEKKKRVQALIDQLGLRNAAGTIIGDEGHRGVSGGERRRVSIGVDIIHDPIVLFLDEPTSGLDSTSAFMVVKVLQRIAQSGSVVVMSIHQPSYRILGLLDRLLFLSRGQTVYYGPPGALPSFFDDFGKPIPGNENPTEFALDLI

SEQ ID NO: 41898 - DNA, 548 bp, Panicum virgatum
  misc_feature: Ceres CLONE 2009529-R
gatctggttccactacctctcgctggtcaagtacccgtacgaggcggtgatgcagaacgagttcagcgacccgacgcggtgcttcgtgcgcggcgtgcagatgttcgacaacacgccgctggccgcgctgccggcggcgctcaaggtgcgggtgctgcgcgccatgagccagtcgctcggggtggacatcgggacggcgacgtgcatcacgacgggccccgacttcctggtgcagcaggccgtcacggacctcaccaagtgggactgcctctggatcaccgtcgcctgggggttcctcttccggatcctcttctacatctcgctgctgctcgggagcaggaacaagaggaggtgatccggcggctctgcttcattcgcggctaccttggatttcttcttgggaatttatcccaatttcctttctgatcgaccgcatctgattagtatgggacgggagttgtgtatcgcatcgcgtgtaaatttgtttccaagttgtaagtttccatggcaagttcaaattgtttcccctttttggggtgcttggtgtt

SEQ ID NO: 41899 - DNA, 707 bp, Panicum virgatum
  misc_feature: Ceres CLONE 2009545
  misc_feature: Encodes the peptide sequence at SEQ ID NO. 41900
accgatcacagcaccccacgccgtcgccgtcgccgtcgccgtcgccgcccccgctgcttcccaagccatctcatggcggcgtcggcctcttccctcctcgccgccgcagcatcctcgtcctgcgcggccatctctccccggattccccacggagctccggctgccgcccccgttccttcgccgtcacatcactcctgcccttccctccgcgcttcccccgcaaggcgccatcagagccgcttcgtagccagcgtcgctcccacgatgcagcctccggcggagtccagggtctctacggtggtcgacgtcgacctcggcgaccgtagctacccgatctacatcggcgcaggcctcctcgacgagccagacttgctgcagaggcatgttcacgggaagagggttctggtggtgaccaacacgaccgtcgcgccgctttacctggagaaggtgacctgggcactcacccacaacaacccgaacgtgtcagtggagagcgtgatcctgcctgacggcgagaagtacaaagatatggacacgctgatgaaggtgtttgacaaggcagtcgagtcccggcttgaccggcgttgcacatttgtagcactgggtggtggtgtcattggggacatgtgcgggtttgcagctgctgcgttccttcgtggtgtcaacttcatacagataccaactactctgatggctcaggtggattc

SEQ ID NO: 41900 - protein, 211 aa, Panicum virgatum
  misc_feature: Ceres CLONE 2009545
  misc_feature (90)..(211): Pfam Name: DHQ_synthase Pfam Description: 3-dehydroquinate synthase
  misc_feature: SWISSPROT Homolog: EC 4.2.3.4 3-dehydroquinate synthase
MAASASSLLAAAASSSCAAISPRIPHGAPAAAPVPSPSHHSCPSLRASPARRHQSRFVASVAPTMQPPAESRVSTVVDVDLGDRSYPIYIGAGLLDEPDLLQRHVHGKRVLVVTNTTVAPLYLEKVTWALTHNNPNVSVESVILPDGEKYKDMDTLMKVFDKAVESRLDRRCTFVALGGGVIGDMCGFAAAAFLRGVNFIQIPTTLMAQVD

SEQ ID NO: 41901 - DNA, 627 bp, Panicum virgatum
  misc_feature: Ceres CLONE 2009547
  misc_feature: Encodes the peptide sequence at SEQ ID NO. 41902
ctcgcgctttgcccccatctccgccccgccgctgcagcgctccgcctccctctcccctcgcacccgcaggctagggttctcctcgagaggcggcgccatgttggtctaccaggatctgctcaccggcgacgagctgctctcggactcgttcccgtacaaggagatcgagaacggcgtgctctgggaggtcgagggcaagtgggtcgtccaaggagcagtggaggtgaacattggtgccaacccgtctgccgagggtggcgaggatgagggcgtagacgatcaggctgtgaaggttgtggacattgtcgacaccttccgtctacaggaacaacctgccttcgataagaagcagtttgtcacatttattaagcgctacataaaaaacctcaccgccaagctggagccggagaaggctgatgagttcaagaagggcattgagggtgccaccaagtaccttcttggcaagttgaaggacctacagttctttgttggcgagagcatgcatgacgatgggagtctcgtgttcgcgtactacaaggaaggagccaccgacccgaccttcctctactttgcgcatgggctgaaggagatcaagtgctagcagtggcggaagcagattttcaacat

SEQ ID NO: 41902 - protein, 167 aa, Panicum virgatum; identical to SEQ ID NO: 33826
  misc_feature: Ceres CLONE 2009547
  misc_feature (1)..(164): Pfam Name: TCTP Pfam Description: Translationally controlled tumour protein

SEQ ID NO: 41903 - DNA, 499 bp, Panicum virgatum
  misc_feature: Ceres CLONE 2009563
  misc_feature: Encodes the peptide sequence at SEQ ID NO. 41904
aaaaaaaagccatctgcaagtcaagtctcactactcgctcctaatcctaaaccacaagacaccttggtgttagaagtgcagtggccaccagcaccatggccctctcctctacggccttcacaggcaaggtcgtcaaactgccatcgtctctctttggcgaagcccgcgtgaccatgagcaaaaccactgcaaaacccatgccggctgcttccggcagaccgtgggaccgcccaaaccgcgtgctctacctcggcccgctctccggcgagcccccgagctacctgaccggcgagttccccggcgactacgggtgggacaccgccgggctctcggccgaccccgagaccttctccaagaaccaggagctggaggtgatccactcccgctgggccatgctcagcgcgctcgactgcgtcttcctcgagctgatcgcctgcaacggcgtcgagttcagcgaggtcgtctggttcaaggcgggttcccagatcttcagcgaggg

SEQ ID NO: 41904 - protein, 134 aa, Panicum virgatum
  misc_feature: Ceres CLONE 2009563
  misc_feature (58)..(131): Pfam Name: Chloroa_b-bind Pfam Description: Chlorophyll A-B binding protein
MALSSTAFTGKVVKLPSSLFGEARVTMSKTTAKPMPAASGRPWDRPNRVLYLGPLSGEPPSYLTGEFPGDYGWDTAGLSADPETFSKNQELEVIHSRWAMLSALDCVFLELIACNGVEFSEVVWFKAGSQIFSE

SEQ ID NO: 41905 - DNA, 687 bp, Panicum virgatum
  misc_feature: Ceres CLONE 2009566
  misc_feature: Encodes the peptide sequence at SEQ ID NO. 41906
acagctccccccggccggccctctcctccccattcccttccgtcctgctccgtcgtcgttcgtcgcttggtgagctgaggggaagagcagaggcgcagccagaggagcagcaagctcgctcaggctcagctcgtcgacaagaacgaacagggccgggggcctgcagccaacagggtcctccgaagcacagatattcagtgcagcaccaagaacccatgtaatcaacatcttcagagatcatctgccagcaccatctattagcaatgagaaggcacatccctgtctgcctccctctgatcacactcctctccctcttcctgagctcgagctgccaaatcgacccccagacacaagccctcctccaattcaaggccggcctgaacgatcctctaaaccacctcgcgacatggacgaacgccacctcgccgtgccacttcttcggcgtccggtgcggcgacggctccgccacggtcaccgagatctcgctctcgaccatgaacctctccggcgggatctcgccgtccgtcggcgccctgcgcgacctgacgcggctggagctcgactccaactcgctgtcggggcccgtgccgcctgagctgggcgggtgcactcagctccggttcctgaacctgtcgtgcaacgtcctctccggggagctgccggacttgtcgtcgctagcggcgctcg

SEQ ID NO: 41906 - protein, 64 aa, Panicum virgatum
  misc_feature: Ceres CLONE 2009566
  misc_feature: SWISSPROT Homolog: EC 2.7.11.1 Non-specific serine/threonine protein kinase
  misc_feature: Functional homolog of the protein sequence given in SEQ ID NO 51590
  misc_feature: Useful for making plants with modulated yield
  misc_feature: The sequence is a functional homolog of SEQ ID NO 2 in US patent 7135625
MNLSGGISPSVGALRDLTRLELDSNSLSGPVPPELGGCTQLRFLNLSCNVLSGELPDLSSLAAL

SEQ ID NO: 41907 - DNA, 648 bp, Panicum virgatum
  misc_feature: Ceres CLONE 2009587
  misc_feature: Encodes the peptide sequence at SEQ ID NO. 41908
agcaacatcagtagctggagcgccgttgcgttcgcgtagtgggctagtgcagaccactgtgctgctgggtgcagccaggctcaggcgctcagctccgctgcttccagtccagtctccagcgcctgaagctcaaagatctcccggggggacctgctccgcactgcactggtagcttgcctctgcccagccattggagcttgtccccaatggcaatggctcgcgcgttggcgctgctgctggtagtttcagtagtagcagcggcggccgtggccaccagcaccgccgaccaggagagcgaccggatccgggagctcccggggcagccgccccacgtggacttctcgcagtactctggctacgtcacggtgaacccggcgcgggggcgcgcgctcttctactggctcgtggaggcggtgccggcggcggggcccatcgcgcctctcgtcctctggctcaacggcgggcccgggtgctcgtcggtcggctacggtgcctccgaggaggtcggcccgttccgcatcaggcccgacggccagacgctctacctcaaccccaattcctggaacaaggcggccaatttgctcttcttggagtctccggccggcgttggcttctcctactcgaattcgtcgctggatctacacaccc

SEQ ID NO: 41908 - protein, 147 aa, Panicum virgatum
  misc_feature: Ceres CLONE 2009587
  misc_feature (37)..(147): Pfam Name: Peptidase_S10 Pfam Description: Serine carboxypeptidase
  misc_feature: SWISSPROT Homolog: EC 3.4.16.6 Carboxypeptidase D
MAMARALALLLVVSVVAAAAVATSTADQESDRIRELPGQPPHVDFSQYSGYVTVNPARGRALFYWLVEAVPAAGPIAPLVLWLNGGPGCSSVGYGASEEVGPFRIRPDGQTLYLNPNSWNKAANLLFLESPAGVGFSYSNSSLDLHT

SEQ ID NO: 41909 - DNA, 643 bp, Panicum virgatum
  misc_feature: Ceres CLONE 2009602
  misc_feature: Encodes the peptide sequence at SEQ ID NO. 41910
ctcgccgctcagacagcagtcagtcgcacagaggagagagacaggctcacctcagagacccaacacctcagagacccatccgccgcgtccgaaccgaaacgaaagcagcagcagccagcagccggcagccgagcgaggatgaaggtggaggtggtggagacgacgctggtgccgccgagcgaggcgacgccgcggcacgcgctgtggctgtccaacctcgacctggcggtgcccaagacccacacgccgctcgtctactactaccccaggcccaagcccgccggcgacggcaacggcgagggcgagggcgtgggcggcggggcccctttcttcgacccggcgcggctgcgggacgcgctggcccgggcgctggtgcccttctacccgctggcggggcggctggcgtcgggccccggcgggcgggtcgagatcgactgcacgggcgagggcgcgctcttcgccgtcgcgcgcgctgacttcgccggcgacgaggtgttccggaacttcgagccgtcccccgaggcgcgccgcctcctcgtgcccttcgccgagtccggcgagccaccctgcgtgctcgccatggtccaggtcaccttcctcaagtgcggcggcgtcacggtgggcacgggcatgcaccacgtga

SEQ ID NO: 41910 - protein, 168 aa, Panicum virgatum
  misc_feature: Ceres CLONE 2009602
  misc_feature: SWISSPROT Homolog: EC 2.3.1.144 Anthranilate N-benzoyltransferase
  misc_feature: Functional homolog of the protein sequence given in SEQ ID NO 50924
  misc_feature: Useful for making plants with altered carbohydrate content
MKVEVVETTLVPPSEATPRHALWLSNLDLAVPKTHTPLVYYYPRPKPAGDGNGEGEGVGGGAPFFDPARLRDALARALVPFYPLAGRLASGPGGRVEIDCTGEGALFAVARADFAGDEVFRNFEPSPEARRLLVPFAESGEPPCVLAMVQVTFLKCGGVTVGTGMHHV

SEQ ID NO: 41911 - DNA, 1435 bp, Panicum virgatum
  misc_feature: Ceres CLONE 2009612
  misc_feature: Encodes the peptide sequence at SEQ ID NO. 41912
aaaaacacgcgagctcgagccgcacagtctacccactccctctcccacaacagctcagtgctctgctcacgccccaggcctcgaatcctcgatggctgctgcaagcaccacggctgcgccggcgacatgctacgacacgccggagggcgtggacgtccggggccggtacgacccggcgttcgcgtccgtcctgacccgcggcgcgctggcgttcgtggcgggcctgcagcgcgagttccgcggcgccgtccggcacgccatggagcagcggcgggaggcccagcggcggtacgacgccggcgagccgccgcggttcgacccggccactaggttcgtccgggaggggggctggaggtgcgcgcccgtgccgccggccgtcgcggaccgcaccgtggagatcacgggccccgccgagccccggaagatggtcatcaacgcgctcaactccggcgccaaggtcttcatggctgacttcgaggacgcgctgtcgccgacgtgggagaacctgatgaacgggcaggtgaacctgcgcgacgccgtggccggcaccatcaccttccgcgacgcggcgcgcggccgggagtacaggctcaacgaccagaccgccaagctcttcgtccggccccgcggctggcacctcccggaggcgcacatcctcatcgacggcgagccggccatcggctgcctcgtcgacttcgggctctacttcttccacaaccacgctgccttccgcgtcgaccagggcgccgggctcgggcccttcttctacctccccaagatggagcactccagggaggcgaggatatggaacggcgtgttcgagagggcggagcagacggccgggatcgagcggggaagcatccgcgcgacggtgctggtggagacgctgccggcggtgttccagatggacgagatcctgtacgagctgcgcgaccactcggtggggctcaactgcggccgctgggactacatcttcagctacgtcaagacgttccgcgtccacccggaccgcctcctccccgaccgcgccctcgtcggcatgggccagcacttcatgcgctcctactcccacctcctcatccgcacctgccaccgccgcggcgtccacgccatgggcggcatggcggctcagatcccgatcaaggacgacgcggcggcgaacgaggcggcgctggagttggtgcgcaaggacaagctgcgggaggtgcgcgcggggcacgacggcacgtgggcggcgcacccggggctcatcccggcgatccgggaggtctttgagggccacctcggcgtgaggccgaaccagatcggcgacgccccagcggggcaggagcccgccacggtcgcggcggaggacctcatccagccgccgcggggcgcgcgcacggtggacggcctgcggctcaacgcccgcgtgggcgtgcagtacctcgcggcg

SEQ ID NO: 41912 - protein, 447 aa, Panicum virgatum
  misc_feature: Ceres CLONE 2009612
  misc_feature (20)..(447): Pfam Name: Malate_synthase Pfam Description: Malate synthase
  misc_feature: SWISSPROT Homolog: EC 2.3.3.9 Malate synthase
MAAASTTAAPATCYDTPEGVDVRGRYDPAFASVLTRGALAFVAGLQREFRGAVRHAMEQRREAQRRYDAGEPPRFDPATRFVREGGWRCAPVPPAVADRTVEITGPAEPRKMVINALNSGAKVFMADFEDALSPTWENLMNGQVNLRDAVAGTITFRDAARGREYRLNDQTAKLFVRPRGWHLPEAHILIDGEPAIGCLVDFGLYFFHNHAAFRVDQGAGLGPFFYLPKMEHSREARIWNGVFERAEQTAGIERGSIRATVLVETLPAVFQMDEILYELRDHSVGLNCGRWDYIFSYVKTFRVHPDRLLPDRALVGMGQHFMRSYSHLLIRTCHRRGVHAMGGMAAQIPIKDDAAANEAALELVRKDKLREVRAGHDGTWAAHPGLIPAIREVFEGHLGVRPNQIGDAPAGQEPATVAAEDLIQPPRGARTVDGLRLNARVGVQYLA

SEQ ID NO: 41913 - DNA, 645 bp, Panicum virgatum
  misc_feature: Ceres CLONE 2009612-R
  misc_feature: Encodes the peptide sequence at SEQ ID NO. 41914
catggaggacgcggccaccgcggagatcagccgcgtccagaactggcagtggctgcgccacggcgcggcgctcgacgccgccggcgtcgaggtgcgcgccacgccggagctgctcgcgcgcgtcatggaggaggagatggccaggatccaggccgaggtggggcgcgagaggttccggcaggggaggtacgcggaggccgggaggatcttcagccggcagtgcacggcgccggagctcgacgacttcctgacgctggacgcgtacaacctcatcgtggtgcaccatcccggaggtgcgtcgccgtgcaagctttgagcgttgtcggcattgtcgttgccttcgaataacgtgttgccgtttgctgcagctgccgataaggctgaataaagcttcaagcttgctagatatgaacagcattgaaatgctcacagcatattatatggttgtcatgtagtaaggtgctgatatgtaataaagaacatttacatggtatacttcattgccctgaggctgaagaggtaggactgtactggggagtacaaaacatgtgcagttcactgaaaggtgggaagcgaattttcttgccagaggattgctgagaattacagagtaagatgaatgagttcacactgtaccagttggcc

SEQ ID NO: 41914 - protein, 104 aa, Panicum virgatum
  misc_feature: Ceres CLONE 2009612-R
  misc_feature: SWISSPROT Homolog: EC 2.3.3.9 Malate synthase
MEDAATAEISRVQNWQWLRHGAALDAAGVEVRATPELLARVMEEEMARIQAEVGRERFRQGRYAEAGRIFSRQCTAPELDDFLTLDAYNLIVVHHPGGASPCKL

SEQ ID NO: 41915 - DNA, 741 bp, Panicum virgatum
  misc_feature: Ceres CLONE 2009615
  misc_feature: Encodes the peptide sequence at SEQ ID NO. 41916
aacattcgtgcctctcgtctttttcggtgcattagacagagacatctgtttccatcttcctcgccttcaatcaatcaaccaaccttcccattccatccatcaaccaaaaacccttccatccatcgcaatcccgtcaacatgtctcaagcagttggtgatttcggtctcattggccttgcggtcatgggccagaacttgattctgaatgctgccgaccatggcttcactgtcatcgccttcaaccgaaccgtttccaaggtcgaccgcttcctcgagaacgaggccaagggcaagtcgatcgttggtactcactccatcgaagagtttgtctccaagctcaagaagccccgccgtatcatgctcttggtcatggctggtcctgccgtcgacgacttcattgagaagttgcttcctttcgtcgagaagggtgatatcatcattgatggtggtaactcccattaccctgacagcaaccgacgaacccagtacctcgctgagaagggcatccgattcgtcggaactggtgtttccggtggtgaagaaggtgctcgctatggtccttctctcatgcctggtggcaatgaagaggcttggccatacatcaaggacgtcttccaaagcattgctgccaagtctgatggtgagccttgctgtgactgggtcggtgacgagggtgctggtcactacgtcaagatggtccacaacggtattgaatatggtgatatgcagttgatctgcgag

SEQ ID NO: 41916 - protein, 200 aa, Panicum virgatum
  misc_feature: Ceres CLONE 2009615
  misc_feature (5)..(177): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MSQAVGDFGLIGLAVMGQNLILNAADHGFTVIAFNRTVSKVDRFLENEAKGKSIVGTHSIEEFVSKLKKPRRIMLLVMAGPAVDDFIEKLLPFVEKGDIIIDGGNSHYPDSNRRTQYLAEKGIRFVGTGVSGGEEGARYGPSLMPGGNEEAWPYIKDVFQSIAAKSDGEPCCDWVGDEGAGHYVKMVHNGIEYGDMQLIC

SEQ ID NO: 41917 - DNA, 595 bp, Panicum virgatum
  misc_feature: Ceres CLONE 2009619
  misc_feature: Encodes the peptide sequence at SEQ ID NO. 41918
gacgagagcgtgactggtgcctgacttcgaccgacgagagctcacctgactggaaggaggagacgcttgagctgagctgcggcggcgctgggatgggcgccgcggggtctgcggctccgccgccggcggcagcgcattgccgccgggtgctgctggccctcgccctcgtgtcgctctgcggccgcgggcttcgcgtgcgtgccgctggggcggacacgggcggcctgagcagggacgcgttccccaaggggttcgtcttcggcacggcgacgtccgcgttccaggtcgagggcgcggcggcgtccggcggccggggggccagcatctgggaccccttcgtccacacccccggaaatattgctggagacgcgaacgcagatgtcgcaactgatgaatatcatcgctacaaggaagatgttgatctcatgaaaagcctgaattttgacgcatatcggttttcaatctcttggtccaggatcttcccagatggtgaaggaaaagttaatgaagaaggtgtacaatattacaacaatcttatagactatatgattaagcaagggcttactccttacgtcaaccttaaccattatgatct

SEQ ID NO: 41918 - protein, 167 aa, Panicum virgatum
  misc_feature: Ceres CLONE 2009619
  misc_feature (46)..(167): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51134
  misc_feature: Useful for making plants with altered cell wall content and/or composition
  misc_feature: Functional homolog of the protein sequence given in SEQ ID NO 50586
  misc_feature: Useful for making plants with altered carbohydrate content
  misc_feature: Functional homolog of the protein sequence given in SEQ ID NO 50615
  misc_feature: Useful for making plants with modulated biomass
  misc_feature: Functional homolog of the protein sequence given in SEQ ID NO 50360
  misc_feature: Useful for making plants with modulated flowering time
MGAAGSAAPPPAAAHCRRVLLALALVSLCGRGLRVRAAGADTGGLSRDAFPKGFVFGTATSAFQVEGAAASGGRGASIWDPFVHTPGNIAGDANADVATDEYHRYKEDVDLMKSLNFDAYRFSISWSRIFPDGEGKVNEEGVQYYNNLIDYMIKQGLTPYVNLNHYD

SEQ ID NO: 41919 - DNA, 644 bp, Panicum virgatum
  misc_feature: Ceres CLONE 2009628
  misc_feature: Encodes the peptide sequence at SEQ ID NO. 41920
ctcgcacatttaaccctagagaccgctcgagccgtcctccgccgccgctcccgctcccgctcatcttctcctcgggcgctctccctcccggatccaggatgaagtttgttgctgcatatctacttgctgtcctcgctgggaaccccagcccctctgcggaggatctgtcggccatactggaatcagttggctgtgaaatcgacagtgaaaagatggagctcctgctgtcccaactgagcggcaaggacattacggagctcattgctgctggcagggagaagttcgcttcagtcccctgcggtggtggtggtgtggctgtcgcggctgctgcaccagctgctggtggcgctgctcctgcagctgaggcaaagaaggaagagaaggtggaggagaaggaagaaagcgatgatgacatgggcttcagcctcttcgactaggcttctgcagtcatcagagctgtctcatttgagtaggaaaaccaagagtcgatgtttggatttgaaccctgttttattttgccaatcaccagaaagacttattatcttgatatgtagtaattcagctgtaggttgctatgctggttgtggtatgcttgtgaaccagagttttcactatcctatatatatccgatgaattggttgccc

SEQ ID NO: 41920 - protein, 112 aa, Panicum virgatum
  misc_feature: Ceres CLONE 2009628
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MKFVAAYLLAVLAGNPSPSAEDLSAILESVGCEIDSEKMELLLSQLSGKDITELIAAGREKFASVPCGGGGVAVAAAAPAAGGAAPAAEAKKEEKVEEKEESDDDMGFSLFD

SEQ ID NO: 41921 - DNA, 662 bp, Panicum virgatum
  misc_feature: Ceres CLONE 2009685
  misc_feature: Encodes the peptide sequence at SEQ ID NO. 41922
agtcacagataatatacagtatgcaaaagttgtgaagatgatgggtaacagagctaatgcagtcaagattgatttctctgagatactgtcagatgaagaggtagaaacacagctaaaggaggcagcagtaatatccatgggaactgaagttagcgaccttgacttgttaaatatcagagagctatgcgatcaagtgttggctctttctgagtatagagcgcagctgtatgactatctaaaaagtaggatgaacactattgcgccaaatctgaccgcactggtgggtgaattagttggtgctcgtcttattgcgcatggtggcagtttgctaaatttagccaagcaacctggcagcacaattcagatacttggtgcagagaaggctttattcagagctctaaagacgaagcattctacacctaagtacggcctcatctaccatgcatccttaattggcaaggcttctcaaaagcacaagggaaagatctctcgttctctcgccgcgaaaactgctcttgccatccggtatgatgcccttggtgatggtgaggacaactctattggcacggagagtcgactcaagcttgagacccggcttcaagttcttgagaaaacagaatttgggaaatctgccggttccgcaaagggaaagcccaagatag

SEQ ID NO: 41922 - protein, 220 aa, Panicum virgatum
  misc_feature: Ceres CLONE 2009685
  misc_feature (57)..(205): Pfam Name: Nop Pfam Description: Putative snoRNA binding domain
VTDNIQYAKVVKMMGNRANAVKIDFSEILSDEEVETQLKEAAVISMGTEVSDLDLLNIRELCDQVLALSEYRAQLYDYLKSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEKTEFGKSAGSAKGKPKI

SEQ ID NO: 41923 - DNA, 358 bp, Panicum virgatum
  misc_feature: Ceres CLONE 2009709
  misc_feature: Encodes the peptide sequence at SEQ ID NO. 41924
tacttgttggccgcgagcgtctccgcctctgccccccgcaggaagatagagagagatcgccgtctcgcttcgtctgtggtgtgggtgcccgccctccccgagcgagatccccctgctgttgctcgagatctggtcacacatctagctgtcacgatggtgaagatctgctgcatcgctgctggctatgtcggtggcccgaccctgggcgtccttggtctcaagtgctcagacattgaggtcgtcctcgtccacctctcccagtcccgggttgtggcctggaacagtgacaccctcctcgtctaccagcctggtctcgacgatgtcgagaacgtgggcgcgggcaagaacctcttcttct

SEQ ID NO: 41924 - protein, 68 aa, Panicum virgatum
  misc_feature: Ceres CLONE 2009709
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
MVKICCIAAGYVGGPTLGVLGLKCSDIEVVLVHLSQSRVVAWNSDTLLVYQPGLDDVENVGAGKNLFF

SEQ ID NO: 41925 - DNA, 623 bp, Panicum virgatum
  misc_feature: Ceres CLONE 2009710
  misc_feature: Encodes the peptide sequence at SEQ ID NO. 41926
gcaagttccacgctgacatgaacttcaatatgcttcgctgttggggtggcggattagcagagaggcctgatttttatcatttttgcgatgtctatggcctgatggtttggcaggaattttggataactggagatgtcgatggccgaggaattcccgtgtcaaaccctaatggccctttggaccatgatctctttcttctatgtgctagagatactgtcaaattactcaggaatcatgctagtctagctttatgggttggtggtaatgagcaggtcccaccagtcgacatcaacaaagcactgaagagtgatttgaagctacatcctatgtttgcaagtagccaggcatcagacagtcaagaaaaacatttatcagaagaatcaactgaccctagtaaataccttgatggtactcgtgtatatgtccaaggatcaatgtgggatggttttgccaatgggaaaggcggcttcactgatggtccatatgagattcagtatccagagagctttttcaaggacagcttctacaaatatgggttcaaccctgaagttggatctgtgggagttccagttgcagagacaattagggccacaatgcctccagaaggatggagtattccaatt

SEQ ID NO: 41926 - protein, 206 aa, Panicum virgatum
  misc_feature: Ceres CLONE 2009710
  misc_feature: SWISSPROT Homolog: EC 3.2.1.152 Mannosylglycoprotein endo-beta-mannosidase
KFHADMNFNMLRCWGGGLAERPDFYHFCDVYGLMVWQEFWITGDVDGRGIPVSNPNGPLDHDLFLLCARDTVKLLRNHASLALWVGGNEQVPPVDINKALKSDLKLHPMFASSQASDSQEKHLSEESTDPSKYLDGTRVYVQGSMWDGFANGKGGFTDGPYEIQYPESFFKDSFYKYGFNPEVGSVGVPVAETIRATMPPEGWSIP

SEQ ID NO: 41927 - DNA, 695 bp, Panicum virgatum
  misc_feature: Ceres CLONE 2009717
  misc_feature: Encodes the peptide sequence at SEQ ID NO. 41928
gtagccgcccctgcctctcctcgcgagtcatacaacagcgcagcccctccaggcaccctccccctcgctctgcctcgccgctggccacccccatctccatctcccgcaccgcaccctgcggcgccatccagagctaggccccgctgctccgccccgacgccagctctccccacggaggatcctccgccaccgccaccgccatgggcaaggtccgctccttcttctcccgcagcggcaagcgcggcgccggcccgtcctcgccgtcctcctccgcggcgggcagcgcgccgtcgtcgccgtcgaggaggacctgcgccacgccttcatggtcttcgacgccgacggcaacggcctcatcacgcccgccgagctcgcgcgcgtcctgcgcggcctcggggaggccgccaccgtcgcccagtgccgccgcatgatccagggcgtcgaccgcaacggcgacggcctcgtctccttcgacgagttcaagctcatgatggccgccggcggaggcttcggcaggatggcctcctcctcttcttaggcactcatctgtttgggcaagatcactgctcggctctgctcccacaaattggattcgttcgttgaattgcactgtacatacgtaacagcgagatcgaagagatcatcgccaccaaaccaaagtaattactagtactaggcccatatcacacggacaa

SEQ ID NO: 41928 - protein, 70 aa, Panicum virgatum
  misc_feature: Ceres CLONE 2009717
  misc_feature (31)..(59): Pfam Name: efhand Pfam Description: EF hand
  misc_feature: SWISSPROT Homolog: EC 2.7.11.1 Non-specific serine/threonine protein kinase
MVFDADGNGLITPAELARVLRGLGEAATVAQCRRMIQGVDRNGDGLVSFDEFKLMMAAGGGFGRMASSSS

SEQ ID NO: 41929 - DNA, 1342 bp, Panicum virgatum
  misc_feature: Ceres CLONE 2009718
  misc_feature: Encodes the peptide sequence at SEQ ID NO. 41930
atccaagccattcaggccattcatgcgccaactcctgaataggagttaacaataccactgggctacctaccaagagaccggtattgttcttagcccaaacgccaacagatgaatgagaaggactgcgcaaagctgtcaaaaacacgcgcctgcacaacagccatgatataacctcgcaccttccattctttctttcggctagggcccatttccactccgagaagccagctttccaatcagtcacgcaattgaagcgttgccgactccacgtgggccctcaacagaccaacattgcaatcatggaatctctagaacaccagcggcttccttcctcccctctctcctcgccgctctccgtcctttcaaactcaccctctccacccagcgcgctatatatttctaaacgctacccttcgccttcttccactaccgtgtcgggaagcgcatcgcctgtgaaatttcccgacatggaaatccaggtgcggacagatggacccccgccgagtaagcgccgccggattgccgctcccgcgaagccacgcaccaccgcctatatcgatttggaaaatcaaggcgaagaggaggatgcggatctcaagaggctcatggtggctctgcgaaagaagaagaagattgtggtcattgcaggtgctggcatctccgtatctgcaggaattcccgatttccgatcctcgacaggcctgttcgccactctccgtgggcagcataaacttaaggcgtccgggaaacatctcttcgatgcgtcggtatacaaacacgattcgtccaccgaatccttccataccatggttcgcgagctggctcagatgacctccgatgcgaagccgaccccgtttcaccacatgctggcgtccatcgccgccgagggcagacttatgcgcatgtatagccaaaacattgataccctcgacacccagatgccgcccctggcgactacagtccctctaaacaccaaggcgccctggccgacaactatccagctccacggcggactcgaaaatatggtgtgcacaaagtgtggctacctggaacgtttcaacgcatcgctgttcgagggcccggaaccgccgccgtgcgagaagtgcaaggaacaggatgaggtgcggactgcttttgcggggaagcggagccacggaattgggaagttgcgcccaaggatcgtgctttataacgaatacaatccagacgaggaggccatcggaaacgtgtccaaggccgacttacggagggttcctgacgccgtcattgtggtcggcacgagtttaaaaatccctggggtacggaggctggtcaaggagatgtgccagttgacccggagcag

SEQ ID NO: 41930 - protein, 291 aa, Panicum virgatum
  misc_feature: Ceres CLONE 2009718
  misc_feature (61)..(276): Pfam Name: SIR2 Pfam Description: Sir2 family
MEIQVRTDGPPPSKRRRIAAPAKPRTTAYIDLENQGEEEDADLKRLMVALRKKKKIVVIAGAGISVSAGIPDFRSSTGLFATLRGQHKLKASGKHLFDASVYKHDSSTESFHTMVRELAQMTSDAKPTPFHHMLASIAAEGRLMRMYSQNIDTLDTQMPPLATTVPLNTKAPWPTTIQLHGGLENMVCTKCGYLERFNASLFEGPEPPPCEKCKEQDEVRTAFAGKRSHGIGKLRPRIVLYNEYNPDEEAIGNVSKADLRRVPDAVIVVGTSLKIPGVRRLVKEMCQLTRS

SEQ ID NO: 41931 - DNA, 535 bp, Panicum virgatum
  misc_feature: Ceres CLONE 2009718-R
aggagaacatggcgagcagccccccgaccaccccggtcgaagagaccaacgccgcgtccttgggcaccatttcccctacctccaagccgaggagcatgagtcatctcattgattgaccggctacggggtgctgtggcatgtgacagggagggtcaggggcttttaatgaaggtggggcggttgggggttgcagcgggcggcgtggctctgtttgctgtggcatcaggaaggggataggggtgctggtgaattggggggcataattacgatggttttactcgtgaggcccacgggagggttcttttccgtttgatgggctgggatattgctgtgctggtacccgggtttgagagggtgagagagagagggcaccacttgggaggaatatggtcgtcccagtcggcgatgccgaacctggctcgaaaaccgaaataattgcaacatgatagaacggataatcttccgtcgagagttcctatgcttgaaaatatagataaacaaccaaccctgggggttggctgaacttgctgcttcg

SEQ ID NO: 41932 - DNA, 762 bp, Panicum virgatum
  misc_feature: Ceres CLONE 2009722
  misc_feature: Encodes the peptide sequence at SEQ ID NO. 41933
agcacacagcagctatccagactcacactactgtcgcacacacactactgcagcatttgctttgcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagctcgatccgctcagaagctagctgctagctagcgagctatattcaggagaataaaataaagttgaggcatcatcagcagcacatcatctatatatattatattattgttgtactcgatctgtgtgtacgtgcgcgtatacatacatgaatgcttatacgatcgatgtatatatatgtgctgcctctctcacaagtacgtgtgctcatatacatacatacataca

SEQ ID NO: 41933 - protein, 126 aa, Panicum virgatum; identical to SEQ ID NO: 40598
  misc_feature: Ceres CLONE 2009722
  misc_feature (37)..(122): Pfam Name: Tryp_alpha_amyl Pfam Description: Protease inhibitor/seed storage/LTP family

SEQ ID NO: 41934 - DNA, 637 bp, Panicum virgatum
  misc_feature: Ceres CLONE 2009733
  misc_feature: Encodes the peptide sequence at SEQ ID NO. 41935
acaggccaccgccattccccattgccgcgttcttggactctgcttctctcgctgttgaacctcctgctgtttggaggctgatcgaggaggaagaagatgacgatcaccattgaacagccccagctcgatgcggtggcagcggagaggaaggtccccgccggcggcgaccccgcggagctggtgctggacggcggcttcgtcgtgccggacgccaacgccttcggcaacaccttcagggactacgacgcggagtcggagcggaagaagacggtggaggagttctacgaggtgaaccacatccggcagacgcacgagttcgtgtcccggatgcgggccgagtacgggcggctcgacaggacggagatgggcatctgggagtgcatcgagctgctcaacgagttcatcgacgacagcgacccggacctggacatgccccaaatcgagcacctcctccagaccgccgaggccatccgcaaggactaccccgaccaggactggctccacctcaccggcctcatccacggtgcccttcctcttcctcttccttgctgcggcctgcctcttcgctgactgaaacctgttgtgacatgggagatgtctctgttttttcagacctgggcaaggtgctgctgcaccc

SEQ ID NO: 41935 - protein, 157 aa, Panicum virgatum
  misc_feature: Ceres CLONE 2009733
  misc_feature: SWISSPROT Homolog: EC 1.13.99.1 Inositol oxygenase
MTITIEQPQLDAVAAERKVPAGGDPAELVLDGGFVVPDANAFGNTFRDYDAESERKKTVEEFYEVNHIRQTHEFVSRMRAEYGRLDRTEMGIWECIELLNEFIDDSDPDLDMPQIEHLLQTAEAIRKDYPDQDWLHLTGLIHGALPLPLPCCGLPLR

SEQ ID NO: 41936 - DNA, 708 bp, Panicum virgatum
  misc_feature: Ceres CLONE 2009738
  misc_feature: Encodes the peptide sequence at SEQ ID NO. 41937
gcatactccgacgatataagataccctgaagaggttcatgtgacttctgatgatgcaccacgtgcaacggatgaacaaatcaagaaagcatcaaatctattgaaacgcattgatctgaagaatttctctgtatgccaatttgctaacccagctttgcaaagacactatgggatattggaggccttagctttagccgaagatgagatgccagatataaaggatgagacccttcctgatgaacaaggcttatctaggccaggagttgttaaagccatcgatgaatttaaggcttcagtctatggtgaaaattatgatcaagaggaggctgaagctgctgctgcgaaagcttcccatggtgatgctgcgaagaaacggaaggcaatcactgatgcagcctcggttaaaagtgcagcttatgattgggcggaactggcagataatggaaagctgaaggacatgatggttatcgagttgaaatcgtacctgaccgcgcatggcctccctctttccggtaagaaagaggcccttatcagcaggatcttgactcatctgggcaagtgaagccacttatccgaactttgttttcccagaagccgactactgtctcttgggtagcttgaaagcttgtgtaacataacccgacctccctgtacatgatacgtgccaattttatgtagcgatgtgccagcttgttagtttatcatgagg

SEQ ID NO: 41937 - protein, 186 aa, Panicum virgatum
  misc_feature: Ceres CLONE 2009738
  misc_feature (38)..(130): Pfam Name: Ku_C Pfam Description: Ku70/Ku80 C-terminal arm
  misc_feature (150)..(184): Pfam Name: SAP Pfam Description: SAP domain
AYSDDIRYPEEVHVTSDDAPRATDEQIKKASNLLKRIDLKNFSVCQFANPALQRHYGILEALALAEDEMPDIKDETLPDEQGLSRPGVVKAIDEFKASVYGENYDQEEAEAAAAKASHGDAAKKRKAITDAASVKSAAYDWAELADNGKLKDMMVIELKSYLTAHGLPLSGKKEALISRILTHLGK

SEQ ID NO: 41938 - DNA, 700 bp, Panicum virgatum
  misc_feature: Ceres CLONE 2009749
  misc_feature: Encodes the peptide sequence at SEQ ID NO. 41939
agagaagccggaaaagatctctccttcccctgcgagcagagctccgtccacccaccgacggagtctcctccccggctcttcccataaacgcaggctcacgcggacgcctccgcctcgccccaagcccaaacccaccaccaattcaaccgcgacccgacccaacccaacgacccccgcacgcattcccacctcctccctcccttcccccagatctccccccctgcgcgcgcgccggggtgctgccttcgccggcggcggcgacgaccgagggaccgccatgacggcgaagggcggcgccgcgccgtcccccggcggcacgggggccgcggcggggaccgggcgcctcttcacggtggggctcgtcaccgcctggtactcctccaacatcggcgtgctcctgctcaacaagtacctcctcagcagctacggcttcaagtacccaatcttcctcaccatgtgccacatgtccgcctgcgccctgctctcctacgccgccatcgcctggctccgcgtcgtgcccatgcagctcgtgcgctcccgcgtccagctcgccaagatcgccgcgctcagcctcgtcttctgcggctccgtcgtgtcggggaacgtctcgctgcggtacctacccgtctccttcaaccaggccgtcggcgccaccacgcccttcttcaccgccgtcttcgcgtacatcatgatcgtcaag

SEQ ID NO: 41939 - protein, 140 aa, Panicum virgatum
  misc_feature: Ceres CLONE 2009749
  misc_feature: Functional homolog of the protein sequence given in SEQ ID NO 51430
  misc_feature: Useful for making plants with altered cell wall content and/or composition
MTAKGGAAPSPGGTGAAAGTGRLFTVGLVTAWYSSNIGVLLLNKYLLSSYGFKYPIFLTMCHMSACALLSYAAIAWLRVVPMQLVRSRVQLAKIAALSLVFCGSVVSGNVSLRYLPVSFNQAVGATTPFFTAVFAYIMIV

SEQ ID NO: 41940 - DNA, 686 bp, Panicum virgatum
  misc_feature: Ceres CLONE 2009753
  misc_feature: Encodes the peptide sequence at SEQ ID NO. 41941
cgcaccggtagaataaatcgcggccccgatccccgatccccgatgccccctcgccccgccccactcctctcccgcctccgcgctgccgccgtcaccacccctccctcctccgcggcgccgctgcgctacggccgccaccctcgccacgcgagccccttcgctctgcccccgccctgcctgcgcttcccccgcaccgccgcggtctcgccgctcgtgctgcgcccgatcgccggcgggttcgcgctgttcagcatggccgccgccgcctcctccgccagctccgtccacgacttcaccgtcaaggatgctagcgggaaagatgtggacctgagcacctacaaggggaaggtactgctcatcgtaaatgttgcatcccagtgtggcttgaccaattccaactacacagagctgagccagctgtatgagaagtacaaggaccagggtttcgagatccttgctttcccatgcaaccagtttggtgggcaggaacctgggactaatgaggagattgtccagtttgcttgtactcgcttcaaggccgagtatccaatttttgaaaaggttgatgtcaatggtgacaacactgcgcccatctacaagttcctgaagtccagcaaaggcggcctctttggtgagaacatcaagtggaacttctccaagttccttgtcgacaaagaggggcgtgt

SEQ ID NO: 41941 - protein, 214 aa, Panicum virgatum
  misc_feature: Ceres CLONE 2009753
  misc_feature (81)..(189): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50170
  misc_feature: Useful for making plants with modulated flowering time
MPPRPAPLLSRLRAAAVTTPPSSAAPLRYGRHPRHASPFALPPPCLRFPRTAAVSPLVLRPIAGGFALFSMAAAASSASSVHDFTVKDASGKDVDLSTYKGKVLLIVNVASQCGLTNSNYTELSQLYEKYKDQGFEILAFPCNQFGGQEPGTNEEIVQFACTRFKAEYPIFEKVDVNGDNTAPIYKFLKSSKGGLFGENIKWNFSKFLVDKEGR

SEQ ID NO: 41942 - DNA, 597 bp, Panicum virgatum
  misc_feature: Ceres CLONE 2009756
  misc_feature: Encodes the peptide sequence at SEQ ID NO. 41943
cttcttcccctcctcccttcgctcgtcacatctccccattctcgccgccccgctccgtgctcgccgttctcccctcgctccgttggattcctcttctcgccgaagctccgagttcgccccccccccccccaatggcggatgaggaggtatctgatccaaaggcgctcctagaggaacgctcaaaggctaagtgtgtgtcacagtggtacgaatatcagaaatgtgtcaagagaattgaaaatgacgagactgggcataagcactgtactggccagtactttgattactggaaatgtgttgacaagaatgttgctgagaaactctttgatctgctaaaatgacaaggaaaatgtcctctttcagttttctactcaaaattggtaataattgtatcgcctgtgcaccatatagactattcaggtgcttaatatttgtcggagaagttttgcctcttgggtaacacaacaaattttccactgccagtttacgtttcatttctgtcagtagtattgaactttacagcaggtttcctcctgcataaagcattgttgtataaagaaattcaatgggttattccaagaatgtggctgagcatta

SEQ ID NO: 41943 - protein, 69 aa, Panicum virgatum; identical to SEQ ID NO: 14672
  misc_feature: Ceres CLONE 2009756
  misc_feature (7)..(69): Pfam Name: UCR_hinge Pfam Description: Ubiquinol-cytochrome C reductase hinge protein

SEQ ID NO: 41944 - DNA, 1648 bp, Panicum virgatum
  misc_feature: Ceres CLONE 2009757
  misc_feature: Encodes the peptide sequence at SEQ ID NO. 41945
agggctcttctcctgagtcgctgcccgctggggcccacacccacatccaccgccggcgatgaagcccctcatcccccagtccctccacgccgccgtcgaccgccgctggctgctccccctggccgtcggctccgcgctctcgctcctcctcctcgtcgcactcaccaccttccccctccccctcccctcctcgtcctcctcggccgccgacgccctcttcgtcgagcacaaactcgcccccaccccgccgtcccccgccggcgccgagctcccccgcatcgccttcctcatctccggctccgccggggacgcctccgctctccgccgcgtcctcctcgcgctctaccaccccaggaaccgctacatcctgcacctcgatgccgaggcccccgactccgaccggagggacctcgccgccggcctcgccgcccacccggtcctcgcctccgcggccaacgtccgcgtcgtcgaccgcgccaacctcatcacctaccgcgggcccaccatggtcgccaacacgctccacgccgccgccgccttcctgtggggccacgcaggcgccggcggctccgactgggactggttcatcaacctctccgcctccgattacccgctcgtcacgcaggatgatctgatacacgtcttctccaagctgccgcgtgatctcaacttcatcgaccacaccagcgacatcggatggaaggagtttcagagggccaagcccgttatcattgaccccggcctctacatgaggaagaaggctgatgtcttctggataccgcagaggcggagcgtgccgacagccttcaagctcttcactggttctgcttggatggcactgtctaggccctttgtggaatactgcatatggggctgggacaacctacctcgtacggtgctcatgtactactccaatttcatctcctcgccagaaggctacttccacaccgtggtctgcaatgctgaggaattcaagaacacaacagtgaaccatgacctgcattatatctcatgggacaaccctccaaagcaacatccacactacctcacggtcgaagatttagacaggatggttgctagcgatgcacctttcgctcggaagttccatgcaaacgaccctgtgctagacaagatagatgatgagatcctgtcccgcggtgcagacatgccaacccctggaggctggtgcgcaggaacacgagagaacgggagcgacccttgctctgtgataggtgacaccagtctccttctgcctggccgtggagcagtgcggctgcagcggctggtcacctctctgctgtcagaggagaagttccacccaagacagtgcaagtagggcgtgatgcccctgacccacccaaatctgagctatatatgaaaatatacacgcatggactgctgccggtggcggtgcatacatggtttgttctgacttgtaggtcgtcaccgttttgtcaggcagctgccatttaacatgtaccatgttgccgttgtagtaccacattagtcatctgtttgtagagcatgttgtatctccacatgtagtagtactttatcatccaaggtatgaacctggaaacctggttatcaatatatttcagtgtaactttagccgtcaattatattgctaaagttagtgtggttttcg

SEQ ID NO: 41945 - protein, 276 aa, Panicum virgatum
  misc_feature: Ceres CLONE 2009757
  misc_feature (1)..(155): Pfam Name: Branch Pfam Description: Core-2/I-Branching enzyme
  misc_feature: SWISSPROT Homolog: EC 2.4.2.26 Protein xylosyltransferase
MVANTLHAAAAFLWGHAGAGGSDWDWFINLSASDYPLVTQDDLIHVFSKLPRDLNFIDHTSDIGWKEFQRAKPVIIDPGLYMRKKADVFWIPQRRSVPTAFKLFTGSAWMALSRPFVEYCIWGWDNLPRTVLMYYSNFISSPEGYFHTVVCNAEEFKNTTVNHDLHYISWDNPPKQHPHYLTVEDLDRMVASDAPFARKFHANDPVLDKIDDEILSRGADMPTPGGWCAGTRENGSDPCSVIGDTSLLLPGRGAVRLQRLVTSLLSEEKFHPRQCK

SEQ ID NO: 41946 - DNA, 586 bp, Panicum virgatum
  misc_feature: Ceres CLONE 2009758
  misc_feature: Encodes the peptide sequence at SEQ ID NO. 41947
atcgagctgtgtcgcagtcgccgttgccgtcgacgatggcagcggaggtggatcagaaagtggtggtgcatgtgcggtcgacgggtgatgccccgatactgaagcaatccaaattcaagatttcgggacgagataaatttttgaaggtcattgagtttcttcgccgacaacttcatcaggatacactgtttgtctatatcaacagtgcattttcgccaaacccagacgaactggtaattgacttgtataataactttggaattgatgggaaactggtggtaaattatgctttatcagcagcatggggctaaagttgctgctgcagcaatgagataatagagaccctgacaattcctcatggcgattgtaaattacatctagttttagtgctaatgagactgtatatctaatttgtaaaggttattatacatatttcacaatcacccaaatgtatttctcctgtaaagaattccacccctactgttcatcacgctgcaccacagccccgtgctcgtgcatgtggctttctggattgtgtaatgcaccagtgcaggtggtggattttaaggactgctttaacgacttc

SEQ ID NO: 41947 - protein, 91 aa, Panicum virgatum
  misc_feature: Ceres CLONE 2009758
  misc_feature (1)..(91): Pfam Name: APG12 Pfam Description: Ubiquitin-like autophagy protein Apg12
MAAEVDQKVVVHVRSTGDAPILKQSKFKISGRDKFLKVIEFLRRQLHQDTLFVYINSAFSPNPDELVIDLYNNFGIDGKLVVNYALSAAWG

SEQ ID NO: 41948 - DNA, 675 bp, Panicum virgatum
  misc_feature: Ceres CLONE 2009779
  misc_feature: Encodes the peptide sequence at SEQ ID NO. 41949
gtcatttgtcaagcgacaagtgggttcttgcggagtccaccagcgaagaatcctgatccgcatcgtcctctccgcctccggtgccagcacgccttgaacccctccaatctccggcacctagctctcctgccggccgacgctcaccacctggttttgctgccgcacaatctgctaccgcctcccccagcccgctgcccagccgttatttcctcctggacgggctcggcgggaggatgagcgatgactccccatatgctctttggtaccctgcgcgccaacgtgctcgccgatcccacccgcgccacctgcggccacgcagcgtccccaagaccgtctgcaaggataggcagaggggactttgcagtggcagccatctcggacgattatcttccgatgagaagtattgaagcgaaaaatcggacatcaaaaggtgatatcacaagcctcagactaatcacagcggtcaaaacaccctatttaccagatgggagatttgatctcgaagcatatgattatttgatcaacatgcagatagagggcggggctgaaggtgtgatagttggagggacaacaggagagggtcaccttatgagctgggatgagcatatcatgctcattgggcatactgtcaactgctttggcactcgaatcaaagtgataggggacacggggagt

SEQ ID NO: 41949 - protein, 144 aa, Panicum virgatum
  misc_feature: Ceres CLONE 2009779
  misc_feature: SWISSPROT Homolog: EC 4.2.1.52 Dihydrodipicolinate synthase
MTPHMLFGTLRANVLADPTRATCGHAASPRPSARIGRGDFAVAAISDDYLPMRSIEAKNRTSKGDITSLRLITAVKTPYLPDGRFDLEAYDYLINMQIEGGAEGVIVGGTTGEGHLMSWDEHIMLIGHTVNCFGTRIKVIGDTG

SEQ ID NO: 41950 - DNA, 712 bp, Panicum virgatum
  misc_feature: Ceres CLONE 2009781
  misc_feature: Encodes the peptide sequence at SEQ ID NO. 41951
aagacccgcactggcctcgaagcactctgctctgctgagtactgagatcgcgacgccgtcgtcctccactcgaccactccttcctcgcccgcgccgtcaaatcccgcctccagccttcgaagtgcgccagacaacgagaccactaaccccgcttcgtggttgtcctgctgctcgtcctctattctccggtactggattgccgtggggttttgattcatcggagtttagattgatttctacttctgactaaccatgggcacaagacttatgaagggcttgagcctgaagagactcttaacaccgcggagctcagctgatatttgctgtaaatctcgagcattcagctccactgtatatttttctgatctcgatgagaaggatgacatgggtggcaaaagtggtgatgaatttaaaggtcctaggaaaaataaggaacatcaattccgtggtgtataccgggcaattatttgtggcaaagttggacgagtgcccgtgcagaaaatattaagtaacgggcacacggtaactgtattcactgttgggacaggtggtatgtttgaccagagaatagtagacgataacttgccaatgccagcacagtggcatcggatagctgtccataatgaggagcttggcgcatatgctgttcagaagttggtcaagaatgctgcagtctatgttgagggtgatatcgagactagagtctacaatg

SEQ ID NO: 41951 - protein, 153 aa, Panicum virgatum
  misc_feature: Ceres CLONE 2009781
  misc_feature (67)..(153): Pfam Name: SSB Pfam Description: Single-strand binding protein family
MGTRLMKGLSLKRLLTPRSSADICCKSRAFSSTVYFSDLDEKDDMGGKSGDEFKGPRKNKEHQFRGVYRAIICGKVGRVPVQKILSNGHTVTVFTVGTGGMFDQRIVDDNLPMPAQWHRIAVHNEELGAYAVQKLVKNAAVYVEGDIETRVYN

SEQ ID NO: 41952 - DNA, 613 bp, Panicum virgatum
  misc_feature: Ceres CLONE 2009786
  misc_feature: Encodes the peptide sequence at SEQ ID NO. 41953
actaccagtgcagtaacctcggcactagtactcgcagcgcgccagccgccatggcctccctcgccgccgtctccgtgcagccggtcgccgtgaagggcctcggcggcagctccatctccggcaggaggctcgccgtgaggccgtcgccccgcgccgcctgccgctcctccacccgcaggccccgcgccgccgtggtcgccaagtacggcgacaagagcgtctacttcgacctcgacgacatcggcaacaccaccgggcagtgggacctctacggctccgacgcgccctcgccctacaacccacttcagagcaagttcttcgagaccttcgcggggccgttcaccaagaggggcctgctgctcaagttcctgctgctgggcggcggctccctgctggcctacgtcagcgcgtcggcgtcgccggacctcctgcccatcaagaaggggccacagcagccgccgcagccgggcccgcgcggcaagatctaagttcttcggctcctcctcgatccatttgtctactagcttgcttgtaccgctagctgatccggtcgccatggatccctgcctgttatgctgttgatatgacgacattcgatccccgtctgtttacg

SEQ ID NO: 41953 - protein, 145 aa, Panicum virgatum
  misc_feature: Ceres CLONE 2009786
  misc_feature (5)..(145): Pfam Name: PSI_PsaH Pfam Description: Photosystem I reaction centre subunit VI
MASLAAVSVQPVAVKGLGGSSISGRRLAVRPSPRAACRSSTRRPRAAVVAKYGDKSVYFDLDDIGNTTGQWDLYGSDAPSPYNPLQSKFFETFAGPFTKRGLLLKFLLLGGGSLLAYVSASASPDLLPIKKGPQQPPQPGPRGKI

SEQ ID NO: 41954 - DNA, 590 bp, Panicum virgatum
  misc_feature: Ceres CLONE 2009791
  misc_feature: Encodes the peptide sequence at SEQ ID NO. 41955
aaccatcgtagtagcaaagctagcccacttttccttgacttgacccgcgcgcgcggcgtcagctcccgcctctccgccgagaagccggacggagctctttttttaaaggcagcaagcccaaccaaacccttctccttcgagaggtcgccgaggagagctgcccctgcgagggagggggggagccatgctggaccatctcgtcgggctggtgagggtgcgcgtgctcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggaagtgtttgacaaggacacattcgtcgatgattcgatgggtaccgcagagctggacatccgcccgttggttgaggtcgtgaagatgaagctccaggatgttgccgatggaactgtggtaaagaaactggtgcccaacagacagaactgcctggccgaggagagctccatttacatctccgaggggaaggtgaagc

SEQ ID NO: 41955 - protein, 135 aa, Panicum virgatum
  misc_feature: Ceres CLONE 2009791
  misc_feature (9)..(87): Pfam Name: C2 Pfam Description: C2 domain
  misc_feature: SWISSPROT Homolog: EC 3.1.4.4 Phospholipase D
MLDHLVGLVRVRVLRGVNLAIRDLRSSDPYVVVRIGKQRLRTKVVKKNTNPEWNEELTLSIEDPAHPVRLEVFDKDTFVDDSMGTAELDIRPLVEVVKMKLQDVADGTVVKKLVPNRQNCLAEESSIYISEGKVK

SEQ ID NO: 41956 - DNA, 1410 bp, Panicum virgatum
  misc_feature: Ceres CLONE 2009802
  misc_feature: Encodes the peptide sequence at SEQ ID NO. 41957
atatgcagctttggattccatcgaggccacaacaacgacgagttctcgtcacaagctaccttgactcaatcttctccacagccaacagccatggaggccatggcatcatcagcaaacctttttttctacgctgcgctgctttttctggcggtattgtatctcgccatcacccgacgccgcaccagccgcttgccgcccgggccgacgggcctcccactggtgggcagtctcccgttcatccacccgaacctacacgtctgcttcgctggcctcgccgcgaagcatggacctatcttctcgatccgtctgggctccaaggtggaaatcgtggtcacctccccggagttggcacacgaggtcctccgggacaaggaccctgtcttctccaaccgcgtcattcccgaggccggccgcgctgtctcgtttgacggcgtggagaatatcgtgggcgcccccgtcggcccaaagtggcgcctgctccgacgcatctgcgcgcacgagatgctgagccccacaggtctcgacaacctgtacggccttcgcaggcgcgagttcatgtctactctgagcttcctatactctcaggccggagagccggtcgacatcggcgcccagatgttcgtcaatatgttgaacgtggtcacgagcaccctttggggtggcaccatcgggagcgagagcgagcgggctgcggtgggaaaagagttcagggggctcatcgccaagttgactgagctgctcggctcgcccaacttgtcggatttcttccctgtgctggcgccgttcgacctgcagggcatccggaggaacatggagcggatcagggtgcggttcgacaagatcttcgagaagatcatacagcagcgggtgaaaggccagcaagatggcagcaagatggcgactgacttccttgagtgcctgctcaagacggagaaggaaggcggggacggcaaggccaccttcaccatgactgacgtcaagtctctcctcatggtatcaatctttcccaatctttaattcccatcccggcctccttttccgttaacattctcatgagcggagcggcacctgcccccccccccccccccccctcccgcgtttgccgcccggggtgccaccccgtggaggggaattgctgcccacctcctggaagggtggttggcgggtgagtggcccttggtgaaatcctccgcggcccgggtggtggtccaggttggcggactttagggatttcaagttgttgggtctggtatggccgatggacttggccaaaaaggtcggcggcggtggcaagccagggggtggtggcggtagttcgtcccgcatggccgtgtggatggccgcccggggtgggacaaccggggggtggcggctggcggtagtgggaagtcaaacagcggatgagggggc

SEQ ID NO: 41957 - protein, 308 aa, Panicum virgatum
  misc_feature: Ceres CLONE 2009802
  misc_feature (35)..(308): Pfam Name: p450 Pfam Description: Cytochrome P450
  misc_feature: SWISSPROT Homolog: EC 1.14.13.88 Flavonoid 3',5'-hydroxylase
MEAMASSANLFFYAALLFLAVLYLAITRRRTSRLPPGPTGLPLVGSLPFIHPNLHVCFAGLAAKHGPIFSIRLGSKVEIVVTSPELAHEVLRDKDPVFSNRVIPEAGRAVSFDGVENIVGAPVGPKWRLLRRICAHEMLSPTGLDNLYGLRRREFMSTLSFLYSQAGEPVDIGAQMFVNMLNVVTSTLWGGTIGSESERAAVGKEFRGLIAKLTELLGSPNLSDFFPVLAPFDLQGIRRNMERIRVRFDKIFEKIIQQRVKGQQDGSKMATDFLECLLKTEKEGGDGKATFTMTDVKSLLMVSIFPNL

SEQ ID NO: 41958 - DNA, 635 bp, Panicum virgatum
  misc_feature: Ceres CLONE 2009802-R
  misc_feature: Encodes the peptide sequence at SEQ ID NO. 41959
ggtggtcggtcgggaggccatcgtggaggagtcccaccttcctcagctccactacctccgcatggtgatcaaggagacgctcaggctccacccggcgctgcccctcatggtgccgcactccccgagcgtggactcgacgattggcgggtaccacgtcccagcgggctgccgtatctttgtcaacgtctgggccatccacaggaaccccctggtttggaacgagcctctcgagttcaaccctgacagattcgctggggacgccggccgcaggtgggacttcacgggaagccagttcgactatttccccttcggctccgggaggaggatctgcgccggtatcgccatggctgacaagatgactgcctactcgctggccatgctgctgcaagcttttgattggacactgccgccgggaaccgatcttgacctgtccgagaagttcggagtcgtgatgaagaaggctacgccactggtgactattcctaagccaaggttgtctaagcctcatctgtattattcgtgaagacatccttagcctggacacaaataaatgcgtaatacatcgtaatgttgtacttaaatattatattattgtaaacgattcgcggtatcaccggaaacgtcctatcttgtgc

SEQ ID NO: 41959 - protein, 173 aa, Panicum virgatum
  misc_feature: Ceres CLONE 2009802-R
  misc_feature: SWISSPROT Homolog: EC 1.14.13.21 Flavonoid 3'-monooxygenase
  misc_feature: Functional homolog of the protein sequence given in SEQ ID NO 51510
  misc_feature: Useful for making plants with modulated cold sensitivity
VVGREAIVEESHLPQLHYLRMVIKETLRLHPALPLMVPHSPSVDSTIGGYHVPAGCRIFVNVWAIHRNPLVWNEPLEFNPDRFAGDAGRRWDFTGSQFDYFPFGSGRRICAGIAMADKMTAYSLAMLLQAFDWTLPPGTDLDLSEKFGVVMKKATPLVTIPKPRLSKPHLYYS

SEQ ID NO: 41960 - DNA, 693 bp, Panicum virgatum
  misc_feature: Ceres CLONE 2009816
  misc_feature: Encodes the peptide sequence at SEQ ID NO. 41961
aaaaccctagctgcctgctcccactcgcgaccagagcggcggcggcgcatctcgtggttgcgagctgcgaggccaggtcggtatcaaggggcgccggcaactccgcgtctccggcagcagattcattcttcaatggcggccttcaacaagcttggcagccttctaaggcacaacgctctgacagctggtgcccccaccagctcgtctcctgcattgttcaatgctgctcgctggcagcgctgctgctccgccgcctctcctcccactcctcttctgcctattccgtcagccgccgcgcctcctctgccctgccctctcagccctccgcctcccacctcgccaccagccccccttgccccctttccagcagccgcaggaccaggggattcgcggcctgggcctcggcgccggggcccgccgaatcccccgccactaaggcgctagaggccaagatcaaggagcagctggaggccgacgcggtcagggtcgtcgacaactccggggacggccgccacgtctgcatagatgtggtttccaaggcattcgagggaaaatctgcagtaaataggcagagaatggtttacaaggctatatgggaggagcttcagagcaccgtgcatgccgtggacgaaatgactaccaagacaccagatgaagctgctgcgaacagtaattcaatactcctatggaggc

SEQ ID NO: 41961 - protein, 230 aa, Panicum virgatum
  misc_feature: Ceres CLONE 2009816
  misc_feature (142)..(219): Pfam Name: BolA Pfam Description: BolA-like protein
NPSCLLPLATRAAAAHLVVASCEARSVSRGAGNSASPAADSFFNGGLQQAWQPSKAQRSDSWCPHQLVSCIVQCCSLAALLLRRLSSHSSSAYSVSRRASSALPSQPSASHLATSPPCPLSSSRRTRGFAAWASAPGPAESPATKALEAKIKEQLEADAVRVVDNSGDGRHVCIDVVSKAFEGKSAVNRQRMVYKAIWEELQSTVHAVDEMTTKTPDEAAANSNSILLWR

SEQ ID NO: 41962 - DNA, 475 bp, Panicum virgatum
  misc_feature: Ceres CLONE 2009844
  misc_feature: Encodes the peptide sequence at SEQ ID NO. 41963
acacacaggccacagcaccaccaccggagcacagagagagctcgggagagagcagagcgccacaggccgcccgatcctccgcgcgaagcagatcagatggctctcgctctctccggctcctccgcgctccgcgccgcgctggcctcgctggcccccgccaggggctacgcggcgtcggcggcgtccggggccatgcggcgcgcggcggccgcggcggagggcgccgccgcgggggaggccaaggaggccgggcgcggcgccgcctccgagatctcctgggtccccgaccccgtcacgggccactaccgccccgccaactgggccgccgccgccgacctccgcgccgcgcacctcgcccgggcgtgagccccgcgcccgcccgcccccacccgtctgacataacataccaacaaaggggaaggtggggtggaggttcgtctggcgtcttcgtcggccgcgcgcgcgaacgctcgct

SEQ ID NO: 41963 - protein, 89 aa, Panicum virgatum
  misc_feature: Ceres CLONE 2009844
  misc_feature (1)..(87): Pfam Name: LEA_3 Pfam Description: Late embryogenesis abundant protein
MALALSGSSALRAALASLAPARGYAASAASGAMRRAAAAAEGAAAGEAKEAGRGAASEISWVPDPVTGHYRPANWAAAADLRAAHLARA

SEQ ID NO: 41964 - DNA, 1305 bp, Panicum virgatum
  misc_feature: Ceres CLONE 2009845
  misc_feature: Encodes the peptide sequence at SEQ ID NO. 41965
tctcagagcattgtgcgtagtctcagtcagtcagagagagagagagaatgcagggcttattcacagcacccgctgctgcgtccccggtcacagcggcattgctgcgacgatggactgcggggacgcagcaggttcagcatgccctgcctgggcgcgctccgctctggcgacgtcagcgatttcatcaggggttcatcgtggaggcagtacagagcgaagcacatgccgaagcacacaaaccagttgttgggaagacacagcagcataagggtgagccgagaaacatcgacgaaatgatcggctccatcagagcttcgttgaggtcagcagcaggcggtgatctcgatatctccctatacgacacagcatggatcgcgcttgtgagaaagctggacggtggagaaggcccggagttcccctcgtgcatcgactgtatcgctaggaaccagctcccagatggttcatggggcgatgaggccttcttcgtagcccaagaccgtctcatcaacaccttggcttgcatcatcgctctaaaaacttggaatgttcatagcgacaagtgcaacagaggcttgtcgtttctccatgaaaatatgaagagactacgtgacgatgatgagaattggatgatggtcggttttgagatgaccttcccaacactgatagagatggccaaggatataggccttgacctgccttacgatgagcctgcgttgcaagacatatatgcaaaaagagatctaaaactcgccaagattcctatagatgtactgcactccgtaccaacatctttgctttttagcttagagggaattccaggattagactgggacaggttattcaaactccaggctccagatggctccttctgtgcggcaccagctgcgacagcttatgctcttatacaaacaggggacaagaaatgccacgagtaccttaccgacgtcatcgacaagttcaacgggggagcaccctttatctacccggtggagctgttcgagcgcttatgggttgtcgatcggttggaccggttgggaatatcctcctacttcaggagtgaaattaacagttttttggactatgtttacaggcactggagtgacgaaggcataggttttagctgggtcgtcaactcggtgccggacgtcgatgacacggccatggctatccgtctcctccggcagcatggctaccacatctctaccgaagccataaagcgtttcaagacgaaggatggcgagttcgttgtgtacccggggcagtccagccagtcaccgaccgcgatgtacaacctgtaccgcgctg

SEQ ID NO: 41965 - protein, 419 aa, Panicum virgatum
  misc_feature: Ceres CLONE 2009845
  misc_feature (261)..(419): Pfam Name: Terpene_synth Pfam Description: Terpene synthase, N-terminal domain
  misc_feature: SWISSPROT Homolog: EC 5.5.1.13 Ent-copalyl diphosphate synthase
  misc_feature: Functional homolog of the protein sequence given in SEQ ID NO 51550
  misc_feature: Useful for making plants with modulated biomass
  misc_feature: Useful for making plants with modulated flowering time
  misc_feature: Functional homolog of the protein sequence given in SEQ ID NO 51551
  misc_feature: Useful for making plants with modulated biotic stress sensitivity
MQGLFTAPAAASPVTAALLRRWTAGTQQVQHALPGRAPLWRRQRFHQGFIVEAVQSEAHAEAHKPVVGKTQQHKGEPRNIDEMIGSIRASLRSAAGGDLDISLYDTAWIALVRKLDGGEGPEFPSCIDCIARNQLPDGSWGDEAFFVAQDRLINTLACIIALKTWNVHSDKCNRGLSFLHENMKRLRDDDENWMMVGFEMTFPTLIEMAKDIGLDLPYDEPALQDIYAKRDLKLAKIPIDVLHSVPTSLLFSLEGIPGLDWDRLFKLQAPDGSFCAAPAATAYALIQTGDKKCHEYLTDVIDKFNGGAPFIYPVELFERLWVVDRLDRLGISSYFRSEINSFLDYVYRHWSDEGIGFSWVVNSVPDVDDTAMAIRLLRQHGYHISTEAIKRFKTKDGEFVVYPGQSSQSPTAMYNLYRA

SEQ ID NO: 41966 - DNA, 500 bp, Panicum virgatum
  misc_feature: Ceres CLONE 2009845-R
  misc_feature: Encodes the peptide sequence at SEQ ID NO. 41967
acagcactgttgttagttcgcacagtggagatctgctcagggagacactgttcggccaaccagaatctgaagctttccgagtattcgcagcttgagaagcttacctcttccatctgcagcaaagtttgctctagaattctttctcacaatggaacaaccaaggagaacactgagaatttagaacaacgagtagatcaggagatgcaagagctggctcagtgtgtttatcagacatgcgacgctataagcagggtgaccaagcagacatttctccatgtgactaagagctactgctacgttgctcatgcttcatctgaaacaatcgacagtcacatctccaaggtcatatttgaggatgtcctttagagcaatcccaaccaagaaactatgagtagtactgtctatgacatgctgtattatcacatagacaccgcctgagaaactataattccctatgcataatttgtaattgtggttacaaaataaattcattcaatgac

SEQ ID NO: 41967 - protein, 121 aa, Panicum virgatum
  misc_feature: Ceres CLONE 2009845-R
  misc_feature: SWISSPROT Homolog: EC 5.5.1.13 Ent-copalyl diphosphate synthase
TALLLVRTVEICSGRHCSANQNLKLSEYSQLEKLTSSICSKVCSRILSHNGTTKENTENLEQRVDQEMQELAQCVYQTCDAISRVTKQTFLHVTKSYCYVAHASSETIDSHISKVIFEDVL

SEQ ID NO: 41968 - DNA, 618 bp, Panicum virgatum
  misc_feature: Ceres CLONE 2009849
  misc_feature: Encodes the peptide sequence at SEQ ID NO. 41969
accgctctcatttctcttcccctcatatctctaccttatcctttcctttggagtgctggggagcgccggccgccgagcggcggcgactctcgcgtagacgccgctaaagtctccgccggcgactggacacgcaagattggtcgctggcgaccggccacgcaggacggctgcgtcggcgtcggtgcattcggggctgcagcctccgccaagccgtgggggttatcgttggccaccttctcaaggctgtccaccggcggcaggaggcgctccgagatggtgcggtgcgatgccggtgtggagacccaagcgcaggcgatggccaaggcggccagcgtcgatgcgcttgagcagttcaagatctctgcctactaaaacacaaggggactttcctcttgcgcaaattatgtgctgcagctccgccagatgcggagggacatcgccaagctcctcgaggcggggcaggaggccactgcgcggatcagggtacgtggagcgagttctcgtgcctgtcgatttagagctccccgctgcggggtgctcgggcctccgctcgggccgccaccactgcggggcgctcgggccgccgccggccgctgctgcgggagacggacttggtga

SEQ ID NO: 41969 - protein, 123 aa, Panicum virgatum
  misc_feature: Ceres CLONE 2009849
  misc_feature: SWISSPROT Homolog: EC 1.2.1.70 Glutamyl-tRNA reductase
TALISLPLISLPYPFLWSAGERRPPSGGDSRVDAAKVSAGDWTRKIGRWRPATQDGCVGVGAFGAAASAKPWGLSLATFSRLSTGGRRRSEMVRCDAGVETQAQAMAKAASVDALEQFKISAY

SEQ ID NO: 41970 - DNA, 699 bp, Panicum virgatum
  misc_feature: Ceres CLONE 2009851
  misc_feature: Encodes the peptide sequence at SEQ ID NO. 41971
  misc_feature (565)..(565): n is a, c, t, g, unknown, or other
gcacacacacacacgcacaaacctgcaaatcaccatctaggaagcacaaaaaaaaaaaaacacctactgatcatcgcaagttcagctcaggttaaagggctaggcatgtcaagggcgttggagcctctcattgtggggaaggtgattggtgaggtgctggaccacttcaaccccaccgtcaagatgatggtcacctacaactccaacaagcaggtcttcaatggacacgagttcttcccctccgcagtggccaacaagccgcgtgttgaggtccaagggggcgatctcaggtccctgtttacattggtgatgactgaccctgatgtgccaggacctagtgatccatacctgagggagcaccttcactggattgttactgatattcctgggactactgatgcttcttttgggaaggagctagtgagctacgagaacccaaggccaaccattggcatccacaggttcatattcgtgctgttccggcagaaccgccggcaggcggtgagcccgccgtcgtcgagggaccgcttcagcacccgccaattcgccgaggagaacgacctgngcctccccgtcgccgccgtctacttcaacgcgcagcgcgagaccgccgcccgccggcgctagccgctgaccaactgcagctgaacgtacccaagcaacgaccctacgcaccgtacctgatcttgcatggacaga

SEQ ID NO: 41971 - protein, 173 aa, Panicum virgatum
  misc_feature: Ceres CLONE 2009851
  misc_feature (19)..(165): Pfam Name: PBP Pfam Description: Phosphatidylethanolamine-binding protein
  misc_feature: The sequence is a functional homolog of SEQ ID NO 2 in US patent 7208653
  misc_feature: Functional homolog of the protein sequence given in SEQ ID NO 51458
  misc_feature: Useful for making plants with modulated flowering time
  misc_feature: The sequence is a functional homolog of SEQ ID NO 2 in US patent 7196246
  misc_feature (154)..(154): Xaa is any aa, unknown, or other
MSRALEPLIVGKVIGEVLDHFNPTVKMMVTYNSNKQVFNGHEFFPSAVANKPRVEVQGGDLRSLFTLVMTDPDVPGPSDPYLREHLHWIVTDIPGTTDASFGKELVSYENPRPTIGIHRFIFVLFRQNRRQAVSPPSSRDRFSTRQFAEENDLXLPVAAVYFNAQRETAARRR

SEQ ID NO: 41972 - DNA, 719 bp, Panicum virgatum
  misc_feature: Ceres CLONE 2009876
  misc_feature: Encodes the peptide sequence at SEQ ID NO. 41973
gatggagatggaagcggaggcgacatgcacggagcccaccccctcctgctgccatccacaactttcgcaggaatccatcgcccctagctcgctcgctcgcctcggtcgatccccaagacaagatttgttccgatcctctctctttatatccttccgacgacctgctgcctccgtccgcctcctccattccatcgccgcagccgcagtcaagtgtcgctgccagtgagtgagctcgctctcctgttcattgcaaggttggtattgtcttggcgctagctgttgggcgaaagggatggagcaggcagagggggctgcgaccgcgaggagggcggagctccagctgctgcagcagctagagaaggaggagagcaaggggaagaggaagcgcggccgggtggagctgcggcggatcgaggaccggaccagccggcaggtgcgcttctccaagcggcggagcgggctgttcaacaaggcctacgagctctccgtgctctgcgacgcccgggtcgggctcatcgtcttctcccccgccggccgcctctaccagttcgcctcctctggctccagcattgaagaaatttttggtcgatactgggacctcgccaacacaatagatggtctcaatattgaagcacgagattcaacggttgactgcaacacacagaaggagcagcagtcatctgtcagctctttacctgatcagctgaatatcattgctc

SEQ ID NO: 41973 - protein, 142 aa, Panicum virgatum
  misc_feature: Ceres CLONE 2009876
  misc_feature (38)..(88): Pfam Name: SRF-TF Pfam Description: SRF-type transcription factor (DNA-binding and dimerisation domain)
  misc_feature: Functional homolog of the protein sequence given in SEQ ID NO 51642
  misc_feature: Useful for biocontainment applications
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
MEQAEGAATARRAELQLLQQLEKEESKGKRKRGRVELRRIEDRTSRQVRFSKRRSGLFNKAYELSVLCDARVGLIVFSPAGRLYQFASSGSSIEEIFGRYWDLANTIDGLNIEARDSTVDCNTQKEQQSSVSSLPDQLNIIA

SEQ ID NO: 41974 - DNA, 702 bp, Panicum virgatum
  misc_feature: Ceres CLONE 2009881
  misc_feature: Encodes the peptide sequence at SEQ ID NO. 41975
aaaaaccctcctcccttcctcgccgccttgcccgctcgcagtcgcaggtccagctagggtttgctctccccgccccgccgccgcgcgcgcgctctgcctccagaggctctgaggaggggaagggaagctcccgccgccgcatcagccatggcgtccaccaaggtccagcgtatcatgacccagcccattaacctcatcttccggttcctccagagcaaagcgcgcatccagatctggttgttcgagcagaaggatctccggattgagggtcgcatcattggattcgatgagtacatgaacttggtccttgatgatgctgaagaaatcaatgttaagaagaacactaggaaatcattgggtcggatacttctgaaaggtgacaacataactttgatgatgaacactggcaagtgaaggtcgttggtgtttggcgccaagtttttccgtgaggcatttgtaatccatccagactgaaatgtagaacgtcattgtgtgcgagatatgtactccatccagactgagaatgtagtatgagagtgagattggtatcgctgttgactaaatgggtttaactctgtgagctactgctagatgtgataatgagctgctcacttgtgttctgaagatcaacttgactcgtgtgtgctttgttgacatctttttttggtctcatggtcaggtttagctatttttatcttgctc

SEQ ID NO: 41975 - protein, 88 aa, Panicum virgatum; identical to SEQ ID NO: 14684
  misc_feature: Ceres CLONE 2009881
  misc_feature (19)..(85): Pfam Name: LSM Pfam Description: LSM domain

SEQ ID NO: 41976 - DNA, 667 bp, Panicum virgatum
  misc_feature: Ceres CLONE 2009916
  misc_feature: Encodes the peptide sequence at SEQ ID NO. 41977
aaccaaggcacgcttgctcttgcaactcctcatcatctccaagtgtgcgtgtcttgattccctctccgctaccagccatggcgtcgccgttctccgtgccctccttgatcatggaggaggaagggcggttcgaggctgaggttgccgaggtggagtcgtggtggggcacggagcggttccggctcaccaagcgcccctactccgcccgcgacgtcgtgctcctccgcggcacgctccgccagagctacgcctcgggcgagatggccaagaaactatggcgcacgctgaaagcgcaccaggccgctggcacggcctcccgcacgttcggcgccctcgaccccgtccaggtgaccatgatggccaagcacctcgacaccatctacgtgtccgggtggcagtgctcctccacgcacacctccaccaacgagcccggccccgacctcgccgactacccctacgacaccgtgcccaacaaggtggagcacctcttcttcgcgcagctctaccacgaccgcaagcagcgcgaggcgcgcatgtcgctgccccgctccgaccggaccagagcgtcctacgtcgacttcctcaagcccatcatcgccgacggcgacacgggcttcggcggcgccacggccaccgtcaagctctgcaagctcttcgtcgagcgcgg

SEQ ID NO: 41977 - protein, 196 aa, Panicum virgatum
  misc_feature: Ceres CLONE 2009916
  misc_feature (21)..(196): Pfam Name: ICL Pfam Description: Isocitrate lyase family
  misc_feature: SWISSPROT Homolog: EC 4.1.3.1 Isocitrate lyase
MASPFSVPSLIMEEEGRFEAEVAEVESWWGTERFRLTKRPYSARDVVLLRGTLRQSYASGEMAKKLWRTLKAHQAAGTASRTFGALDPVQVTMMAKHLDTIYVSGWQCSSTHTSTNEPGPDLADYPYDTVPNKVEHLFFAQLYHDRKQREARMSLPRSDRTRASYVDFLKPIIADGDTGFGGATATVKLCKLFVER

SEQ ID NO: 41978 - DNA, 702 bp, Panicum virgatum
  misc_feature: Ceres CLONE 2009950
  misc_feature: Encodes the peptide sequence at SEQ ID NO. 41979
tgatcagccaccaagcaagtcagctaggcaaggcggttaggccatcgtcttgggtgcccaagaaggcaagaaatcgatataatccttctctcagacagacttcgccctcctccggcaaatcccacgctggtttcgggatgtcgacggaactcctgacgaaattcctcacgttgctgtttgggtacgcgatgccggcgctggagtgcttcaaggcgatcgagcagctgcccggccgggctgaccagctccgattctggtgcgagtattggatcatcctagtgctcctggttatgttcgacgaaattgctggcgttctgatttccaagattccaatgtactacgagctcaagcttgccttcctcgtgtacctgtggtacccgaagacaaggggaacagagatcgtgtacgagaccttcctccagcccctggtgatgcagtatcatcccagcatcgaggcgaggcttcagtacctacgcgccaatgccggtgacatccttgtcttctacctcaagaacttcacggagaggggctatgacctcttcctccgggtaatggactacgtccggtcgcaggcgtccagaggatcaagaacaaggagtttcttctcgttcagaggggaccgggctgagaggccgagcttcaccgacgactacgcaattgggtggcgaccgggagggatgggggggaggcaccggcgaccgc

SEQ ID NO: 41979 - protein, 188 aa, Panicum virgatum
  misc_feature: Ceres CLONE 2009950
  misc_feature (2)..(98): Pfam Name: TB2_DP1_HVA22 Pfam Description: TB2/DP1, HVA22 family
MSTELLTKFLTLLFGYAMPALECFKAIEQLPGRADQLRFWCEYWIILVLLVMFDEIAGVLISKIPMYYELKLAFLVYLWYPKTRGTEIVYETFLQPLVMQYHPSIEARLQYLRANAGDILVFYLKNFTERGYDLFLRVMDYVRSQASRGSRTRSFFSFRGDRAERPSFTDDYAIGWRPGGMGGRHRRP

SEQ ID NO: 41980 - DNA, 1880 bp, Panicum virgatum
  misc_feature: Ceres CLONE 2009951
  misc_feature: Encodes the peptide sequence at SEQ ID NO. 41981
gtttccgttcccccggcctcgcttatttggcaccgctcgctcgctcgctcgcgcctctctctctctcctctcgcctgtcagctagctcagctgaagctcgcggcagtcatcgccggtcagctcagctcgcggccaccctagacgaccgcgatcgatcgagggcctaccagggctgcggctccatcgtccaccgtgctgctacctcatcatcatcatcatgctagagaaccaaaagcaagcggaggttctctggcccaggctggtggccaacaagcttttccggaagacctccggcagccacgccttcgtcgccgacttcccggtcgccgatgacgccgccgccttcgacgacggcgggtgcagccccgacgcggacgccagccgctgcgttaagcgggcgcggccgcaggagcggagcaagaccctcaagtacaagctgttcgcgagcacgtggaacgtgggcggcgtggcgccgccggacgacctggacctgtcggactggctggacgcccgcgacgggccctacggcgtgtacgtgctcgggttccaggaggtggtgccgctgcgcgcgcgcaacgtgctgggcgcggacaagagccgcgtcgggatgcggtggatcgagctcatccgcgccgcgctcaaccggtccgcggcggcgtcgtcggcgtcctcgccgagaggggccggcggcggcggagacagcggcagcaggcagaaggtgcacccggtgcgcgacggcggcggcggcggcggcggcgggctggcgcgcgagtaccagtgcgtggtgagcaagcagatggtgggcatcctcctgacggtgtgggtgcgcgccgacctccggcgcttcgtccggcgcgccagcgtctcgtgcgtggggtgcggcgtcatgggctgcctcggcaacaagggcgccgtgtccgtccgcttctggctacacgacaccagcttctgcttcgtgtgctgccacctcgcctcgggcggccgcgacggcgacgaggcgctccgcaacgccgacgccacggagatcctcgcccggacgtccttcccgcgggggcacgccctcaacctgcccaacaagattctcgaccacgaccgggtgatcctgctgggggacctcaactacaggatctcgctgccggaggccaagacgcggctgctggtggagcggcgggactggaagacgctgctggagaacgaccagctgcgcgccgaggtgacgcgcggcggcggcgcgttccggggctggagcgagggcgacatcgccttctcccctacctacaagtactaccccaactccgacacctactacggtggccgcgcggccgccggcggcggcggcggcaggaagggcgagaagcggcgcgcgccggcgtggtgcgaccgcatcctgtggcgcggcgccgggctcagccagacgcgctacgaccgctgcgagtcgcggctgtcggaccaccgccccgtccgcgccgtcttcaccgtcgaggtggacgcgcccaggaacctcaactcgctcaggagcttcttcatgtccgagaggttcgacagggccaggagccccgccgccgaccggctgctccggaaggacgacgtcaacagcgccaggttcgccgagagcccgagactctctgacacaaggaccacgccaggcagcgcacggtctgccttacttctaggagtgggtggaatcgtcactccgattctccaattgtacacaggcaaaaagtatatatgattgttcagttctgagtgagtattcatatgatcgtatctacatctacaggtagctaggatacagagatgtttttttccaccctgttcctgacttgctgtaactgcatctgtactcttcatcttgatccattgagtatgaagttgtctcg

SEQ ID NO: 41981 - protein, 504 aa, Panicum virgatum
  misc_feature: Ceres CLONE 2009951
  misc_feature (74)..(419): Pfam Name: Exo_endo_phos Pfam Description: Endonuclease/Exonuclease/phosphatase family
  misc_feature: SWISSPROT Homolog: EC 3.1.3.56 Inositol-polyphosphate 5-phosphatase
MLENQKQAEVLWPRLVANKLFRKTSGSHAFVADFPVADDAAAFDDGGCSPDADASRCVKRARPQERSKTLKYKLFASTWNVGGVAPPDDLDLSDWLDARDGPYGVYVLGFQEVVPLRARNVLGADKSRVGMRWIELIRAALNRSAAASSASSPRGAGGGGDSGSRQKVHPVRDGGGGGGGGLAREYQCVVSKQMVGILLTVWVRADLRRFVRRASVSCVGCGVMGCLGNKGAVSVRFWLHDTSFCFVCCHLASGGRDGDEALRNADATEILARTSFPRGHALNLPNKILDHDRVILLGDLNYRISLPEAKTRLLVERRDWKTLLENDQLRAEVTRGGGAFRGWSEGDIAFSPTYKYYPNSDTYYGGRAAAGGGGGRKGEKRRAPAWCDRILWRGAGLSQTRYDRCESRLSDHRPVRAVFTVEVDAPRNLNSLRSFFMSERFDRARSPAADRLLRKDDVNSARFAESPRLSDTRTTPGSARSALLLGVGGIVTPILQLYTGKKYI

SEQ ID NO: 41982 - DNA, 704 bp, Panicum virgatum
  misc_feature: Ceres CLONE 2009956
  misc_feature: Encodes the peptide sequence at SEQ ID NO. 41983
gtgattttgtttcagctgtccgcaaacttgcatcccaaaattcaggccactggaagtttaagaaaggtcctgaatatggaaatggtgtttcgtctcattctgtaccgaaacagtacggtactagcaccaaacaatcatctgggaacaaatttcaaagtgtcagcggtgcaagagttgctccatggctcgagactggtgatgctgtggcaaatatgtactccgaatcaaggggggaagctcgggattttgctagggtcagaaatgcttgctttgagcaggctagacaggcttacttagttggcaacaaagctctggccaaggaactgagcatgaagggtcaggcgtacaatgcacaaatgaaagcagctcatgagaaagccagagaagctatttatcgacaaaggaatcctgtttcgcaacggggaggtgatggtctgattgatttacatggactgcatgtgagtgaagcaatccacatcctaaaggttgagcttgctgccatgaagagcgcagcaagggctgcaggggagaggatgcaggtcatggtatgtgtcgggacaggccaccacaccaagggctcgcgcaccgcaaggttgcccatcgccgtggaacagttcctcctggacgaaggcctccactacacgcagcctcaaccagggtcttctccgcgtcatggtgtactaacatctcttaggtaagacacc

SEQ ID NO: 41983 - protein, 231 aa, Panicum virgatum
  misc_feature: Ceres CLONE 2009956
  misc_feature (146)..(231): Pfam Name: Smr Pfam Description: Smr domain
DFVSAVRKLASQNSGHWKFKKGPEYGNGVSSHSVPKQYGTSTKQSSGNKFQSVSGARVAPWLETGDAVANMYSESRGEARDFARVRNACFEQARQAYLVGNKALAKELSMKGQAYNAQMKAAHEKAREAIYRQRNPVSQRGGDGLIDLHGLHVSEAIHILKVELAAMKSAARAAGERMQVMVCVGTGHHTKGSRTARLPIAVEQFLLDEGLHYTQPQPGSSPRHGVLTSLR

SEQ ID NO: 41984 - DNA, 677 bp, Panicum virgatum
  misc_feature: Ceres CLONE 2009957
  misc_feature: Encodes the peptide sequence at SEQ ID NO. 41985
ctttcctcgcgagtcccacccaaaccctcgttccctctcttccgacctcgccgccgccgcctcgacctacgcccggaggacttcgtcgcggcgttccggaacaaggagcgcgacttcctacggatgaggacccgcctcaaggtccgcaagcagccgcccgccgaggcgctcggttccaagctcatcttcgcgatccgcatccctggctctgtggacttgcatccgcacatcaggaaaatcttgaggaagctacggctgacgaaggtcctcaccggcgtgttcctcaaggccaccgatttgacgctcaagaggcttctcgtggttgaaccgttcatcacctacgggttcccgaacttgaagaatgtgaaagagcttatttacaagaagggccgtgggttcttggataaggagcctttccctcttaccagcaacgatctaattgagaaggctcttggagatcatggcatcatatgcttggaagaccttgtgcatgaaattgccactgttgggccccacttccaggacacgtcaaagttcctcatgcccttcaagctcaagtgtccagagaggaggctgcagatgaagaagaagccctacaaggacggtggtgactcaggcgaccgaggcgacaaaatcaacgaactaattgagaagttaaactaaagcggagcttgttg

SEQ ID NO: 41985 - protein, 220 aa, Panicum virgatum
  misc_feature: Ceres CLONE 2009957
  misc_feature (61)..(112): Pfam Name: Ribosomal_L30 Pfam Description: Ribosomal protein L30p/L7e
LSSRVPPKPSFPLFRPRRRRLDLRPEDFVAAFRNKERDFLRMRTRLKVRKQPPAEALGSKLIFAIRIPGSVDLHPHIRKILRKLRLTKVLTGVFLKATDLTLKRLLVVEPFITYGFPNLKNVKELIYKKGRGFLDKEPFPLTSNDLIEKALGDHGIICLEDLVHEIATVGPHFQDTSKFLMPFKLKCPERRLQMKKKPYKDGGDSGDRGDKINELIEKLN

SEQ ID NO: 41986 - DNA, 673 bp, Panicum virgatum
  misc_feature: Ceres CLONE 2009985
  misc_feature: Encodes the peptide sequence at SEQ ID NO. 41987
aaaatcccctcgagagccctgcaattttcagcctcccaaacccagcgattcgagccggtggcggcggcggcggcggccacggtcggttcgtggcatggcggagattcgcaagtacgccatgtccaaccaggcgccagatattcctcagatactactggaagctcagaataggtggctgcggcccaccgaaatctgccaaatattgtcaaactacaagaagttctccattgcacctgagccgccaaacagacctccaagtattgcttcttcctacttgccctatttttctcctgaatactgaagcatgcagtgttagccagttaatctttcctggtttgctggggtgctggattgctgtagaatcgtgctcaggtggcatgtaggatggtagcagcatgatgatgcattctgataatttattatgttgtagggagatatatagattatcgcttctgttttctggaagacatcaggactgcagttttactatttttcctttttttttgtgtgtggatgccttagatttgcgctcaggtggtttatagcatggaagtggcatcatggatacattctaggatctttaatttacaacatatatttgataatgttcgaacttctaatttatcaaccatgctaattggttcaatgaacttttagcagatccgggaccgtt

SEQ ID NO: 41987 - protein, 68 aa, Panicum virgatum
  misc_feature: Ceres CLONE 2009985
  misc_feature: The sequence is a functional homolog of SEQ ID NO 1308 in the 10/666,642 US patent application
  misc_feature: The sequence is a functional homolog of SEQ ID NO 588 in the 10/666,642 US patent application
MAEIRKYAMSNQAPDIPQILLEAQNRWLRPTEICQILSNYKKFSIAPEPPNRPPSIASSYLPYFSPEY

SEQ ID NO: 41988 - DNA, 682 bp, Panicum virgatum
  misc_feature: Ceres CLONE 2009990
  misc_feature: Encodes the peptide sequence at SEQ ID NO. 41989
aacatgccgcggccgcctccctcagatcctccgtcctcgctcggtcaagtgccgccgctacccccctccgtcactcttctcccgtggccaccacccaccgcatccgccgctccccgcccctctccaccggctggtttggtttgtctctgaaaggcggcggcggagatgtcggaaaagaagcgcggcggcggcggcacccgcaaggacgaggtggtgacccgcgagtacaccattaacctccacaagcgcctccacggatgcaccttcaagaagaaagcaccaaatgccatcaaagagatcaggaagtttgcacagaaggctatgggaaccactgatgtccgaattgatgtgaagctcaacaagcacatctggagcagtggtatccggagcgttccaaggcgagttcgcgtcagaatcgcccggaagaggaatgatgaggaagatgccaaggaggagctctactctctggtcacagttgctgagatccctgcagagggtctcaaaggtttgggtactaaggttgttgaggatgaggattaagccctcccatggattgaatctgctagcacttagtgcatatcatgagagcaagtttgagaatgttaccttagcttattgttatctaccgttgatgacttatgtaatagaagattcaagactttgctcatttctttcaagtgct

SEQ ID NO: 41989 - protein, 124 aa, Panicum virgatum; identical to SEQ ID NO: 12126
  misc_feature: Ceres CLONE 2009990
  misc_feature (12)..(106): Pfam Name: Ribosomal_L31e Pfam Description: Ribosomal protein L31e

SEQ ID NO: 41990 - DNA, 476 bp, Panicum virgatum
  misc_feature: Ceres CLONE 2009991
  misc_feature: Encodes the peptide sequence at SEQ ID NO. 41991
cacacaggaagcactccaccttcttcagccgcgctacctgctttccttcctgcttgctcgtgatcaccgagatcaggatgtctggttgcagcggcggcaaatgcgggagcggctccgcctgcaactgcggcagcggatgcaacgggtgcaagatgttccctgacatggaggcagcctccacctccaccaccatggtcatcgccgccgccagcaacaaggcgaggtccggcggggtcagggcggccacagagagcggaggctgcgagtgaaacacgtgatagagcgggaccagctgcagctgctcctgctgcacctgcaaatgaggcggccatgcgccgccgacatgaaaacacgaggagaaagccccccggcgtagtatataggagcagcgtctaaataagatcttgccaactgcgccgtccatcatctaccgatgtcgtgtcgtgacatccatggtcgcctgccgtgtctcagct

SEQ ID NO: 41991 - protein, 63 aa, Panicum virgatum
  misc_feature: Ceres CLONE 2009991
  misc_feature (1)..(63): Pfam Name: Metallothio_2 Pfam Description: Metallothionein
MSGCSGGKCGSGSACNCGSGCNGCKMFPDMEAASTSTTMVIAAASNKARSGGVRAATESGGCE

SEQ ID NO: 41992 - DNA, 1371 bp, Panicum virgatum
  misc_feature: Ceres CLONE 2009993
  misc_feature: Encodes the peptide sequence at SEQ ID NO. 41993
atcattcattctcccctcgccccgactcaggctctctcgcaaacacctcgtcgccctttcccctccctttcccagatccagacacacaccacgacgagtctcgagtcgaaaatcacagatcacaatggcagcccccagcagcagtgctaacggccttaagccgaccggcggcctgtctgctaacgacaacatccgccggttcgctgcgcccagccggccgctgagcccgctccccgcccacgcgctgttcaacgacaagacaagatgcttcgtctacggcctgcagccgcgtgccgtgcagggcatgctcgatttcgacttcatctgcaagcgggcgacaccgtcggtcgctggtattatctacacattcggcggtcaattcgtcagcaagatgtattggggcaccagcgagacgctgctccccgtgtaccagcaggtcgagaaggcgatggccaagcaccccgacgttgataccgttgtcaacttcgcttcgtcccgtagtgtctacagctcgaccatggaactcatggagaacccccaaattaagaccatcgctattmttgctgagggtgtcccggagcgccgtgcccgcgagatcgcgcatgtcgcgcagaagaagggtgtcacaatcattggccctgctaccgttggtggcatcaagcccggcagcttcaagattggcaacactggtggtatgatggacaacatcgttgcttccaagctctaccgcaagggctcggtcggctacgtctccaagtccggcggcatgtccaacgagctgaacaacatcatctcgcagacgacagacggcgtctacgagggtgtggcgatcggtggtgatcggtaccccggcaccactttcatcgaccacttgctgcgttaccaggccgaccctgactgcaagattctcgtgcttctcggcgaagtcggtggtgttgaggagtacaaggtgatcgaggccgtcaagcagggcgtgatcaccaagcccattgtggcgtgggccattggtacctgcgcgagcatgttcaagaccgaggtccaattcggccacgccggttcgttcgccaactcgcagctcgagacggcggccatgaagaaccagagcatgcgggacgctggtttccacgtccccagcacattcgaggacatgccggcgctcctcaagtctgtctacgacaagctcgtgagccagggcaccatcaagccccagcccgagcctgttgtgcccaagatccccatcgactactcgtgggctcaggagctcggccttatccgtaagcccgccgccttcatctcgaccatctcggatgaccgtggccaggagcttctctacgctggcatgcccatctcggacgtgtttagggaggacat

SEQ ID NO: 41993 - protein, 415 aa, Panicum virgatum
  misc_feature: Ceres CLONE 2009993
  misc_feature (191)..(336): Pfam Name: Ligase_CoA Pfam Description: CoA-ligase
  misc_feature (41)..(150): Pfam Name: CoA_binding Pfam Description: CoA binding domain
  misc_feature: SWISSPROT Homolog: EC 2.3.3.8 ATP citrate synthase
  misc_feature (146)..(146): Xaa is any aa, unknown, or other
MAAPSSSANGLKPTGGLSANDNIRRFAAPSRPLSPLPAHALFNDKTRCFVYGLQPRAVQGMLDFDFICKRATPSVAGIIYTFGGQFVSKMYWGTSETLLPVYQQVEKAMAKHPDVDTVVNFASSRSVYSSTMELMENPQIKTIAIXAEGVPERRAREIAHVAQKKGVTIIGPATVGGIKPGSFKIGNTGGMMDNIVASKLYRKGSVGYVSKSGGMSNELNNIISQTTDGVYEGVAIGGDRYPGTTFIDHLLRYQADPDCKILVLLGEVGGVEEYKVIEAVKQGVITKPIVAWAIGTCASMFKTEVQFGHAGSFANSQLETAAMKNQSMRDAGFHVPSTFEDMPALLKSVYDKLVSQGTIKPQPEPVVPKIPIDYSWAQELGLIRKPAAFISTISDDRGQELLYAGMPISDVFRED

SEQ ID NO: 41994 - DNA, 529 bp, Panicum virgatum
  misc_feature: Ceres CLONE 2009993-R
  misc_feature: Encodes the peptide sequence at SEQ ID NO. 41995
ctgcaagatgctcgatttcgcgctggcggtcgagtcggtgacgacgtcgaagaaggacaacctgattctgaatgtggacggctgcattgccgtctgcttcgttgacctcatgcgcaactgcggcgccttcagcaacgaggaggccgaggactaccttagcatgggtgtacttaacggcctgttcgtgctcggccgcagcatcggtctgattgcccactacctcgatcagaagcgcctgcgcaccggcctgtaccgccacccttgggatgacatcacctacatcctcccgagcctgcagcaggcgggcccgccgggcaccgagggtcgcgtggaggtgcagatgtaaggggccgcttatttttagacgaagttagagatgcaacgttttctacgagatttgggacgggctcttcaacatgggatgtgacatgaatttcctcttgcggagcgccagcagggtccgaggcggcccggctcgtggagggtaggacaggcccggattagttctagaaattttaatcagtgactg

SEQ ID NO: 41995 - protein, 114 aa, Panicum virgatum
  misc_feature: Ceres CLONE 2009993-R
  misc_feature: SWISSPROT Homolog: EC 2.3.3.8 ATP citrate synthase
CKMLDFALAVESVTTSKKDNLILNVDGCIAVCFVDLMRNCGAFSNEEAEDYLSMGVLNGLFVLGRSIGLIAHYLDQKRLRTGLYRHPWDDITYILPSLQQAGPPGTEGRVEVQM

SEQ ID NO: 41996 - DNA, 646 bp, Panicum virgatum
  misc_feature: Ceres CLONE 2010037
  misc_feature: Encodes the peptide sequence at SEQ ID NO. 41997
atctcgaacgctcgcctcgccggccccgcttcaatcccaagcagtcctcgacgcagatggcagttcccggcggccgcaacgggctcagggacgacgaggacgacatcgccgagcacgccgaggtcttcgccggcgcctccgacgacgaggatgtgcctccccacctccgcgccctcgccaacgccgcccagaccggcgacgtcgacgccctccgtgccgccctcgaaaaccatgatggcagtattgatgttcctgttgaagatggcgatactctgcttcacctggcacgcttatatggccatcttccttgtgttcagctactgttggaacgtggggctagcttggaatgcaaagatgaagaaggtgcaattcctcttcacgatgcttgtgctggaggcttcactgagatggtccaatatatgctcaacttcgctgctaacagggatgattgtatagtgcgaatgctcaacactgttgattctgaaggcgatacaccgctccatcatgctgctagaggagaacatttggatgttgtcaagcttttgctcgaggccggggcatctcccaagaaagagaacacttatgggcagacacccgctgatatggctgaacaagacactgaaagtcgaaccctgttgcttgcgaa

SEQ ID NO: 41997 - protein, 196 aa, Panicum virgatum
  misc_feature: Ceres CLONE 2010037
  misc_feature (143)..(175): Pfam Name: Ank Pfam Description: Ankyrin repeat
  misc_feature (69)..(101): Pfam Name: Ank Pfam Description: Ankyrin repeat
  misc_feature: SWISSPROT Homolog: EC 2.4.2.30 NAD(+) ADP-ribosyltransferase
MAVPGGRNGLRDDEDDIAEHAEVFAGASDDEDVPPHLRALANAAQTGDVDALRAALENHDGSIDVPVEDGDTLLHLARLYGHLPCVQLLLERGASLECKDEEGAIPLHDACAGGFTEMVQYMLNFAANRDDCIVRMLNTVDSEGDTPLHHAARGEHLDVVKLLLEAGASPKKENTYGQTPADMAEQDTESRTLLLA

SEQ ID NO: 41998 - DNA, 690 bp, Panicum virgatum
  misc_feature: Ceres CLONE 2010054
  misc_feature: Encodes the peptide sequence at SEQ ID NO. 41999
aaaccaagaaccaactcttcacaagaccgtgcaccaaacagagcagagcagcgcctccccgacggtgtacccggcggccggggacgcggaggaggaggcgacgcagacggcgaccgggtggccctccgtgtcgtacctccggaagcggcgccggtgcctgctgtgctgcggcggctgctgcgtcaccaccacggtggtcgtcggcatcatcatcctggtgctcgcgctcaccgtcttcaaggtcaaggacccgcgcatgaccatgaacaacgtctggctcacggccatcagctcggggcccgggacgggggtcacgagccccgtcgccaccaacgccaccatcaccgccgacgtctccatcaagaaccccaacgccgcggcgttccggttctcgcgctccgcgacggacgtctactacaaggggcagacgatcagcgtggcgtacgtgcccgccggcaaagtcggcgccgaccggacgctgaggacgaacgtgaccgtcgacctcctcgccgaccgcctcgccagcgccatgaacaccacgggcctcatcttcggccaggagtacgacatcaccacccacacggagatgaacgggagggtcagtatattggggatcatcaagaagcacatcgggatcaagctcaactgcaccatcgtcatcgaggtcgggggcgcggccgcggcgatcca

SEQ ID NO: 41999 - protein, 229 aa, Panicum virgatum
  misc_feature: Ceres CLONE 2010054
  misc_feature (76)..(216): Pfam Name: Hin1 Pfam Description: Harpin-induced protein 1 (Hin1)
NQEPTLHKTVHQTEQSSASPTVYPAAGDAEEEATQTATGWPSVSYLRKRRRCLLCCGGCCVTTTVVVGIIILVLALTVFKVKDPRMTMNNVWLTAISSGPGTGVTSPVATNATITADVSIKNPNAAAFRFSRSATDVYYKGQTISVAYVPAGKVGADRTLRTNVTVDLLADRLASAMNTTGLIFGQEYDITTHTEMNGRVSILGIIKKHIGIKLNCTIVIEVGGAAAAI

SEQ ID NO: 42000 - DNA, 637 bp, Panicum virgatum
  misc_feature: Ceres CLONE 2010056
  misc_feature: Encodes the peptide sequence at SEQ ID NO. 42001
acgtcgatcgcaatcgccttctgatttcgcagacgaaatcccctcttccgcagctaatcgcctcggcaagatgcagatctttgtgaagaccctgaccagcaagaccatcaccttggaggttgagtcctcggacacaatcgacaatgtgaaggccaagatccaggacaaggagggcatccctccagaccagcagcggctcatctttgctgggaagcagcttgaggacggccgcacccttgctgactacaacatccaaaaggagtccaccctccacctcgtcctacgcctccgtggtggcatgcagatctttgtgaagacccttactggcaagaccatcaccctggaggtcgagtcatctgacaccattgacaatgttaaagccaagatccaggataaggagggcatccccccggaccagcagcgcctcatctttgctggcaagcagcttgaggacggccgtacccttgctgactacaacatccagaaggagtccaccctccaccttgttctgcgcctgcgtggtggtctgtgaccaagttctggtgcagcattagctctggtgtcatcgtgccatggtcaaattggagttttagatgaacaaactttgggtcttcgtgatagtatgtcagtatgtaca

SEQ ID NO: 42001 - protein, 176 aa, Panicum virgatum
  misc_feature: Ceres CLONE 2010056
  misc_feature (105)..(173): Pfam Name: ubiquitin Pfam Description: Ubiquitin family
  misc_feature (29)..(97): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
RRSQSPSDFADEIPSSAANRLGKMQIFVKTLTSKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGL

SEQ ID NO: 42002 - DNA, 734 bp, Panicum virgatum
  misc_feature: Ceres CLONE 2010089
  misc_feature: Encodes the peptide sequence at SEQ ID NO. 42003
attcccccacagcacacacagcagctaatccagactcacactactgcagcatttgctttgcttagcacgaccgccgatcgataattaataataatacaacgataatggcggctctgatgatgaagaacaagaagcagatgcaggcggtggcggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctgaacagcgcggcgcgcacgagctcggaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagctcgatccgctcagaaggcgagctatattcaggagaataaaataaagttgaggcatcatcagcagcacatcatctatatatattatattattgttgtactcgatctgtgtgtacgtgcgcgtatacatacatgcatgcttatactacgatcgatgtatatatatgtgctgcttctctcacaagtacgtgtgctcatatat

SEQ ID NO: 42003 - protein, 126 aa, Panicum virgatum
  misc_feature: Ceres CLONE 2010089
  misc_feature (37)..(122): Pfam Name: Tryp_alpha_amyl Pfam Description: Protease inhibitor/seed storage/LTP family
MAALMMKNKKQMQAVAALAVVVAAAALVASASAAITCGQVGSALAPCIPYATGKASALPSSCCGGVRSLNSAARTSSDRQAACRCLKSLASTVKSVNMGTVATIPGKCGVSVPFPISMSTDCNKVN

SEQ ID NO: 42004 - DNA, 628 bp, Panicum virgatum
  misc_feature: Ceres CLONE 2010096
  misc_feature: Encodes the peptide sequence at SEQ ID NO. 42005
aactctcatcccattccttccaagccacctctgctctgctcactctgtcctcctcgcggttgctaagctaagctaagctaagcaaagcttaaggcaagctaggcggcatgggcaaggacgacgtgatcgagggcggcgccggcggcggcgagttcgcggccaaggactacacggacccgcccccggcgccgctgatcgacgcggcggagctggggtcgtggtcgctgtaccgcgccatgatcgccgagttcatcgcgacgctgctctacatggtggcgcagtgcctgggcgccatctgcggcgtcggcctcgtcaaggccttccagagcgcctacttcgaccgctacggcggcggcgccaactcgctcgcctccggctactcccgcggcaccggcctcggcgccgagatcatcggcaccttcgtcctcgtctacaccgtcttctccgccaccgaccccaagcgcaacgcccgcgactcccacgtcccggtgctggcgccgctccccatcgggttcgccgtgttcatggtccacctggccaccatccccgtcaccggcaccggcatcaaccccgccaggagcctcggcgccgcctgagtagccttcttcctgtgacctgtgagcttgca

SEQ ID NO: 42005 - protein, 162 aa, Panicum virgatum
  misc_feature: Ceres CLONE 2010096
  misc_feature (34)..(162): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
MGKDDVIEGGAGGGEFAAKDYTDPPPAPLIDAAELGSWSLYRAMIAEFIATLLYMVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAA

SEQ ID NO: 42006 - DNA, 639 bp, Panicum virgatum
  misc_feature: Ceres CLONE 2010100
  misc_feature: Encodes the peptide sequence at SEQ ID NO. 42007
gaagagggccagaaatcagtgtccgtctaccttcctgggaaggagtcatggtatgacttaaggaatggatctccatacaagggaagcatgtcacacaaactacaagttctagaagatagcattcccagcttccaaaggggtggcacaattgtcccaagaaaggatagattcaggcgcagttctactcagatggtgaacgacccatacaccctggtgatagccctcaatagctcaaatgctgctgaaggcgaactttatgtggatgatgggaaaagttatgattaccagcaaggggcattcatccatcgccgctttgtttttgcagacattaagctaacttcattgaatattgcacctgataatttgggcaagaagaaatttactagtgactgtgtggttgaaagaattataatcctcggcttacgatcgggagcaaagaaggctattattgagcctggaaaccgagaagtggaaattgaatcaggtccggttagtttaaggagtggttctagcccagttgcgccaacaatccggaggcccaatgttcgcattgcggacgattggacgataaggatagcttaagaggtaggccattcgcatctggagcctgatgtctcttttggtcactgtcaggttgga

SEQ ID NO: 42007 - protein, 193 aa, Panicum virgatum
  misc_feature: Ceres CLONE 2010100
  misc_feature: SWISSPROT Homolog: EC 3.2.1.84 Glucan 1,3-alpha-glucosidase
EEGQKSVSVYLPGKESWYDLRNGSPYKGSMSHKLQVLEDSIPSFQRGGTIVPRKDRFRRSSTQMVNDPYTLVIALNSSNAAEGELYVDDGKSYDYQQGAFIHRRFVFADIKLTSLNIAPDNLGKKKFTSDCVVERIIILGLRSGAKKAIIEPGNREVEIESGPVSLRSGSSPVAPTIRRPNVRIADDWTIRIA

SEQ ID NO: 42008 - DNA, 733 bp, Panicum virgatum
  misc_feature: Ceres CLONE 2010109
  misc_feature: Encodes the peptide sequence at SEQ ID NO. 42009
agcttgaggtggcacgctcgctcgagctcggctcattcacagccctcccggctcctgctcagggctcagggcctctgtctctcccttctctcagactctccttgctcttccttccctggcggcgacgactgggcgagcggcgacgccatttctcacgtcttcgtcaagccctttgccggcgacggagacgaccatcctccagacatggatgcgtcaggccttccagcattcgccaatggagagatgctgaagacgttggttgggcgaagagtgcgcacagtggttcaagtccagcgccgtgaaggcggactccttgttgggcagtcaactgacgggcatcagttgattattagaggtgtcatggatgtccctgtatcacactttatggaggtttttggaactgctgaaggcgaccagtctatcagtgctgaagtttgcacagatttcggcaacaactttgatgctgaatcattcaatggactgtgcaagtttgcgaacatggtcaaggagccgttcctgtagagttcagtatctgacataagttgatgtcttagatttgaagatttggctaaatgtttcttcataacctcagtgatctgttgctgtcagtattgggtatctcttatgacctattaatctaagctatgtaacaaggaagacaagtgactcatggtctcatgtagtagatgagattactgcgtttgtttcctccaagcaaacgagcagaagcttt

SEQ ID NO: 42009 - protein, 105 aa, Panicum virgatum
  misc_feature: Ceres CLONE 2010109
  misc_feature (1)..(104): Pfam Name: Rep_fac-A_3 Pfam Description: Replication factor A protein 3
MDASGLPAFANGEMLKTLVGRRVRTVVQVQRREGGLLVGQSTDGHQLIIRGVMDVPVSHFMEVFGTAEGDQSISAEVCTDFGNNFDAESFNGLCKFANMVKEPFL

SEQ ID NO: 42010 - DNA, 659 bp, Panicum virgatum
  misc_feature: Ceres CLONE 2010130
  misc_feature: Encodes the peptide sequence at SEQ ID NO. 42011
aaccaaaatccgaacctcagcggcggcggcggcggcaagtaggagtggattgcatcctgcgatggggagcgataccgaggcagagaacaagagggctccggtcgccctggcccccatcgcgaagccccttgcgggcaagaagctctgcaagcggaccctcaagctcgtccgccgagcttctgaggccaaatgcttgaagcgaggagtcaaggaggttgtgaagagcattcgccggggcaacaaggggttgtgtgtgattgctggcaacatttctcccatcgatgtaataactcatgttccagtactctgtgaagaagccaatattccttacgtatatgttccctcgaaagaggatcttgcaaccgctggcaccaccaagaggcctacctgctgcgtgctggtgatgaccaagccagccaagggggagctcgagggcgaggtcaaggagaagctcaatacagactacgaccaggtcatgtctgaagttgctgaggccacgtcggcgatgttctgagcaatctcacggggcccacagaagcgctgaaccggcatctcttcttcttgccctgtctgtactgtaactctgtgcaacgccagcatgacctctggacgattacaaatgtgcctctttttcccccctatgaatgaactcactgatg

SEQ ID NO: 42011 - protein, 150 aa, Panicum virgatum
  misc_feature: Ceres CLONE 2010130
  misc_feature (30)..(124): Pfam Name: Ribosomal_L7Ae Pfam Description: Ribosomal protein L7Ae/L30e/S12e/Gadd45 family
MGSDTEAENKRAPVALAPIAKPLAGKKLCKRTLKLVRRASEAKCLKRGVKEVVKSIRRGNKGLCVIAGNISPIDVITHVPVLCEEANIPYVYVPSKEDLATAGTTKRPTCCVLVMTKPAKGELEGEVKEKLNTDYDQVMSEVAEATSAMF

SEQ ID NO: 42012 - DNA, 475 bp, Panicum virgatum
  misc_feature: Ceres CLONE 2010132
  misc_feature: Encodes the peptide sequence at SEQ ID NO. 42013
aatcacaactcgcatctggagccatcagagttcatcagcactctctagtcacacagcacatcttcttctcctgctacagagctcagctcaggcaaaagcttcgccgccacaacatcccaatggctcgcttcgccgtggacgccgccatcgtcgccctcctcgccgtcaccgcggccgcgcaggccccggccgcgacgcccaccccggcgcccaggatggccccgctgccgcgacccccggcgcgctccccggccaccgccccggcaccggccgcgaagccgcccagcgcctcggcgacaacgacgatggcgactccaccggccccgccagcaacggaaggcccagcggcggccgcgaccgccgcgctgacaacgaccagaaccgtatccgccagcgccggcgccccatgcactacccccaccgggaatggcgccgcctcctccgcctggagcttcgtcacagtcacggccacatt

SEQ ID NO: 42013 - protein, 118 aa, Panicum virgatum
  misc_feature: Ceres CLONE 2010132
  misc_feature: Functional homolog of the protein sequence given in SEQ ID NO 50188
  misc_feature: Useful for making plants with altered carbohydrate content
MARFAVDAAIVALLAVTAAAQAPAATPTPAPRMAPLPRPPARSPATAPAPAAKPPSASATTTMATPPAPPATEGPAAAATAALTTTRTVSASAGAPCTTPTGNGAASSAWSFVTVTAT

SEQ ID NO: 42014 - DNA, 657 bp, Panicum virgatum
  misc_feature: Ceres CLONE 2010137
  misc_feature: Encodes the peptide sequence at SEQ ID NO. 42015
gatcccaaacacgctcagactactcagaagctagctgtagcaagcagctcatagcacacttgaagctatagctagctaatagaaatggcgccatcaaagcttgccctgttcctcgccctgactgtcctcacctccgcggcggcagtgcacggctgtacgtcgtcttgtcctaccccaccagtggttcccaccccgccggtcgtgccgacgccatccggtggtggcggctcctgcccaatcaacgcactgaagctggaggtgtgcgccaatgtgttgaacctcctgaagctcaacatccctgtcacggggaacgaccagtgctgcccgctgttgcaggggctcgtcgaccttgacgccgcagtctgtctctgcactgctatcaaggccaatgtcctcggcatcaacctcaatgtgcccatcgacctgagcctcctcctcaaccactgtggcaagatttgccctgcagatttcacctgccccaattagccggcgaatgaaacattccacacgcccatgcatcatctgaatcttcatccatccattgcgatcgtgggcacctatatatcacctatgcggtcggtctatgtgttggtttgcatcagcatgcacccatatatgtgttctcttctgttcgggttttgagtgatgcatggctca

SEQ ID NO: 42015 - protein, 133 aa, Panicum virgatum
  misc_feature: Ceres CLONE 2010137
  misc_feature (50)..(131): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MAPSKLALFLALTVLTSAAAVHGCTSSCPTPPVVPTPPVVPTPSGGGGSCPINALKLEVCANVLNLLKLNIPVTGNDQCCPLLQGLVDLDAAVCLCTAIKANVLGINLNVPIDLSLLLNHCGKICPADFTCPN

SEQ ID NO: 42016 - DNA, 281 bp, Panicum virgatum
  misc_feature: Ceres CLONE 2010140
  misc_feature: Encodes the peptide sequence at SEQ ID NO. 42017
accattacagtacgcgctccggctgacgcgccccgcactgtcacacaaaagctcaagtcttgcgctcgctcgctcgagggtacatctacaatggcgcgcttccatctcccggccctggacatggccatgctcttcgacacggtggcggcacatgccccggccgccacccccacaccggcacccacggcattgcccccgcagggaacgccgccaacaaactccgaccccgtgctgctgcaccccctcgcccccgtgtctaatgccacactctcgagtataac

SEQ ID NO: 42017 - protein, 63 aa, Panicum virgatum
  misc_feature: Ceres CLONE 2010140
  misc_feature: Functional homolog of the protein sequence given in SEQ ID NO 50206
  misc_feature: Useful for making plants with altered carbohydrate content
MARFHLPALDMAMLFDTVAAHAPAATPTPAPTALPPQGTPPTNSDPVLLHPLAPVSNATLSSI

SEQ ID NO: 42018 - DNA, 626 bp, Panicum virgatum
  misc_feature: Ceres CLONE 2010152
  misc_feature: Encodes the peptide sequence at SEQ ID NO. 42019
acatatcgatctccttcatttcctatagagatttagccttcagccgatctttcagagcttattatctcacagtgccagcacgagagcaagatcatgtcgactgtgagccgtgcctccctggaccagaagctcgccatggccaagcgctgctcgcgagaggcaaccattgcaggaactaaggcggcagctgtggcaaccattgcctctgcgattccaactctggcgagcgtgaggatgctgccatgggcgaaggccaacatcaaccccaccggtcaggccctcatcatctccacagttgccgggatggcctacttcatcgcggccgacaagaagatcctatctctggcgaggcggcactcgtatgaggaagcgcccgagcacctcaagaacacctccttccaaggagccggccgcccccacccagctttcttcaggccatgagacacgaatttgttgagctacctctcttcgtcactactagcacaatatgccgtcgatgatgtctgaataaactaccagtcccagctactagcccactaatcctagaagggcccctgtaactagtttgtactgttggtgatccaatttcaaaaggaatgaaacttgatgttgctgatcatcactga

SEQ ID NO: 42019 - protein, 115 aa, Panicum virgatum
  misc_feature: Ceres CLONE 2010152
  misc_feature (11)..(89): Pfam Name: ENOD93 Pfam Description: Early nodulin 93 ENOD93 protein
MSTVSRASLDQKLAMAKRCSREATIAGTKAAAVATIASAIPTLASVRMLPWAKANINPTGQALIISTVAGMAYFIAADKKILSLARRHSYEEAPEHLKNTSFQGAGRPHPAFFRP

SEQ ID NO: 42020 - DNA, 724 bp, Panicum virgatum
  misc_feature: Ceres CLONE 2010154
  misc_feature: Encodes the peptide sequence at SEQ ID NO. 42021
gagacccaacacaacaaccgcatccgtccgtccaggtccagtgtgtccactcatcgcgtgagaaagaagagagcggtagtgcgcgcccgcgagacagagatggcaactccggcgacggaggcggcgacaccggaggcaccggctgaggggtcggtgatcgcgatccacagcctggacgagtggagcacctatatcgagagcgccaacagcgccaagaagctggtggtgatcgacttcaccgcatcttggtgtgggccatgccgcatcatggctccaattttcgctgatttggccaagaagcatccaaatgctgttttcctgaaggttgatgttgatgaactgaaggccattactgagcaattcagtgtcgaggcgatgccgaccttcctgttcatgaaggaaggtgacgtcaaggacagggttgttggcgcaatgaaggacggactagtccagaagcttgcgttccacatgacccatgtagaccagtaattttatagtgaagtagtattcgcctaaataagaagcagcatcaactcagagagaactagtgcctctacgatggtacttcgtatgtagtattaactatcctactctgctgcccagtttctggataatgataagatcaggccttgcttgtttccagattgtgctttgcatatcatgtttccaacttcggagcttcctctttgagctgagatgctataatggtgaatcagatatcttg

SEQ ID NO: 42021 - protein, 129 aa, Panicum virgatum
  misc_feature: Ceres CLONE 2010154
  misc_feature (19)..(123): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MATPATEAATPEAPAEGSVIAIHSLDEWSTYIESANSAKKLVVIDFTASWCGPCRIMAPIFADLAKKHPNAVFLKVDVDELKAITEQFSVEAMPTFLFMKEGDVKDRVVGAMKDGLVQKLAFHMTHVDQ

SEQ ID NO: 42022 - DNA, 687 bp, Panicum virgatum
  misc_feature: Ceres CLONE 2010173
  misc_feature: Encodes the peptide sequence at SEQ ID NO. 42023
attcccactcccccaattcctcgaatttttatattttgaaaaaaaagaaaaggagaagactccgcagccgcggcggaggggaccctcgccgcccgcgtcggtcagcagcggcggcgatcctgcgccggctttagcacgccccgtcgatccggcccgcttggcctccaggttgcaacttaaggtctgggcgtggaaggtctggtcccttcttgggttggggggtcttcttctccagcgggcgagatcgacactggctggcattgactggagcactggtgcgcggtttccactccaggacacttggggggtttggttcggctgaacccccatggcccagccgaggtctgcttctgggaagaaggaggtgggccggggacgatcgccggagccgctggatttcttcatctggactgtcgaggatgttggattatggctggaagaaataaaccttggtggctacagacaagtatttgaagaaaatggtgtgaatggggaatatctggaaagcttgtccatgtttactactgaacagattctgcggtttatcaggcggtgccatatgaaatggggagactttatcacactgtgtaaagagttgaggcgcattaaagtcgcctgcctgaagggtgagcaagaagtccggcggccatggtgggcaccatcatgcctctctgtggtgtttgtgag

SEQ ID NO: 42023 - protein, 119 aa, Panicum virgatum
  misc_feature: Ceres CLONE 2010173
  misc_feature: SWISSPROT Homolog: EC 2.7.10.2 Non-specific protein-tyrosine kinase
MAQPRSASGKKEVGRGRSPEPLDFFIWTVEDVGLWLEEINLGGYRQVFEENGVNGEYLESLSMFTTEQILRFIRRCHMKWGDFITLCKELRRIKVACLKGEQEVRRPWWAPSCLSVVFV

SEQ ID NO: 42024 - DNA, 716 bp, Panicum virgatum
  misc_feature: Ceres CLONE 2010191
  misc_feature: Encodes the peptide sequence at SEQ ID NO. 42025
agcgccaataatccaagccatttctttgtgttttgcaaaaaaaactagaaagaaatgggaagcaaggatcttaagagtgtaatcatgtgtgtgctgatactagggataatcttggatgtagagggcatgagttgctgcaggaacaccacggcaagaaactgctacaacatgtgtcgtatgaccccgccagcttgtgcagcaagatgtggctgtataatcataagtggcaatcaatgcccatgctaccctagtttgaaccttcttccgaactccggtgaaccagatgccattaagtactgcaacttgggatgtgtgtcttctatgtgcgacaccaagaacaatgctccagaatttgtcggtgaagagatgaaaatcgacatggaacactgcagtgatgcatgtgaccgtttctgcaatgggtatgcccgcatggcatccgttgctgcttaatcatgcatgtgcatgccatgggatttgttgtcgaaggccaaggtctcatcatgatggatgatattctaaataaaggatctcatgggacagatccaagtcagtgtgtgtcatcttgtacatatgtacgtgtgtgctctttttttgtttctttgttacaataaaggtaaccacacgatggatgccatgttattacctgtatgtgctcatctctatcgagatgtatgcatgtagccttggccagttaatataataactataaattatac

SEQ ID NO: 42025 - protein, 131 aa, Panicum virgatum
  misc_feature: Ceres CLONE 2010191
  misc_feature (25)..(67): Pfam Name: Thionin Pfam Description: Plant thionin
MGSKDLKSVIMCVLILGIILDVEGMSCCRNTTARNCYNMCRMTPPACAARCGCIIISGNQCPCYPSLNLLPNSGEPDAIKYCNLGCVSSMCDTKNNAPEFVGEEMKIDMEHCSDACDRFCNGYARMASVAA

SEQ ID NO: 42026 - DNA, 675 bp, Panicum virgatum
  misc_feature: Ceres CLONE 2010200
  misc_feature: Encodes the peptide sequence at SEQ ID NO. 42027
aaaaaaaaaaacaagaaccccgacgcaccatctcgcagcaaagctgtagcattcggagcaaaggctccttggctctagctcgtctacactgcagaccgaccacagagtaatcaatcatcgatggctgatcagaggaacgcgacggtgcggccgctcctgcgccgggtgctctcgttccgggagccgctcctgctcatcccgtacctgctcaccttcctcggcgccgcggcgtcggcgttcgtgcggagccattcctcgctgctgcacgcgctcgcgaggtcgctcgtcccgtccaagtgcgcgtacagcgcctcgccggctagcggcgacctgcccgtcgccgccgccgaggcggaaaaggaggaggcggcggcggaggacgccgcgctgagcaaggaggaggtggaggcgatcatgggcgcgatcggcctcgcggcggccggccggggggagggcctcgcgcccgccatgggccgggacgaggtggcccggctgttcgacgccgaggagccgagcttcgcggaggtgcggagcgccttcgcggtgttcgacggcgaccgcgacgggttcatcggcgcggccgacctgcagggcgccctggcgaggctcggcgtgcgggaggacgccgcagcgtgccgcgccatgatcgccgcgggcggcggcggcagggacggc

SEQ ID NO: 42027 - protein, 184 aa, Panicum virgatum
  misc_feature: Ceres CLONE 2010200
  misc_feature (135)..(163): Pfam Name: efhand Pfam Description: EF hand
MADQRNATVRPLLRRVLSFREPLLLIPYLLTFLGAAASAFVRSHSSLLHALARSLVPSKCAYSASPASGDLPVAAAEAEKEEAAAEDAALSKEEVEAIMGAIGLAAAGRGEGLAPAMGRDEVARLFDAEEPSFAEVRSAFAVFDGDRDGFIGAADLQGALARLGVREDAAACRAMIAAGGGGRD

SEQ ID NO: 42028 - DNA, 718 bp, Panicum virgatum
  misc_feature: Ceres CLONE 2010202
  misc_feature: Encodes the peptide sequence at SEQ ID NO. 42029
aacacgacacgccaaaccaaaaccacacaggacgccaggagctccgcgtcccaaatttcttctgcaaagagcaagccaaagaggagttcgttcccggaatctctcgctcgcgtgcgcgggatttgatccccaaccacccaagtctctcgccctctctctttctccggcggttggttccttcgatcccaaatcgtgatccactcgatggcggccaccgccggcggcaacaagatccgcaacgccaagctggttcttctcggggacgtgggcgccggcaagtccagcctggttctccggtttgtgaaaggccagttcgtcgaattccaggaatcgaccatcggggcagctttcttctcgcagaccttggcagtgaacgatgagacagtgaagtttgagatatgggacacggcagggcaggagaggtatcacagcttgactcccatgtattaccggggtgctgctgctgcgctagttgtctacgacatcaccaatgcggcctctttcacacgtgcgaagaaatgggttcaagaacttcaagcgcaaggaaacccgaatacaataatggctcttgctgggaacaaggctgatttggtagaggcgaggcaggtgccagcagaagaagcaaaggcatacgctcaagagaatggtctcttcttcatggaaacatctgctaaaacggcgatcaatgtgaatgacgtgttctacgagattgctaaga

SEQ ID NO: 42029 - protein, 171 aa, Panicum virgatum
  misc_feature: Ceres CLONE 2010202
  misc_feature (14)..(171): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
MAATAGGNKIRNAKLVLLGDVGAGKSSLVLRFVKGQFVEFQESTIGAAFFSQTLAVNDETVKFEIWDTAGQERYHSLTPMYYRGAAAALVVYDITNAASFTRAKKWVQELQAQGNPNTIMALAGNKADLVEARQVPAEEAKAYAQENGLFFMETSAKTAINVNDVFYEIAK

SEQ ID NO: 42030 - DNA, 696 bp, Panicum virgatum
  misc_feature: Ceres CLONE 2010215
  misc_feature: Encodes the peptide sequence at SEQ ID NO. 42031
gtgctctcatagaggtgggttggatctcctccccctcttcccccggttctcagttctcggttcggttcgttagggtttagtggaaggaatggcggctgaagtggagtaccgctgcttcgtcggcggcctcgcctgggccaccgacgaccgctccctcgagcaggccttctcccagtacggcgaggtcctcgactccaagatcatcaacgacagggagactggccggtcccgcgggttcggctttgtcaccttctccaacgagcagtcgatgctggacgccatcgagaacatgaacggcaaggagctcgacggccgcagcatcaccgtcaaccaggcgcagtcccgcggcggcggcggcggcggtggcggcggctacggtcgccgcgagggcggctacagtggaggaggcggcggcggctacgggcgccgcgagggaggctacggcggcggcggcggctacggtggtggcaaccgcggctacggtggcggcggcggcggctacggcggtggtggctacggcggcagccgcggtgactccggtgggaactggaggaactgatgggtggggccccaagtggccaagttatcttaagttatcttccctggaatcgtgttaccgtcaccgttgggtccaactgtgggatccagagttaccctggtctcgtttagtgtccgtgttaccgttcgattaggtct

SEQ ID NO: 42031 - protein, 156 aa, Panicum virgatum
  misc_feature: Ceres CLONE 2010215
  misc_feature (9)..(80): Pfam Name: RRM_1 Pfam Description: RNA recognition motif. (a.k.a. RRM, RBD, or RNP domain)
  misc_feature (47)..(142): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAEVEYRCFVGGLAWATDDRSLEQAFSQYGEVLDSKIINDRETGRSRGFGFVTFSNEQSMLDAIENMNGKELDGRSITVNQAQSRGGGGGGGGGYGRREGGYSGGGGGGYGRREGGYGGGGGYGGGNRGYGGGGGGYGGGGYGGSRGDSGGNWRN

SEQ ID NO: 42032 - DNA, 471 bp, Panicum virgatum
  misc_feature: Ceres CLONE 2010216
  misc_feature: Encodes the peptide sequence at SEQ ID NO. 42033
acttccagggtcatcgttctgatggtcagctgctaacactggatgagataaaacaacaccttccttctaactcgcttaaagtattaagcgagtcaaagtggacatttattactcgagaggagcacccccacttaagcaggccatggttcaccttgcacccctgtgcaaccagtgactggatgaagctacttcttgaagaaagtaaagtggcaattgaggaacaatcgctgcgatatctatcgacatggttatccgtggttggccaggcagtaggacttaaaatccctcttgagcttcattgcaactcataggttcgctcttttttcattttcagtttgtatgtatggagtatatggtgattgaaagggaaagtccccgcctcatacttggtgatgtataaggtcatggatacttctgacgctggttacacttgccctttgaaattttgtggtagatttctactttcattgc

SEQ ID NO: 42033 - protein, 102 aa, Panicum virgatum
  misc_feature: Ceres CLONE 2010216
  misc_feature (1)..(100): Pfam Name: Autophagy_C Pfam Description: Autophagocytosis associated protein, C-terminal domain
FQGHRSDGQLLTLDEIKQHLPSNSLKVLSESKWTFITREEHPHLSRPWFTLHPCATSDWMKLLLEESKVAIEEQSLRYLSTWLSVVGQAVGLKIPLELHCNS

SEQ ID NO: 42034 - DNA, 708 bp, Panicum virgatum
  misc_feature: Ceres CLONE 2010223
  misc_feature: Encodes the peptide sequence at SEQ ID NO. 42035
ctcgatcggattgggttgggggttctgggtaggtgtggtgtgctcgggagttggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgcaggcccagtcgcggaagatatgttccactggcaagcgaccataatgggtccatcagatagcccatacttcggcggcgtctttttggtcacaattcacttccctccagactacccattcaaaccgcctaaggttgcattcaagacaaaggtcttccatccgaatatcaacagcaatgggagcatctgtcttgatatcttgaaggaacaatggagcccagcattgacagtttctaaggttagtaaattattctgctttcctgtagctttgtagtaaccaaatgtttcaagccaactgtgccatacctagttgtttcaacagattagcggaatcagcccctgcactgtagcctattcaagtttggttcttcagttgcatcatcatctcagaaaacatgcttgctgttttcaggtactactctcaatttgctcccttttgacggacccaaaccctgatgacccattggtttcggagattgctcacatgtacaagagtgatcgggcgaaatatgagtc

SEQ ID NO: 42035 - protein, 112 aa, Panicum virgatum
  misc_feature: Ceres CLONE 2010223
  misc_feature (5)..(112): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
  misc_feature: Functional homolog of the protein sequence given in SEQ ID NO 50119
  misc_feature: Useful for making plants with modulated low light sensitivity
  misc_feature: Functional homolog of the protein sequence given in SEQ ID NO 50120
  misc_feature: Useful for making plants with modulated light quality sensitivity
MASKRILKELKDLQKDPPTSCSAGPVAEDMFHWQATIMGPSDSPYFGGVFLVTIHFPPDYPFKPPKVAFKTKVFHPNINSNGSICLDILKEQWSPALTVSKVSKLFCFPVAL

SEQ ID NO: 42036 - DNA, 711 bp, Panicum virgatum
  misc_feature: Ceres CLONE 2010253
  misc_feature: Encodes the peptide sequence at SEQ ID NO. 42037
cgctccgcatcgtcgggaggaggaagaggagtaatccacggtgatcaccgggccaagcaagatgtcggctgccaccgccccgagattgtccgtccccaaatgcggggcgagcctccggaccgccgctccggcggccagggcccctccctccgtcggcttcgcgaggcaggcggcccgcgcgcctgggccgcggctctccggcaggttcgtggcctccgcggcggccgtgcacaaggtgaagctggtcgggccggacggggtggagcacgagttcgaggcccccgaggacacctacatactcgaggcggccgagaacgccggcgtggagctgcccttctcctgccgcgccgggtcctgctccacctgcgcgggcaagatgtcggacggcgaggtcgaccagtcggagggctcgttcctcgacgagaaccagatggccgaggggtacctcctcatctgcatctcctaccccaaggcggactgcgtcatccacacccacaaggaggaggagctgtactagagtgctcgtgcgtcagtgagcttcaatggcggcgcagtggctgagaccatgggttgccatgccatggtagagacgattgttgtgggggaagggataactcttgatgtctactgttgaacatctgtttcgttgagatcgtgccatatgagctgtgacaataattgttgtaacgtgattctgaaattcaaactgcg

SEQ ID NO: 42037 - protein, 151 aa, Panicum virgatum
  misc_feature: Ceres CLONE 2010253
  misc_feature (62)..(138): Pfam Name: Fer2 Pfam Description: 2Fe-2S iron-sulfur cluster binding domain
  misc_feature: SWISSPROT Homolog: EC 1.14.13.25 Methane monooxygenase
MSAATAPRLSVPKCGASLRTAAPAARAPPSVGFARQAARAPGPRLSGRFVASAAAVHKVKLVGPDGVEHEFEAPEDTYILEAAENAGVELPFSCRAGSCSTCAGKMSDGEVDQSEGSFLDENQMAEGYLLICISYPKADCVIHTHKEEELY

SEQ ID NO: 42038 - DNA, 532 bp, Panicum virgatum
  misc_feature: Ceres CLONE 2010258
  misc_feature: Encodes the peptide sequence at SEQ ID NO. 42039
atagcgactgtctcagcccgcatccggaactcgcgagcccgagaaagagagagagagcgccgcgcctggccgggaataaagccagtcagctagcgcgcgcacggcggcggcttccatatggcgggcgaccaccgaggcccgtagccgccgggggggggggcggaggcggatatcacggatcaggaccggctgctgcccatcgcctacgtcggccgcatcgtgaagcatgatcctggcccccaacgccaagatctccgaggatgccaaggagaccttgcacgagtgcgtctccgacttcatctgcttcgtctccggggaggcctccgacaagtgccacgcggagaagcgcaatagcgtctacggctacgatgtctgctgggccttctgcgccctctgcttcgacgactacgtcgaccccatgcgcaggtacctccacgagttccgcgagctcgagggcgaccgcgccgccgccgccccctcctcccgcgggggcgggggctccacctcggccggctccgaccccggggcggca

SEQ ID NO: 42039 - protein, 101 aa, Panicum virgatum
  misc_feature: Ceres CLONE 2010258
  misc_feature (1)..(53): Pfam Name: CBFD_NFYB_HMF Pfam Description: Histone-like transcription factor (CBF/NF-Y) and archaeal histone
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 62 in the 10/675,852 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 795 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: Functional homolog of the protein sequence given in SEQ ID NO 50466
  misc_feature: Useful for making plants with modulated drought sensitivity
  misc_feature: The sequence is a functional homolog of SEQ ID NO 14 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 42 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 64 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 38 in the 10/675,852 US patent application
  misc_feature: The sequence is a functional homolog of SEQ ID NO 22 in US patent 7166765
MILAPNAKISEDAKETLHECVSDFICFVSGEASDKCHAEKRNSVYGYDVCWAFCALCFDDYVDPMRRYLHEFRELEGDRAAAAPSSRGGGGSTSAGSDPGA

SEQ ID NO: 42040 - DNA, 1160 bp, Panicum virgatum
  misc_feature: Ceres CLONE 2010260
  misc_feature: Encodes the peptide sequence at SEQ ID NO. 42041
accttcaaacagatcatgaagctactgctctccctgcagctccccagtcaccagatgggcctatgagcaagccgtcagcagcgacagttacttaccaccaccgagaaagacttttcactgatcttgtgcagattcaagaagctagcctccacttctgacagcggcaagatcagccgccacctccaccaacggtgactgatctagccgatccatggacatgtcaccaaatcccgatagcccctcgtcaggagggggcaacggcggcggcggcgcatcgccgtccgttgtctcgatgacgccgcagtccccgagccgttacgaggcgcagaagcggcgcgactggaacacgtttggccagtacctgcggaaccaccgcccgccgctgagtctggctcagtgcagcggcgcgcacgtcctcgagttcctgcgctacctggaccagttcggcaagaccaaggtgcacgcggcggcgtgccccttcttcggccaccccaacccgccggcgccctgcccctgcccgctccggcaggcctggggcagcctcgacgcccttgtcggccgcctgcgcgccgccttcgaggagaacggaggccgcccagagtccaacccctttgccgcgcgtgctgtccgcctctacctccgcgaggtccgcgagcaccaggcccgtgcgcgtggcgtcagctacgagaagaagaagcgcaagaagccacagcagctgcagggcgagggcagcggccttcaaggccaccaccatcaccagcctccgccgccgccgcccgccgcagcctgctgaacaccgaccgatcattctgcctacgctctcctgtttggccggtatgccagattgagcttgagcacatatattttatgtatcatctgcttctgcatgcatgcatgtgcatggcagtggcttcgtgctgctgattcgtgtactcttttatcgtgacaaagtactagtgtagtcggtgctcgtgcgtgcctactgcattgcttgtgtgtttccattggatttagctttgtgtcgtcgaatctattagctgcttgtacgagtgaggaagtgtttgctgtactttgaaccgaggagtgtgtcctctgaggtctagagatccagctagagacagggagatacatatatggagatctctcgtgctgctttgtgg

SEQ ID NO: 42041 - protein, 193 aa, Panicum virgatum
  misc_feature: Ceres CLONE 2010260
  misc_feature: Functional homolog of the protein sequence given in SEQ ID NO 50806
  misc_feature: Useful for making plants with modulated low light sensitivity
  misc_feature: Useful for making plants with modulated nitrogen use efficiency
  misc_feature: Functional homolog of the protein sequence given in SEQ ID NO 50807
  misc_feature: Useful for making plants with modulated flowering time
  misc_feature: Functional homolog of the protein sequence given in SEQ ID NO 50809
  misc_feature: Useful for biocontainment applications
  misc_feature: Functional homolog of the protein sequence given in SEQ ID NO 50808
  misc_feature: Useful for making plants with modulated biomass
MDMSPNPDSPSSGGGNGGGGASPSVVSMTPQSPSRYEAQKRRDWNTFGQYLRNHRPPLSLAQCSGAHVLEFLRYLDQFGKTKVHAAACPFFGHPNPPAPCPCPLRQAWGSLDALVGRLRAAFEENGGRPESNPFAARAVRLYLREVREHQARARGVSYEKKKRKKPQQLQGEGSGLQGHHHHQPPPPPPAAAC

SEQ ID NO: 42042 - DNA, 698 bp, Panicum virgatum
  misc_feature: Ceres CLONE 2010264
  misc_feature: Encodes the peptide sequence at SEQ ID NO. 42043
atagaggaaacgagggtttcttcgggtcctttcgaggggcaggggggctttatccgcggaacactttccggcggcgaccacttggtgcccggggaggcgatcgatccctcaccatgtcatcggagaaggaggcggcgctcgccgccgtgcccaacgacaaccccactatatttgacaagatcataaaaaaggaaataccgtctactgtcgtttatgaggatgagaaggtattggctttcagagacatcaaccctcaagctccaacacacatcctaatcattcccaaagtcaaggatggattaactggcctttcgaaggcagaagagaggcacgttgagatacttggccatctcctctatgttgccaaagtgattgcgaagcaggaaggacttgaagatggctaccgtgttgtcatcaatgatggccccagtggatgtcaatctgtttaccacatccacgttcacctccttggaggcaggcagatgaactggcccccaggctaagaatctcgcgttgatcagtctccatggcgaggattgacgctgcatctctatcgaataattcctgtaattcccacaaaatttagcgtgtggaacttgtgctgtatttgtggaattactggaaccaatcctgctgcgatttatggacgacaaacttgcacttggaagttggaatcatggattgacttgtcctcgttg

SEQ ID NO: 42043 - protein, 129 aa, Panicum virgatum
  misc_feature: Ceres CLONE 2010264
  misc_feature (25)..(124): Pfam Name: HIT Pfam Description: HIT domain
  misc_feature: SWISSPROT Homolog: EC 3.6.1.17 Bis(5'-nucleosyl)-tetraphosphatase (asymmetrical)
MSSEKEAALAAVPNDNPTIFDKIIKKEIPSTVVYEDEKVLAFRDINPQAPTHILIIPKVKDGLTGLSKAEERHVEILGHLLYVAKVIAKQEGLEDGYRVVINDGPSGCQSVYHIHVHLLGGRQMNWPPG

SEQ ID NO: 42044 - DNA, 670 bp, Panicum virgatum
  misc_feature: Ceres CLONE 2010271
  misc_feature: Encodes the peptide sequence at SEQ ID NO. 42045
gaatttgtttttttattcttctgcaccagcatcaaagagttcctaaatttggaagctgggaggatgagaatgatcacctttacacacagtattttgaaaatgctcgtaagggtaaatctccaggtaagggagatccaaaaacgccctcaaaggatccaccatcagctaaagcttctcccctgaggactgggtcagatccagtggtgcgaaagcccaaggatgaaagatgtgcagacagagaagatgatcttcgtcggcatgaggccactgctggaaaaccatatgctgagtcacctaatcataaacacagtgatcatacgaactacaatagtgcagcaagaaaaactggcatggaacgatcacctctgcatcctcaccaccaagcaagagttgtaaacaaaggaggggtttcatctccttcatgggaacggaggggttcatcagaaggaaaccgtgggaatgcacccaccacacctggaaggtccaggatgagaccaagcgggcgtggagatgaaacgcctgagagaggatcagctgtgcccaagtttggagagtgggatgagaaagatccatctacgggtgaaggtttcaccgacatatttaacaaggtgagggaggagaaacagtctggcgatgctcctgttatcaccaatgatgcaagttataaacg

SEQ ID NO: 42045 - protein, 222 aa, Panicum virgatum
  misc_feature: Ceres CLONE 2010271
  misc_feature (170)..(222): Pfam Name: NOI Pfam Description: Nitrate-induced NOI protein
ICFFILLHQHQRVPKFGSWEDENDHLYTQYFENARKGKSPGKGDPKTPSKDPPSAKASPLRTGSDPVVRKPKDERCADREDDLRRHEATAGKPYAESPNHKHSDHTNYNSAARKTGMERSPLHPHHQARVVNKGGVSSPSWERRGSSEGNRGNAPTTPGRSRMRPSGRGDETPERGSAVPKFGEWDEKDPSTGEGFTDIFNKVREEKQSGDAPVITNDASYK

SEQ ID NO: 42046 - DNA, 714 bp, Panicum virgatum
  misc_feature: Ceres CLONE 2010273
  misc_feature: Encodes the peptide sequence at SEQ ID NO. 42047
gactctccgccctcgtcgtcctccacttccaccggggattccttctcctcatggcaactggcaaggcaatccttcctccttcccgcgctctctcgtcgtcctcctcgcccccggatttgagtcgaggcagctacttcctcccctttccacctgctcttctttagcgccatttctttctttctttcgttttctgtccaattcaataattaattaattaaagccaagctgcgacgtggggcaagaagcttgatgctgatgtttatgactgcaacaacatggtagagcaggagctgccctacggtggtctactaatctaccagagcttttctgctgctgaagatgctgttgttagctcgcccaaatctgttcttcattgcttcgagggtcacaatatggagaatgctgctccggtgaaggatggcaagctggctaatcttctctgctgggaggaagatgatgccatggaggagaaggacggagtgcttgtcgagtaagaccgggcatctggtgtcgatttgctgctgagttattttttttaagtgtttgcgattattgtttggttattgtgtgaagcagccaagccaggctatctagtatgaaaatgatcgtcaggaagcatgggttctgatgttgccgcatgctagtgatgaatctgaataagtatacagctctaggtggtcagctgcgtctaccacaatgagcatatgtatggag

SEQ ID NO: 42047 - protein, 72 aa, Panicum virgatum
  misc_feature: Ceres CLONE 2010273
  misc_feature: SWISSPROT Homolog: EC 4.1.1.50 Adenosylmethionine decarboxylase
MVEQELPYGGLLIYQSFSAAEDAVVSSPKSVLHCFEGHNMENAAPVKDGKLANLLCWEEDDAMEEKDGVLVE

SEQ ID NO: 42048 - DNA, 691 bp, Panicum virgatum
  misc_feature: Ceres CLONE 2010289
  misc_feature: Encodes the peptide sequence at SEQ ID NO. 42049
aacaaccaccagtgacttcgcagcctcctcttcccccaaccaacccgaatcccagccgcagaaccccccccccccccccagcagccgcgtcgatggcccccaagggggagaagaagccgggggcgaagaagcccgcggaggaggagcccgcgacggagaagggggagaaggccccgggggggaagaagcccaaggccgagaagcggctccccgctggcaagtccgccggcaaggagggcggcgagggcaagaaggggaagaagaaggccaagaagtcgggggagacgtacaagatctacatcttcaaggggctgaagcaggtgcaccccgacatcggcatctcctccaagggcatgtccatcatgaactccttcatcaacgacatcttcgagaagctcgccggcgaggccgccaagctcgcgcgctacaacaagaagcccaccatcacctcccgcgagatccagacctcggtgcgcctcgtcctccccggcgagctcgccaagcacgccgtctccgagggcaccaaggccgtcaccaagttcacctcgtcttagattctaggctttcccctctgctctttgttggcgtaaggctcctggtagtgatgctagtttgctcggtttggctggtaggatggtgtagtttggtgctggtggttcctgataatgttctttctgtacgaagtgagaaa

SEQ ID NO: 42049 - protein, 153 aa, Panicum virgatum
  misc_feature: Ceres CLONE 2010289
  misc_feature (60)..(130): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKGEKKPGAKKPAEEEPATEKGEKAPGGKKPKAEKRLPAGKSAGKEGGEGKKGKKKAKKSGETYKIYIFKGLKQVHPDIGISSKGMSIMNSFINDIFEKLAGEAAKLARYNKKPTITSREIQTSVRLVLPGELAKHAVSEGTKAVTKFTSS

SEQ ID NO: 42050 - DNA, 811 bp, Panicum virgatum
  misc_feature: Ceres CLONE 2010297
  misc_feature: Encodes the peptide sequence at SEQ ID NO. 42051
aacgctctcagcaatcagccccagcgccgccactcgctcctttcctccatcaccctcgccggccgccgcctcctacctcaccgaccgccgcagcgcgcaatatttctgccttcctgacacgccactccaaaccctcgggagagaggaggcggctccaaggaagatggggtggaaggctgcggagaagctaatcaggcactggaagatcctccgcggtgacaacgtgatggtcatcagaggcaaggacaagggggagactgggctcatcaagcgggtcattcggtcgcagaatcgcgtcatcgtcgagggcaagaacttggttaagaaacacattaagcaaggcgaagggcacgcaggtggtattttctccatcgaagctccacttcatgtttcgaatgtccaagtagttgatcctgtcactgggaaaccatgtaaggttggatacaagtatttggaagatgggaccaaagtcaggttcgctagagggatgaatgcatctggcgctgtgatcccccggccagaaattctgaaggagagaagaaaaccgaggcctacattacctggcccaaaggatacaccaattgagctcgtgctggagaagacatacgatgagaaagctggaattggtatgcctgatctatagctgctgcctgctggcctgacacgttgtttgtgctgagagttcagtatatgcgaccaggtcctatttaagttagggtgccgatgattgcagttgtaatgtgctaccctcataataatcacgtactaatgatcaaaagagacattgctggcatgtatgttgccttttttt

SEQ ID NO: 42051 - protein, 159 aa, Panicum virgatum
  misc_feature: Ceres CLONE 2010297
  misc_feature (17)..(48): Pfam Name: KOW Pfam Description: KOW motif
MGWKAAEKLIRHWKILRGDNVMVIRGKDKGETGLIKRVIRSQNRVIVEGKNLVKKHIKQGEGHAGGIFSIEAPLHVSNVQVVDPVTGKPCKVGYKYLEDGTKVRFARGMNASGAVIPRPEILKERRKPRPTLPGPKDTPIELVLEKTYDEKAGIGMPDL

SEQ ID NO: 42052 - DNA, 716 bp, Panicum virgatum
  misc_feature: Ceres CLONE 2010299
  misc_feature: Encodes the peptide sequence at SEQ ID NO. 42053
aaaaccccaatccgtgcctccaccgctcactcttcccccattccaccacctctcctggtctggtcgcctcgacccatcccaatcttcaggtttagtgctcaatggcagccttcaacaagcttggcagccttctaaggtacagcactctgacaagcggtgcccctgccagctcgtctcctgctttgttcaatgttgctcggctaatgtccaccaagcttttcgttggtggtctttcctggggtactgatgagcagactttgagacaagcatttagcaacttcggagaggttactgaagcaaggatcatcacagaccgggatactggtaagtcaagaggctttggatttgtgaatttcagcaacagtgatgatgccaaggcggctatgagccgaatggatggtcaggaacttgaagggcggagtgtccgtgtgaactttgctaatgacaggcctgcagggaaccgtggtggtggtggtgatggcggctttggcggaggtggctatggtagtggcggctatggcggcggcggctttggtggaggcaaccaaagctatggttctggagggcggcaggataccttttaaaagtttgctaactataaaagtatttgaaataatggacttcaggcctgatgtgtggcttatgtgaggccttaatcatgttttactattttgtgttctgaagttgagtcgttgaactagtgcaattcaggagct

SEQ ID NO: 42053 - protein, 160 aa, Panicum virgatum
  misc_feature: Ceres CLONE 2010299
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50182
  misc_feature: Useful for making plants with modulated biomass
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
MAAFNKLGSLLRYSTLTSGAPASSSPALFNVARLMSTKLFVGGLSWGTDEQTLRQAFSNFGEVTEARIITDRDTGKSRGFGFVNFSNSDDAKAAMSRMDGQELEGRSVRVNFANDRPAGNRGGGGDGGFGGGGYGSGGYGGGGFGGGNQSYGSGGRQDTF

SEQ ID NO: 42054 - DNA, 548 bp, Panicum virgatum
  misc_feature: Ceres CLONE 2010309
  misc_feature: Encodes the peptide sequence at SEQ ID NO. 42055
gttcacatctcctcccttctctcggactctctcccttgctcttccttccctgccggcggcgactgggcgagcggcggcgccatttgtcacgtcttcgccaagccctttgccggcgacgagcatcttccaggagaaggcatggcttcacgcatgacaccttccaagaggccgtttcagaaatattcttcagatcacaatggccggggcaagtggcagaaaacaaagcattcttcttcacataaatctcagtccaaaatagagcctggtgtccctatctttcgcattctctgccctgcttcaaaatctgggaatgtaatcggtagaaagggcggcattatcgcaaagatacggcaagaaactggattgagaatcagtgttgataaagcagtccttggttgtgacgagagagttgttttcatatctgccattgacaaggatgaagaagctattagcaagcaaggtggagagaatgatggaggtgttgctgtttctgcttctggtgaccatgagaaggataaagtcaacagtaaggagaacaatgatgatcc

SEQ ID NO: 42055 - protein, 136 aa, Panicum virgatum
  misc_feature: Ceres CLONE 2010309
  misc_feature (46)..(109): Pfam Name: KH_1 Pfam Description: KH domain
MASRMTPSKRPFQKYSSDHNGRGKWQKTKHSSSHKSQSKIEPGVPIFRILCPASKSGNVIGRKGGIIAKIRQETGLRISVDKAVLGCDERVVFISAIDKDEEAISKQGGENDGGVAVSASGDHEKDKVNSKENNDD

SEQ ID NO: 42056 - DNA, 711 bp, Panicum virgatum
  misc_feature: Ceres CLONE 2010325
  misc_feature: Encodes the peptide sequence at SEQ ID NO. 42057
attcccccaagcacacacagcagctaatccagactcacactactgcagcatttgctttgcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaagatcaactaaattaatcttacatcagatatgctgctacctgatggtgagaagcttggtccttcagaagatagcaacgagctatttattaggacaataaaataaagttgttaaggcatcatcatcagcatcatctatactattttgtagtattaattaattaattaattaattaattaaatgttgtactcgatctgtgtgtacgtgcgcgtatacatacatgcatgcttatacgatcg

SEQ ID NO: 42057 - protein, 126 aa, Panicum virgatum
  misc_feature: Ceres CLONE 2010325
  misc_feature (37)..(122): Pfam Name: Tryp_alpha_amyl Pfam Description: Protease inhibitor/seed storage/LTP family
MAALMMKNKKQMQAVVALAVVVAAAALVASASAAITCGQVGSALAPCIPYATGKASALPSSCCGGVRSLNSAARTSADRQAACRCLKSLASTVKSVNMGTVATIPGKCGVSVPFPISMSTDCNKIN

SEQ ID NO: 42058 - DNA, 617 bp, Panicum virgatum
  misc_feature: Ceres CLONE 2010353-R
  misc_feature: Encodes the peptide sequence at SEQ ID NO. 42059
tgctgtacctcgtccgcctccgggccatggtcgtcgccggccaggccctcgccgtgccgccgtcggtgttcgcgcccggcgccgtcgtggactcccgcacggtgatcacgcgcctcccgccgacggcgtacggggcgctgcgcgccgccttccgggccagcatggggatgtaccgcgcggcgccgcccaagcagcagctcgacacctgctacgacttcaggggggtccgccgcgtcacgctgcccagggtcacgctggtgttcgaccacagcgccgccgtggagctcgacccgtcggggatcctctacaacgactgcctcgccttcacccccggcagcgacgaccgggcgatcggggccatcggcaacgtccagctgcagacgtacgaggtgctgtacaatgtcgccggcgccaccatgggcttccgccgtgccgcctgctagctgatgagtcgagtgcaggcaccaatcaccatggatctctgctgccagctgctaccaacaagcctcacaacaaactacctgccaaactgcctacctatatatatacctaccgtcatttttggcccttgtatggtcgcgtttgaataagccgagtttaactcgggtacatgtatt

SEQ ID NO: 42059 - protein, 146 aa, Panicum virgatum
  misc_feature: Ceres CLONE 2010353-R
  misc_feature: SWISSPROT Homolog: EC 3.4.23.12 Nepenthesin
LYLVRLRAMVVAGQALAVPPSVFAPGAVVDSRTVITRLPPTAYGALRAAFRASMGMYRAAPPKQQLDTCYDFRGVRRVTLPRVTLVFDHSAAVELDPSGILYNDCLAFTPGSDDRAIGAIGNVQLQTYEVLYNVAGATMGFRRAAC

SEQ ID NO: 42060 - DNA, 637 bp, Panicum virgatum
  misc_feature: Ceres CLONE 2010353
accagtgcaagcatcggtcgaccggcaatgatggctccaccagcggtctggcttcttcttcctctcggcctcttgtgcctgtgtagctccaccgccgccacggcggcggaggccgcagccgactacgtcgtcgtggccacgagctggctcaagacgaagccggtgtgccaagggctcagggctgcagtggatgcgccggcgaaccttaccgccagcagcagctgggtgccgctgagccactcctacggcccctgctcggcggcggcgggaagtttgtcgccggcgccggccgacgtgctgctgcaggaccagcaccgcgcggcctacatccagaggaagctcgccgacggcaccccccaggacgacaacggcagcgacctgccggagtcggactgcaagagcggccagtcggagcacgctcccaccgtgtcacccaacattggcgagaactcgagccccacatcagagggctcggaggcggtgaccctcatcgaaccggcggcgggcggcagcggcgcgcagcggctgccgggcgtgaagcagacgatggtgctggacaccgcgagcgacgtggcgtgggtgcagtgcgccccctgccccatgccgcagtgccaccctcagacggacaccatctacg

SEQ ID NO: 42061 - DNA, 699 bp, Panicum virgatum
  misc_feature: Ceres CLONE 2010360
  misc_feature: Encodes the peptide sequence at SEQ ID NO. 42062
cttcctcctcgctcccctccccacccacacaccccctccctcccgcatgtcaacggccctcccggcggactccgtccccgcccccagctcccgggcctagttacgagccgcggtcggctccggatcggcgcggcccgccgctctcgtcatggcatttccgtcgcgggtggctctgctcgtcgcgggggtgttggtgatgctggggctctccgcggcggcggcggcggcggaagggcgagggagcgtgtgcttccgccgggtgttcagcttcggggactcgctcacggacaccggcaacttcctgctctccgtgccagaggacttcccggaccccgcgcggaacctcccctacggccagaccttcttcggccgcccatccggacgctactccgacggccgcaacctgctcgacttcttcgcggaagcatttgggattccattcgtgccgccgtaccttggcggtggggacttccaatatggtgcaaactttgcggtcggcggggccactgccctcaaaggttcgttcttccgggaacgtggcgtggagcctacatggacgccacactgccttgatgagcagatgcagtggttcaagaagcttctcccatcgattgcgccatcagagacagaacaaagtgatatgatgtccaattcgcttttctttgtgggagaggttggcggaaatgattacaaccatct

SEQ ID NO: 42062 - protein, 183 aa, Panicum virgatum
  misc_feature: Ceres CLONE 2010360
  misc_feature: SWISSPROT Homolog: EC 3.2.1.51 Alpha-L-fucosidase
MAFPSRVALLVAGVLVMLGLSAAAAAAEGRGSVCFRRVFSFGDSLTDTGNFLLSVPEDFPDPARNLPYGQTFFGRPSGRYSDGRNLLDFFAEAFGIPFVPPYLGGGDFQYGANFAVGGATALKGSFFRERGVEPTWTPHCLDEQMQWFKKLLPSIAPSETEQSDMMSNSLFFVGEVGGNDYNH

SEQ ID NO: 42063 - DNA, 711 bp, Panicum virgatum
  misc_feature: Ceres CLONE 2010385
  misc_feature: Encodes the peptide sequence at SEQ ID NO. 42064
actcgcccgccccgacttcaccacttgctcctcgccgacgatctcgcggagcagcggcgcgcatggcgagcgacggcgcggcggccacgccggcgaaggtgaccccgaagaaggccaacatcctcgacccgcactccatcaagcacctcctcgacgataccatctccgatgtcgtgaagagcaagggatacaccgaggacacgcggctgggcaacttgaagctggggatcggggcggccgtgatcgccgtcgccctactcgcgcaattctacccgaagaagttcccgcagaaccgcgagttcctcctcggctgcatcgcattatatccttttcttcgctgggtttgcccgctctttttcttctgatggatcggcgctagatctgatttcggttgagaatcgtgtggaattgtttttttttttggtgttggtccttgacttggatgggtcgatacgtatgtggtgttgaatgtggttctgctgatccttagctacaccaaggagaaggatgccatcctcttcacccacccccctgcgggttctttcaacagcaccggcctcattatttcttctaagctaccaagattctcagacatgtacactctcacaatagccagtgcggacccgcagtctatctctgcgaataagccagtccatttcacaaagagtgtgacaaagtggtttactaaggaaggggttcttgtggaaggtc

SEQ ID NO: 42064 - protein, 100 aa, Panicum virgatum
  misc_feature: Ceres CLONE 2010385
  misc_feature (12)..(99): Pfam Name: SPC25 Pfam Description: Microsomal signal peptidase 25 kDa subunit (SPC25)
MASDGAAATPAKVTPKKANILDPHSIKHLLDDTISDVVKSKGYTEDTRLGNLKLGIGAAVIAVALLAQFYPKKFPQNREFLLGCIALYPFLRWVCPLFFF

SEQ ID NO: 42065 - DNA, 1818 bp, Panicum virgatum
  misc_feature: Ceres CLONE 2010431
  misc_feature: Encodes the peptide sequence at SEQ ID NO. 42066
atgcaagctagaatcacacaaaatctcctatcgaaatcaacctaaaatacggttcaaaccagcatcgtcagagatgtcagaggaacagaacacaccatgaagcttttgcagagctcatcccaggtggagctctgctagggggcttccaggcgcgtgtgccatgtgttgctggtgctcctgcctggagtgcatccataacatccctcccctcaacctcctcttcctccacttctcctccgacccagctctcccagccggagaagaaggtgcagccgtctccatggcctccatctcggttcccaacccggctcctcccgcgactgaagacgccgagaacattaggaaagcggtgcaaggatggggcacggacgagaaggcgctgatcgagatactgggccaccggacggcggcgcagcgcgcggagatcaccgtggcatacgagggcctctacaacgagacgctcctcgaccggctccactccgagctctccggcgatttccggagcgcgatgatgctgtggaccatggacccggcggcgcgtgacgccmagctcgcccacaaggccctgaagaagaagggcgaccggcacgtgtgggtgctcatcgaggtcgcctgcgcgtcgtcgccggaccacctcgtcgccctcaggaaggcctaccgcgccgcctactcggcgtccctcgaggaggacgtcgccgcctgcccgctctacaaggacccgctcaagcagttcttggtgcggctcgtgagctcctaccggtactccggcgagctcgtcgacgacgagctggcgatggcggaggccggggagctgcacgacgcggtggtggccaggaagcagacgctgcacggcgacgttgcgcgcatcgtcggctcgaggagcaagccgcagctgaaggcgacgttcgagcggttccggcaggagcacggcagggccatcgacgacgtcctcgaggaacgccgcggcgaccagctcgcggcgatgctcaagaccgcggtgtggtgcttggcatgccccgagaagcatttcgcagaggtgatccggagctccattgttgggctcggcaccgacgaggagtcgctgacgagggcgatcgtctcgcgcgcagaggtcgacatgaagaaggtgaaggaggagtacaaggtgaggtaccgcaagacggtcaccagcgacgtcaacggcgacacgtccggctactacaatggcatcttgctcacctagtgggggcctgagtaagatggccatgaatggatttctgtaggttggagggcagattgattgatacgcagctgttctggttttggatatgattgagcaacgtgaagctgtcatgccgcgtgtgttcttgtagtgatgcaaaactgcggagtgaaatggtggcgatatttgtgatatttggtgagaataaaacgctagatccatgggcaaaaaactgaatagtagaggctagattgtctcagtattatcatctactcactttgtacacataaaatccatttcaattcgactcaagtatcaccagtttagccccagaatagccgaacgcatctccttgttcatcggtgagcagagcagagacaccatccattcatcttacttctttctagcaacagcagctgcaattccaccaaccagaagtcccacagcagttgtcgcgattcctattccaataagaccatctgcaccatgacaagaataccattagatctacaccatgacaatagacagcaaatcacttcaacagatgtactgatatatatataatatatgttatcccaatgaaacatggaaggaaacaaaaaagcaattgctttcag

SEQ ID NO: 42066 - protein, 313 aa, Panicum virgatum
  misc_feature: Ceres CLONE 2010431
  misc_feature (15)..(80): Pfam Name: Annexin Pfam Description: Annexin
  misc_feature (249)..(313): Pfam Name: Annexin Pfam Description: Annexin
  misc_feature (87)..(155): Pfam Name: Annexin Pfam Description: Annexin
  misc_feature (90)..(90): Xaa is any aa, unknown, or other
MASISVPNPAPPATEDAENIRKAVQGWGTDEKALIEILGHRTAAQRAEITVAYEGLYNETLLDRLHSELSGDFRSAMMLWTMDPAARDAXLAHKALKKKGDRHVWVLIEVACASSPDHLVALRKAYRAAYSASLEEDVAACPLYKDPLKQFLVRLVSSYRYSGELVDDELAMAEAGELHDAVVARKQTLHGDVARIVGSRSKPQLKATFERFRQEHGRAIDDVLEERRGDQLAAMLKTAVWCLACPEKHFAEVIRSSIVGLGTDEESLTRAIVSRAEVDMKKVKEEYKVRYRKTVTSDVNGDTSGYYNGILLT

SEQ ID NO: 42067 - DNA, 726 bp, Panicum virgatum
  misc_feature: Ceres CLONE 2010433
  misc_feature: Encodes the peptide sequence at SEQ ID NO. 42068
cccacacagcaccactgcaacacacacagcatttgcttaattagctaataagcacgaccctatcggtactaatggcggctttgatgatgaagaacaagaagcagatgcagccggtggtggcgttggccgttgtggtggcggcggcggcgctggtggcgtcggcgtcggcggccatcacgtgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcagaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagctcgatccgctcagaagctagctgctagctagcgagctatattcaggagaataaaataaagttgaggcatcatcagcagcacatcatctatatatattattgttgtactcgatctgtgtgtacgtgcgcgtatacatacatgcatgcttatacgatcgatgtatatatatgtgctgcttctctcacaagtacgtgtgctcatatacatacatacatgtgtgctag

SEQ ID NO: 42068 - protein, 126 aa, Panicum virgatum
  misc_feature: Ceres CLONE 2010433
  misc_feature (37)..(122): Pfam Name: Tryp_alpha_amyl Pfam Description: Protease inhibitor/seed storage/LTP family
MAALMMKNKKQMQPVVALAVVVAAAALVASASAAITCGQVGSALAPCIPYATGKASALPSSCCGGVRSLNSAARTSADRQAACRCLKSLASTVKSVNMGTVATIPGKCGVSVPFPISMSTDCNKVN

SEQ ID NO: 42069 - DNA, 634 bp, Panicum virgatum
  misc_feature: Ceres CLONE 2010434
  misc_feature: Encodes the peptide sequence at SEQ ID NO. 42070
aaaccaaaaatccccaatccatgaagcccaccacttccgccgccgccgccgccgcggcggccaccagcgatgacccttccccttcgccgtccgactccacgtcggcgactttcaccgtcgaccgccgcggggacgcctccgcctcctgccggtggaccctcccggacttcccccgcacccgcgcccgtaccttctacagccgctacttcgaggtcggcggcttcgactgccgcctcctcctctacccgcggggcgactcgcaggcgctgccggggtacctctccctctatctccaggtcctcgaccccaaaaccccggtgtcgtcatcgtcctccaccacgaccaccacctcctcgaaatgggactgcttcctcagctatcgcctctccgtcgtccacccgaccgatcccgccaagtcgttggggcgcgattcatggcaccgattctcctccaagaagcgctcccacggctggtgcgactttgcgccctcctcggccgccgccttcctcttccagccccacgacgcgctcgtcatcgccgccgacatatcggtcctctccgagacggcctcctatgccgattctgacggtcgcttcacctggaaggtactcaatttcggcatcttccgggatat

SEQ ID NO: 42070 - protein, 204 aa, Panicum virgatum
  misc_feature: Ceres CLONE 2010434
  misc_feature: SWISSPROT Homolog: EC 3.1.2.15 Ubiquitin thiolesterase
MKPTTSAAAAAAAATSDDPSPSPSDSTSATFTVDRRGDASASCRWTLPDFPRTRARTFYSRYFEVGGFDCRLLLYPRGDSQALPGYLSLYLQVLDPKTPVSSSSSTTTTTSSKWDCFLSYRLSVVHPTDPAKSLGRDSWHRFSSKKRSHGWCDFAPSSAAAFLFQPHDALVIAADISVLSETASYADSDGRFTWKVLNFGIFRD

SEQ ID NO: 42071 - DNA, 662 bp, Panicum virgatum
  misc_feature: Ceres CLONE 2010472
  misc_feature: Encodes the peptide sequence at SEQ ID NO. 42072
ctcctcctccgatcgattgggattggattggattggattccccaacaaacaagcaacaaggggttgcaaggcaacaaattaagagagatcacccagaccagaatcggaggagctggcggcgtctactaagctggaagaggaggatccggagccggtcggccgcctcggcgaagccccagcagcagcagcagcagagaccgagtccgaggagcagcgcaacaagttcctggtgctccgcctgtacgaggcgctccacggccgcgaccacgccgccgtgcaggccctcctcgcccccgacctcgagtggtggttccatggcccgcccaagcaccagcaccacatgatgcgcgtgctcaccggcgccggagccggatccaacaacaataatttcagctttgtgccgcgctccgtcgacgccttgggctccaccgtcatcgccgagggacctcccgccgaccagtgccacatcagggatactaatgtgtactgggtccacgcctggaccgtgggcccggatggggtgatcacccagctgcgcgagtacttcaacaccgacctcaccgtcacccgcctcgccgccgccaccaagtgcaagtgcgtctggcagagccgccgccccgacagggcaacaaactcgctaccaggcctcgtcctcgccctct

SEQ ID NO: 42072 - protein, 107 aa, Panicum virgatum
  misc_feature: Ceres CLONE 2010472
  misc_feature (2)..(107): Pfam Name: WI12 Pfam Description: Wound-induced protein WI12
MMRVLTGAGAGSNNNNFSFVPRSVDALGSTVIAEGPPADQCHIRDTNVYWVHAWTVGPDGVITQLREYFNTDLTVTRLAAATKCKCVWQSRRPDRATNSLPGLVLAL

SEQ ID NO: 42073 - DNA, 612 bp, Panicum virgatum
  misc_feature: Ceres CLONE 2010478
  misc_feature: Encodes the peptide sequence at SEQ ID NO. 42074
aatctcattcgctcctgccgccgccactttcttgccgccgccgccgcagacgcctcccatccgcctcgaagcttccgctcgccggtcccagccatggtgaagtactcgagggagccgaccaaccccaccaagtccgccaaggccatgggctgggacctccgtgttcacttcaagaacacccgtgagacagcttttgccctcaggaaattgccactcactaaggccaaaaggtaccttgaggatgtgattgcccacaagcaggccatccccttccgcaggtactgtggcggtgttgggcgtactgctcaggctaagtcgcgccactcaaatggacagggacgctggcccgtcaagtctgctagattcattcttgatcttctaaagaatgctgagagcaatgctgaggtcaaaggtcttgatgtcgataccctgtatgtgtctcacattcaagtgaaccaggctcagaagcagcggcgcaggacctaccgtgcccatggacgcatcaacccttacatgtcctccccgtgccacattgagctgatcttgtcggagaaggaagagccagtgaagaaagaggcggagtctcagattgcgaccaggaaggcttaagga

SEQ ID NO: 42074 - protein, 171 aa, Panicum virgatum
  misc_feature: Ceres CLONE 2010478
  misc_feature (17)..(153): Pfam Name: Ribosomal_L22 Pfam Description: Ribosomal protein L22p/L17e
MVKYSREPTNPTKSAKAMGWDLRVHFKNTRETAFALRKLPLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 42075 - DNA, 729 bp, Panicum virgatum
  misc_feature: Ceres CLONE 2010482
  misc_feature: Encodes the peptide sequence at SEQ ID NO. 42076
accgaggcaagtcagcgatgaatcccttcgcgaagaagccaacgccgcgagaggtgatgcggagcagcaagcgagacctgacgaatgctacgcgagggattgagagggatatcgcatcattacaacaagaggagaagaagctagttgctgaaattaaaaggacagcaaaaactggcaatgaggcagcaacaaaaattctagcccgtcagctgatcaggttaaggcaacagatttctaatttgcaaggtagccgagctcagattcgggggattgcaacacatactcaggcaatgcatgccaacacttcagtggctactggtttacaaagtgcaagcaaagcaatgggagctcttaataagcaaatggcacctgaaaagcagatgaaaataatgaaagaattccaaaagcagtcagcacaaatggatatgacaaatgagatgatgtctgattcaattgatgatgttttagacgatgatcaggctgaggaagaaactgaagaacttgctaatcaggttctggatgagattggtgtggacatcgcctcacagttgtcctcggctcctaaaggaaaaattgccagaaagaaggttcaggttgatgaaagttcagagctggaggaactagagaaaaggctggctgcattaaaaaatccataagatggtatctgtttgcatctctctctacgcagagttcatatcctcgttagacattcaaaagacatcgtgattt

SEQ ID NO: 42076 - protein, 212 aa, Panicum virgatum
  misc_feature: Ceres CLONE 2010482
  misc_feature (16)..(186): Pfam Name: Snf7 Pfam Description: Snf7
MNPFAKKPTPREVMRSSKRDLTNATRGIERDIASLQQEEKKLVAEIKRTAKTGNEAATKILARQLIRLRQQISNLQGSRAQIRGIATHTQAMHANTSVATGLQSASKAMGALNKQMAPEKQMKIMKEFQKQSAQMDMTNEMMSDSIDDVLDDDQAEEETEELANQVLDEIGVDIASQLSSAPKGKIARKKVQVDESSELEELEKRLAALKNP

SEQ ID NO: 42077 - DNA, 678 bp, Panicum virgatum
  misc_feature: Ceres CLONE 2010505
  misc_feature: Encodes the peptide sequence at SEQ ID NO. 42078
aaacccagacacattcttgtgcccggcaattggcaacgatccgcccaccagctgctccatggacagctacttcgatgacatcttgaaggatacagagcaccacgcttgcacccacacccacacctgcaacccgccggtccacgaccattcgcacacccacacctgtgtccatgtccacaccaagattgttgcggcttcaccggatgccgctgagaccgcggaatcgccgtctgagaacaacaccaccaagaagcgcccgtctggtaaccgagcagcggtgaggaagtaccgggagaagaagaaggctcacacagcgtcgttggaggaagaggtggtccacttgagggctttgaaccagcagctcatgaagaagctccaaaatcacgccgcgcttgaggcggaggtagccaggcttcgctgcctgcttgttgatatcaaaggggaagggaaaacagaagggaggcagaagaaagaagcgtcgaggaaaacacttttgtaacaagttttgtattaagatagatgaatgaaactttagatgacaccttgtaatctttctggcattaagatattgtaccttgttctgctggaatcttggaagcaatacttaaaccatgtaatcctcgagggaaatgaaacacctgtgacataacggcgcatgtagaaggtgctgatatatag

SEQ ID NO: 42078 - protein, 165 aa, Panicum virgatum
  misc_feature: Ceres CLONE 2010505
  misc_feature (77)..(134): Pfam Name: bZIP_2 Pfam Description: Basic region leucine zipper
  misc_feature: The sequence is a functional homolog of SEQ ID NO 208 in the 10/225,068 US patent application
  misc_feature: The sequence is a functional homolog of SEQ ID NO 2360 in the 10/374,780 US patent application
  misc_feature: The sequence is a functional homolog of SEQ ID NO 372 in the 10/412,699 US patent application
  misc_feature: The sequence is a functional homolog of SEQ ID NO 863 in the 11/479,226 US patent application
  misc_feature: The sequence is a functional homolog of SEQ ID NO 1707 in the 11/479,226 US patent application
  misc_feature: The sequence is a functional homolog of SEQ ID NO 1463 in the 11/479,226 US patent application
  misc_feature: The sequence is a functional homolog of SEQ ID NO 52 in the 10/286,264 US patent application
  misc_feature: The sequence is a functional homolog of SEQ ID NO 694 in the 10/412,699 US patent application
NPDTFLCPAIGNDPPTSCSMDSYFDDILKDTEHHACTHTHTCNPPVHDHSHTHTCVHVHTKIVAASPDAAETAESPSENNTTKKRPSGNRAAVRKYREKKKAHTASLEEEVVHLRALNQQLMKKLQNHAALEAEVARLRCLLVDIKGEGKTEGRQKKEASRKTLL

SEQ ID NO: 42079 - DNA, 454 bp, Panicum virgatum
  misc_feature: Ceres CLONE 2010507
  misc_feature: Encodes the peptide sequence at SEQ ID NO. 42080
agctccgccacaatatgtatctctttccttaatccctctacctaccggcgaaaaatgggtaacacctccttgctgcggccattggtgctggcgctccttgcggccgccgccgccgccggccgtgggaagctgagcacttacatcgtccacatggccgagtcggcgatgccacccgagtacgcggaccacggcgagtggtactgcgcctcgctgcgctccgtgtccgcggccagttagatgctctacgcctgcgacaccgtcctgcacggcttctcggcgcgcctcacggctgcggaggtcgtctgcctggcgcgcctcgagggcgtcctcgccgtgaacgccgaggcgcgttacgagctgcacacctggcgaacgcccgagttcctgggcatcgcgggcgccgacctgctcccgcagtacgggacggcggcggacgtcgacagctgggtgctcg

SEQ ID NO: 42080 - protein, 72 aa, Panicum virgatum
  misc_feature: Ceres CLONE 2010507
  misc_feature: SWISSPROT Homolog: EC 3.4.21.25 Cucumisin
MLYACDTVLHGFSARLTAAEVVCLARLEGVLAVNAEARYELHTWRTPEFLGIAGADLLPQYGTAADVDSWVL

SEQ ID NO: 42081 - DNA, 707 bp, Panicum virgatum
  misc_feature: Ceres CLONE 2010518
  misc_feature: Encodes the peptide sequence at SEQ ID NO. 42082
atccctctccgcctccgaccgagagccctccctccctccatcttcctccccacccggcgattgagaaaggtgtccccggctagtaggtagaatgctgctgagctcccccttggtgtccccggcgctgcgggtctctccgcagctgcagccggggaatggctgtcgcctccggatcgaggcggcgaggcagctgacggggcgggtggtgacgaccaaggcggacaagacggtgggcgtggaggtggtgcgcctggcgccgcatcccaagtacaagcgccgagagcgtatcaagaagaagtaccaggcgcacgaccccgacaaccagttcaaggtcggcgacgtcgtcgagctccgaagctcccgccccatctccaagaccaagcacttcatcgccgttccgctcccgccccgcgacacccgccgcaagtcgcagctcctcccgccgctccagtcgcagcaggccgccgaagacgacgaccagcagccgccgccctccacggcacagtgaccgaggtcgaccgccattattcctattcccttgcctctgcggaaccaaccactcttcaagttgtgtaatttggccaaaatttcccctacctactttacttattattattgcgtctgcgtatggtttgccgtttcctttaatctcgttctcgcaaccaccaccatcatcgtcatcatatagagcttgtgtttgattggtt

SEQ ID NO: 42082 - protein, 138 aa, Panicum virgatum
  misc_feature: Ceres CLONE 2010518
  misc_feature (36)..(104): Pfam Name: Ribosomal_S17 Pfam Description: Ribosomal protein S17
MLLSSPLVSPALRVSPQLQPGNGCRLRIEAARQLTGRVVTTKADKTVGVEVVRLAPHPKYKRRERIKKKYQAHDPDNQFKVGDVVELRSSRPISKTKHFIAVPLPPRDTRRKSQLLPPLQSQQAAEDDDQQPPPSTAQ

SEQ ID NO: 42083 - DNA, 722 bp, Panicum virgatum
  misc_feature: Ceres CLONE 2010527
  misc_feature: Encodes the peptide sequence at SEQ ID NO. 42084
atcactcctcactcccactctctctccactccccctgcttcgccactttccccaccttcgccgcttcctctcggagtcgaaaccctagccaaccagctcgatggcctgggcggcggctacggctgcggctctggtggttgcggcggcggtgctgtcgccggcctccgtggcgtcggcgtccaacgcggagggcgacgcgctgtacgcgctgcggcgcgcgctcaaggacccccggggcgtgctccagagctgggaccccaccctcgtcaacccctgcacctggttccacgtcacctgcaaccgcgacaaccgcgtcacccgcgtggatttgggtaactccaatttgtcaggcaatcttgttcctgaactggggcaccttgagcacttgcaatatctagaactctacaaaaacaatattcagggcactatcccagctgagcttgggaatctgaagagccttatcagcttggacctgtataacaacaacattacagggaacataccaagggaacttggcatgatgaaatctttagtattcctgcgacttaatgacaaccatttgacgggtccagttccaagggaactgacaaaaatctctagcctcaaagtgatagacgtctcaaacaatgatctttgcggcacaatcccaactagtgggccttttgagcacataccattgagcaactttgacaataatccaagaatggaagggcccggagttg

SEQ ID NO: 42084 - protein, 207 aa, Panicum virgatum
  misc_feature: Ceres CLONE 2010527
  misc_feature (27)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAWAAATAAALVVAAAVLSPASVASASNAEGDALYALRRALKDPRGVLQSWDPTLVNPCTWFHVTCNRDNRVTRVDLGNSNLSGNLVPELGHLEHLQYLELYKNNIQGTIPAELGNLKSLISLDLYNNNITGNIPRELGMMKSLVFLRLNDNHLTGPVPRELTKISSLKVIDVSNNDLCGTIPTSGPFEHIPLSNFDNNPRMEGPGV

SEQ ID NO: 42085 - DNA, 709 bp, Panicum virgatum
  misc_feature: Ceres CLONE 2010530
  misc_feature: Encodes the peptide sequence at SEQ ID NO. 42086
aacgttcacctctctcccgttcatactccccttccgtatgaacatgcccacggcagccacggcataaagcgtcgcgccatcgagcgcatgcctcgatctcctctaccattagctgaaccctagatactggcaagaaattaagcctggtgcttccccggaggccgcgcgccatgatcacgcccgttgctgacccgacgatgatggacggggacgacgcgcgcgcgtcgctgctcccggagaccgaccctcgacgcggtggccccggcggcggcgggcagaagcgcccgtcgtcgtcgaccgtcctccccgccgtcgtctccgcggcgctcctgctcgtgctcgccgcggtcgcgatcctgtcgtcgcagcacgccgacgacgggcaggggggcgtcgccgccgccgcggggcgcgtcgtcgtggaggtggccgcctcccgcggcgcggcggagggcgtgtcggagaagtcgacggccccgctcctcggcgcgctccgggactacgcctggaccaacgcgatgctggcgtggcagcgcacggcgttccatttccagccccccaagaactggatgaacgatccgaacggtccgctgtatcacaagggctggtaccacctcttctaccaatggaacccggactcggcggtgtggggcaacatcacctggggccacgccgtgtcgcgcgacctcgtccactggctgcacctgcg

SEQ ID NO: 42086 - protein, 179 aa, Panicum virgatum
  misc_feature: Ceres CLONE 2010530
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
MITPVADPTMMDGDDARASLLPETDPRRGGPGGGGQKRPSSSTVLPAVVSAALLLVLAAVAILSSQHADDGQGGVAAAAGRVVVEVAASRGAAEGVSEKSTAPLLGALRDYAWTNAMLAWQRTAFHFQPPKNWMNDPNGPLYHKGWYHLFYQWNPDSAVWGNITWGHAVSRDLVHWLHL

SEQ ID NO: 42087 - DNA, 711 bp, Panicum virgatum
  misc_feature: Ceres CLONE 2010569
  misc_feature: Encodes the peptide sequence at SEQ ID NO. 42088
gaaggcacgaccaccaccgccggccgggaagcaagctcaaaccctaaccgccggcgacgccagcacgatggcccgctacgaccgcgcgatcacagtcttctcccccgacggccacctcttccaggtcgagtacgccctcgaggccgtccgcaaggggaacgccgccgtcggcgtccgcggcgccgacaccgtcgtcctcggcgtcgagaagaagtccacccccaagctccaggactccaggtccgtgcgcaagatcgccagcctggacacccacatcgcgctggcgtgcgcggggctcaaggcggacgcgcgcgtgctcatcaaccgcgcgcgggtcgagtgccagagccaccggctcaccgtcgaggaccccgtcaccgtcgagtacatcacccgctacatcgccgggctgcagcagaagtacacgcagagtggtggagtccgccccttcggcctctccacgctcatcgtcggcttcgacccctacaccgacaagccggctctgtaccagaccgacccatctggcaccttttctgcctggaaggccaacgccacggggaggaactccaactccatgagggaattcctcgagaagaactacaaggaaacctctggcaaggagactatcaagctcgccatccgtgcacttctagaggttgttgaaagtggtgggaagaacatcgaggttgcagtgatgacaaggaaggatgg

SEQ ID NO: 42088 - protein, 214 aa, Panicum virgatum
  misc_feature: Ceres CLONE 2010569
  misc_feature (27)..(210): Pfam Name: Proteasome Pfam Description: Proteasome A-type and B-type
  misc_feature: SWISSPROT Homolog: EC 3.4.25.1 Proteasome endopeptidase complex
MARYDRAITVFSPDGHLFQVEYALEAVRKGNAAVGVRGADTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTRKD

SEQ ID NO: 42089 - DNA, 587 bp, Panicum virgatum
  misc_feature: Ceres CLONE 2010572
  misc_feature: Encodes the peptide sequence at SEQ ID NO. 42090
ctctaaaccctacccgcgccgccgcctcgcatcgccagccgccgccgccgcgccgtgcgagctcagagcctcagaccagcttccaccatggcggacgtcgatgtcgagcccgaggtcgccgccggcgcgcctaagaagaggacgttccgcaagtacagttaccgcggcgtcgacctcgacgcgctgctcgacatgtccaccgacgacctcgtccagctcttccccgcgcgcgcaaggagaaggttccagaggggtctgaagaggaagcccatggcgctcatcaagaagctgcgcaaggcgaaaaaggatgctcctgccggtgagaagccggagccagtgaggacccatctccgcaacatgatcattgtccctgagatgattggaagcatcatcggtgtctacaatggcaagacattcaaccaggttgagatcaagcctgagatgattggccactacctcgctgagttctccatctcctacaagccggtcaagcacggtaggcctggtattggtgccactcactcctcgcggttcattccgctgaaatgagttattgcccagttgtcagccccagaatccagcacggg

SEQ ID NO: 42090 - protein, 153 aa, Panicum virgatum; identical to SEQ ID NO: 12318
  misc_feature: Ceres CLONE 2010572
  misc_feature (55)..(136): Pfam Name: Ribosomal_S19 Pfam Description: Ribosomal protein S19

SEQ ID NO: 42091 - DNA, 701 bp, Panicum virgatum
  misc_feature: Ceres CLONE 2010576
  misc_feature: Encodes the peptide sequence at SEQ ID NO. 42092
ggctaatgttaagcgggtagagcaccagactggtgctcacattaaggttcaagaagttgacaaagatgtttctgaagaaaggattattattgtttcatctaaggagataccagctgatccaatatccccaacaattgaggcactcatgttgctacatgataaactaagtgcactctctgagaaacgccatgtgagtacaaggcttgttgtaccatcaagcaaagttggctgtattcttggggaaggtgggaagataattactgaaatgagaaggcgaactggggcagaaattcgagtctactcaaaggcagataaaccaaagtacttgtcttttgatgacgagcttgtgcaggttgctgggcctccagctgttgcaagaggagccctcacagagattgcttcgagacttagaactaggactttgagagatacaaattctgtcaataaccctccacctgtcgccccttttcatggtccgcctgttgatctgcctagcagagaattcccagtacatggaaggcccgccaatgatccaccaccatatggaaggcctgccattgatccacaatctggaagacttaccaacgatccatatggtaggcctgccatagatccaccatttggaagactaaccaatgattcaccatatggaaggactgccattgttctaccatttggaagacctaccaatgatccaccat

SEQ ID NO: 42092 - protein, 233 aa, Panicum virgatum
  misc_feature: Ceres CLONE 2010576
  misc_feature (65)..(132): Pfam Name: KH_1 Pfam Description: KH domain
ANVKRVEHQTGAHIKVQEVDKDVSEERIIIVSSKEIPADPISPTIEALMLLHDKLSALSEKRHVSTRLVVPSSKVGCILGEGGKIITEMRRRTGAEIRVYSKADKPKYLSFDDELVQVAGPPAVARGALTEIASRLRTRTLRDTNSVNNPPPVAPFHGPPVDLPSREFPVHGRPANDPPPYGRPAIDPQSGRLTNDPYGRPAIDPPFGRLTNDSPYGRTAIVLPFGRPTNDPP

SEQ ID NO: 42093 - DNA, 661 bp, Panicum virgatum
  misc_feature: Ceres CLONE 2010594
  misc_feature: Encodes the peptide sequence at SEQ ID NO. 42094
aatcgccagttattaatctcaggttggggaaaaaagcctcgcaaacaaccctccgctgctgatttgggaggcgctcgaggtaaaccagacctttgggacacatggctcgtactaagcaaaccgctcgcaagtccactggagggaaggctcctaggaagcaactagccacgaaggctgcccgtaagtctgcgcccacaactgggggagtgaagaagcctcaccgttaccgccctgggactgttgctcttcgtgaaatccgcaagtaccagaagagcactgacctgctcataaggaagcttccattccagaggcttgttagggagattgcccaggatttcaagactgatcttcgtttccagagccatgcggtgcttgccctgcaggaggctgcggaagcatacctggtgggtctgttcgaggacaccaacctgtgtgccatccacgccaagcgcgtgacgatcatgcctaaggacattcagctggctaggaggattcgcggcgagagggcttagtttcactgctctggtgtgcatctgttcgatgcaactgcttttgcgatgttggtgctttaacatctgtcagtgttttgaactctgaactatagtgttcgttcgtggtgctaggttaggtgctgctgcaatcttattatgttttagagttt

SEQ ID NO: 42094 - protein, 136 aa, Panicum virgatum; identical to SEQ ID NO: 9774
  misc_feature: Ceres CLONE 2010594
  misc_feature (58)..(132): Pfam Name: Histone Pfam Description: Core histone H2A/H2B/H3/H4

SEQ ID NO: 42095 - DNA, 706 bp, Panicum virgatum
  misc_feature: Ceres CLONE 2010602
  misc_feature: Encodes the peptide sequence at SEQ ID NO. 42096
atccatctactgattatgcatgacagctcaaatgtggttgcagcaatggtgtctctcgcacggcgccacggcgagcctagccatcttcctcctcctcttccctctcctcgtgctgctcgtcacggcgcgcctgctgcggccgagcaagcagctggagacgctgagccggatcccttcgccgccacagctcccgatcatcggccacctccacctcgtgggcgccctcccgcacgtctccctccgtgacctcgccgccaagcacgccggcggcggcctcatgctcctccgcctcggcaccgtccccaacctggtcgtgtcgtccccgcgcgcggcgcaagcgatcttgcgcacgcacgaccacatcttcgcctcgcgctcgacgactgccatcaccgacactctcatgtacagctcgtctgacatcgccttggccccctacggcgagcactggcgccaggccaggaagctcgtcactgcacacctcctcaccgtcaagaaggtgcactcctaccgccatgcccgccaagaagaggtgcgcctggtgatggccaagctacgggaggcgggagccgcgagcacagccgtggacatcggcgagatgatgaacacattcgccaacgacatcatcagccgcgccgtgtcgggcaagctcttcagggtggaagggaggaacaagctcttccgggagctcgttgataacaactcc

SEQ ID NO: 42096 - protein, 224 aa, Panicum virgatum
  misc_feature: Ceres CLONE 2010602
  misc_feature: SWISSPROT Homolog: EC 1.14.13.68 4-hydroxyphenylacetaldehyde oxime monooxygenase
MWLQQWCLSHGATASLAIFLLLFPLLVLLVTARLLRPSKQLETLSRIPSPPQLPIIGHLHLVGALPHVSLRDLAAKHAGGGLMLLRLGTVPNLVVSSPRAAQAILRTHDHIFASRSTTAITDTLMYSSSDIALAPYGEHWRQARKLVTAHLLTVKKVHSYRHARQEEVRLVMAKLREAGAASTAVDIGEMMNTFANDIISRAVSGKLFRVEGRNKLFRELVDNN

SEQ ID NO: 42097 - DNA, 707 bp, Panicum virgatum
  misc_feature: Ceres CLONE 2010611
  misc_feature: Encodes the peptide sequence at SEQ ID NO. 42098
gagcttatcgcttatcatctgcgcctccccatctcttccccgctcctccgcctcctcgtgatccatccaaaccaggagtcgtcatgtcggactcggaggagcaccactttgagtcgaaggccgacgctagggcgtccaagacctatccgcagcaggccggtgccatccgcaagaacggcttcatcgtcatcaagggccgcccctgcaaggtggtggaggtttctacctctaagactggtaagcacggtcacgctaagtgccactttgttgccatagatattttcaatgggaaaaagcttgaagatattgttccatcttcccacaattgtgatgtcccacatgtgaaccgcactgagtaccagctgattgacatttccgaggatggatttgtgagccttcttacctctgatggcaacaccaaggatgatcttaaactcccaactgatgagcagctcctgaagctgatcaaggatggatttgaggagggcaaggaccttgtggtgactgtccagtcagccatgggcgaggagcagatctgcgcgctgaaggacattgcacccaagtaaattctctggacaacacaagccttggaacagagggacctactgtatctccaacttaaaatcgaaaaagacattgcgaggaaggattggatcgacaccgagacatctctccctagcttgagctggcttttgctgtagtaaact

SEQ ID NO: 42098 - protein, 160 aa, Panicum virgatum
  misc_feature: Ceres CLONE 2010611
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADARASKTYPQQAGAIRKNGFIVIKGRPCKVVEVSTSKTGKHGHAKCHFVAIDIFNGKKLEDIVPSSHNCDVPHVNRTEYQLIDISEDGFVSLLTSDGNTKDDLKLPTDEQLLKLIKDGFEEGKDLVVTVQSAMGEEQICALKDIAPK

SEQ ID NO: 42099 - DNA, 653 bp, Panicum virgatum
  misc_feature: Ceres CLONE 2010612
  misc_feature: Encodes the peptide sequence at SEQ ID NO. 42100
atttaacagactaaagttcccctttcctggacatgttcttgtctatgggcctcgaggttctgggaaaactgctttgaccagggcatctgcaaaatactttgaagatcataaagagatcttggcacacgtaatatacagagattgttccaaacttgccctaggcaaggctaaggagacgaggcaagcaattgaggacagcatttctgaagcgctgcttcattcaccttcgatcatcatatttgatgatctggacagtgtgatttcggtctcttcagatcctcaagtttctcaatcgtccagttcttctgattcactagtaaggtatttggctgacattatggatgagtacaaggataagactcgaagtacatgtggatatggacctattgcatttatggcttcagttcaatcacttcagagtcttcctcaagacttaacctcttctggtagatttgatttccacattgagcttcctgctcttgcagtccctcagcgcaatgcacttttgaaacatcaagttgaggagcatgagttgcagtgttctgaggaagttctgtctgagatagcatcaaaatgtgaaggttatgatgcatatgacttggaaattttggttgatagggctgtgcacgctgctgcttctcggtttgttctgc

SEQ ID NO: 42100 - protein, 217 aa, Panicum virgatum
  misc_feature: Ceres CLONE 2010612
  misc_feature (11)..(213): Pfam Name: AAA Pfam Description: ATPase family associated with various cellular activities (AAA)
FNRLKFPFPGHVLVYGPRGSGKTALTRASAKYFEDHKEILAHVIYRDCSKLALGKAKETRQAIEDSISEALLHSPSIIIFDDLDSVISVSSDPQVSQSSSSSDSLVRYLADIMDEYKDKTRSTCGYGPIAFMASVQSLQSLPQDLTSSGRFDFHIELPALAVPQRNALLKHQVEEHELQCSEEVLSEIASKCEGYDAYDLEILVDRAVHAAASRFVL

SEQ ID NO: 42101 - DNA, 1856 bp, Panicum virgatum
  misc_feature: Ceres CLONE 2010623
  misc_feature: Encodes the peptide sequence at SEQ ID NO. 42102
gtagcacaagcatttccggccgcgcgaggtttccttcctcccatcgatctgtacgccctccccatcggccgccggtcgcgcgcctccgcctacctcccggctcgtcgccgtccgtctccgcccccaaaccctgctgcccctgccagctacgctgctccctgcccgcgccatggccaccaacggcagctccccgagggttcgggacacggagagcagcctggagaaggtgaagcgccagctgtcgtcggggtccgggaggtacctgcttcaggggcccctgctcaagcgatctgagacgctgcggaaatggaatgaacgatgggtcatattggaccccacatctggaaagatggaatacaaactccggaggaatgaaactgccataaaggggaccattctatttgacgcctcaagcaccattactttatctcctgtgaactttcaagggatgccgaagtatgatggttgctgcttctatatcggaactcctcaaaagaaggattactttctttgcgctgaaactcctggtgctgcgaaagcttgggtatctacattacacgcaactcagttagtactccgagctcataaagaggcagtaaattccttggctgggaatggctctccagctacattaggcactgttgctactgcggttgctaatgctaatgcaacagccatggaggctatcaaagagatagaagctgcaatgaaggtctcgatgagggcagctcttgggttgggtacaaataattccaatcagggccaactagatgacctaacaatcatgaaggagactctccgagtgaaagatgaggaattgcagcatttggctaaggatattcgttctcgtgatgctacaataaaggaaatagcagacaaattaacagaaactgcagaggctgcagaagctgctgcttcggcggcacatacaatggatgaacagagacgacttttatgtttggagattgagcgcctaaaaagtgccttggaaaggcaaatagaacagtcaatgcttaagctaagacaatccgaagagaaggttattagtctgagcaaagagaaggaccagttgatgaaggaaagagatgctgcatttcaagaggctcatatgtggcgcactgaactaggaaaagctagagaacaagcagtgattcaggaagcaactattgcccgagcggaggagaaggcaagggtttctgaagcagatgctgcagctcggataaaggacgctgctgaaaaactgcatgctgtggagaaagaaaaggaagagcttctagccctggttggtgttctccaatcacaagtccagagagaacagagcagcacaaagcaagtatgtgaggagaggtctgaatcatgctccggtgccgacaattctcctcccttaacaaagcacgttgatgcatcagacgatgatgtagacaaagcctgtgtaagcgactctagatcagtcctggtttccagcgaaagcaccgaggtccaactggctgtggatggggtggacatccgtcctattggtgatgcagagtggggcagcttccagcagtcagaggctctgatcgctgatgtgcgggaggtctccccagaggccgaaggcggcagcttggatattcctgtggtaaatcccccaccagtcaatgatcatatgcagggaggcgcgactcatccttgaatgcccggtttgctgctggcctgctgccaccttctgagattgtgattgctgagaaaccgatagggatttgaatcctggagagaattgccgttgctggtattttgcattgatgcgggttgtatgttcattgtatttaagtatacaactgaataaaaagataagtagtgtttggctgtgagattgg

SEQ ID NO: 42102 - protein, 500 aa, Panicum virgatum
  misc_feature: Ceres CLONE 2010623
  misc_feature (31)..(134): Pfam Name: PH Pfam Description: PH domain
MATNGSSPRVRDTESSLEKVKRQLSSGSGRYLLQGPLLKRSETLRKWNERWVILDPTSGKMEYKLRRNETAIKGTILFDASSTITLSPVNFQGMPKYDGCCFYIGTPQKKDYFLCAETPGAAKAWVSTLHATQLVLRAHKEAVNSLAGNGSPATLGTVATAVANANATAMEAIKEIEAAMKVSMRAALGLGTNNSNQGQLDDLTIMKETLRVKDEELQHLAKDIRSRDATIKEIADKLTETAEAAEAAASAAHTMDEQRRLLCLEIERLKSALERQIEQSMLKLRQSEEKVISLSKEKDQLMKERDAAFQEAHMWRTELGKAREQAVIQEATIARAEEKARVSEADAAARIKDAAEKLHAVEKEKEELLALVGVLQSQVQREQSSTKQVCEERSESCSGADNSPPLTKHVDASDDDVDKACVSDSRSVLVSSESTEVQLAVDGVDIRPIGDAEWGSFQQSEALIADVREVSPEAEGGSLDIPVVNPPPVNDHMQGGATHP

SEQ ID NO: 42103 - DNA, 653 bp, Panicum virgatum
  misc_feature: Ceres CLONE 2010628
  misc_feature: Encodes the peptide sequence at SEQ ID NO. 42104
ctgaatcgaaccagagttccagaccagagaaccgaccaccaccgctcggctccgctccgctccgctcacctcgccggcctagggttttgccgcggctcatctctcacgatccgaaatggccgccgctcacgcgggctcctccgccgcagccggcgaggccccgaccaccggggagcaccggatggggaccaccatcgtcggggtctgctacgacggcggcgtcatcctcggcgccgactccaggaccagcaccggaatgtatgtggcaaaccgtgcttcagacaagattactcaactgacggataatgtgtatgtctgccgctctggatctgctgctgatacacaagtcatttcagactatgtacgttatttccttcaccaacacataatccagcttgggcaaccagctactgtcaaagttgcagcaaacttgattaggttgctagcctatcagaacaagaacatgttgcaagctggcatgataattggaggatgggacaagtatgaaggaggccaaattttctccgttccccttggtggaacgattctgagacagccatttgcaattggaggttcgggttcaagttacctatatgcgctgcttgatcatgaatggagagagggaatgagccaggaggaggcagagaaattgt

SEQ ID NO: 42104 - protein, 179 aa, Panicum virgatum
  misc_feature: Ceres CLONE 2010628
  misc_feature (21)..(179): Pfam Name: Proteasome Pfam Description: Proteasome A-type and B-type
  misc_feature: SWISSPROT Homolog: EC 3.4.25.1 Proteasome endopeptidase complex
MAAAHAGSSAAAGEAPTTGEHRMGTTIVGVCYDGGVILGADSRTSTGMYVANRASDKITQLTDNVYVCRSGSAADTQVISDYVRYFLHQHIIQLGQPATVKVAANLIRLLAYQNKNMLQAGMIIGGWDKYEGGQIFSVPLGGTILRQPFAIGGSGSSYLYALLDHEWREGMSQEEAEKL

SEQ ID NO: 42105 - DNA, 595 bp, Panicum virgatum
  misc_feature: Ceres CLONE 2010641
  misc_feature: Encodes the peptide sequence at SEQ ID NO. 42106
ggcggtggtggtgaggcgaaggagggcgtggaagcttcgagcgttttttttttgcttgctgcgcaagaagaagagaaggcgcctatggcgaagaggctgctcccgtcgttgaaccgggtgctggtggagaagctggtgcagcccaagaagaccgccggcggcatcctcctcccggaaacatccaagcagctgaatgctgccaaagtggtggctgttggccctggtgagcgcgacagggaaggcaagctgatccctgttgctctgaaggaaggcgacactgttctcctgcctgagtatggtggaactgaagtcaagcttgctgctgataaacagtacctactcttcagagagcatgacatcttgggtacactcgtggactgatttgagacaatcaggaagctcatcactaatcagtctagtgtgagagatgttttaggacttgatgctacgaaacaatccttgaaaatttacatgatgatgtcatagaattttgtggtgaacatcgtgaactggataaaaatgctgcttgtttctgttgagatgcaatgcaattgagtaatatacaccatctgaagtggtgccaataattagttct

SEQ ID NO: 42106 - protein, 98 aa, Panicum virgatum
  misc_feature: Ceres CLONE 2010641
  misc_feature (4)..(96): Pfam Name: Cpn10 Pfam Description: Chaperonin 10 Kd subunit
MAKRLLPSLNRVLVEKLVQPKKTAGGILLPETSKQLNAAKVVAVGPGERDREGKLIPVALKEGDTVLLPEYGGTEVKLAADKQYLLFREHDILGTLVD

SEQ ID NO: 42107 - DNA, 1369 bp, Panicum virgatum
  misc_feature: Ceres CLONE 2010646
  misc_feature: Encodes the peptide sequence at SEQ ID NO. 42108
aagacagcaaggcacgccgggccccaccaggaggccaccactccagctcgccggtctcgtgggttccggaagaaacaactcgcgagacgccgcccaaacccgcagcgcccagcagcggccggagtcggaggcagccgaggagaagcgggcgcgggggtcgcggcgcggcgtcggccatgtcggtgagctgcgggctggagtgggtggtgtgcctggggtgcacgcggtgggcgtggaagcggctcacctacatcggcgcctacgacagcgagacgtggccgccggcgacccccggcgagttcgagcccgtcccgcgcctctgccgcgtcgtgctcgccaactacgacccggacctcagcgaccccaagttcgcgccgccgggccgcgggtacgccggcgtcgaccccaggggcgtcgtcaggcgcgccacctacgaggacgtcggcaaccgctgcccgccctacctcatctacgtcgacgaggcgcacaaggagatcgtcctcgccgtgcgcggcctcaacctcgtccgcaacgcggactacaaggtgctcatggacaacaagctggggatgcagatgttcgacggcggctacgtgcaccacggcctcctcaaggccgcccagttcatcctcgagcgggagacggagacgctgcgggacctgctgcgccggtacggccccgagtacaagctcatcttcaccggtcactcgctcggctccggcatcgccgcgctcatgaccgtgctcgtcgtcaacaaccgcaaggagttcgacaacatacccaggagccggatcaagtgctacgcgctcgcgcccgccaggtgtatgtcgctcaatctcgccgtcaagtacgcggacgtcatcaactccgtcgtgctgcaggatgactttttgccaagaacgccaacaccacttgagtacatttttgggtctatattctgcttgccctgcttgctattcctcatttgcttgagagatacatttaaacaagacaagcgaaaattcaaggatccaagaagattgtatgctcctgggcgaatgtatcatatcgttgagaggaaattttgcagatgcggaagattcccacctgaggtcagaactgcaattcctgtggaaggacgatttgagcatgttgtgctatcatgcagtactacttctgatcatgctattgcttggatcgagcgagaatcacaaaaggctttagagctaatgatggaaagtgagaatgcaatggctccacctccgcaacaaaagatggagaggttgcaaagttttgaggaggagcacaagagtgccctccagagggcaaagacattggatgttcctcatgctgccgacctgtcagaagaggaaattctggaggatggtag

SEQ ID NO: 42108 - protein, 397 aa, Panicum virgatum
  misc_feature: Ceres CLONE 2010646
  misc_feature (108)..(247): Pfam Name: Lipase_3 Pfam Description: Lipase (class 3)
  misc_feature (6)..(74): Pfam Name: Lipase3_N Pfam Description: Lipase 3 N-terminal region
MSVSCGLEWVVCLGCTRWAWKRLTYIGAYDSETWPPATPGEFEPVPRLCRVVLANYDPDLSDPKFAPPGRGYAGVDPRGVVRRATYEDVGNRCPPYLIYVDEAHKEIVLAVRGLNLVRNADYKVLMDNKLGMQMFDGGYVHHGLLKAAQFILERETETLRDLLRRYGPEYKLIFTGHSLGSGIAALMTVLVVNNRKEFDNIPRSRIKCYALAPARCMSLNLAVKYADVINSVVLQDDFLPRTPTPLEYIFGSIFCLPCLLFLICLRDTFKQDKRKFKDPRRLYAPGRMYHIVERKFCRCGRFPPEVRTAIPVEGRFEHVVLSCSTTSDHAIAWIERESQKALELMMESENAMAPPPQQKMERLQSFEEEHKSALQRAKTLDVPHAADLSEEEILEDG

SEQ ID NO: 42109 - DNA, 396 bp, Panicum virgatum
  misc_feature: Ceres CLONE 2010646-R
tgggacgcccccacggagatccttttcgcccgggacgaagatggaaaacttgtcgtcaaaaaggagcagcccaaaggaggttggttttgggaaaagacgcttcggagacggttcgggccacggcagttcatttttttttccagatggttaaaggggtaattgcagggtacgaaacatctatccccccccccccccccctatagtccgttgaaaacgtctttttgaggtacattcttttttgcgtatatagaagaggggtagtgcgaaacagcaaaaggctatctagttcacttctgtgtagaggcttcatctgtgtgcattcttggacattcgaagtctttgtaaatttatcagtacagactttgtacattgttcctggtaatgaattgcaagttg

SEQ ID NO: 42110 - DNA, 1317 bp, Panicum virgatum
  misc_feature: Ceres CLONE 2010667
  misc_feature: Encodes the peptide sequence at SEQ ID NO. 42111
atttaatcaattaattaactttatcttttctccttgccaactccccaatacttaccaaacctcctgaccagccccttttatgacttcttctgaagacaaaacccccactatctccaacaattgctcattttcccagtcttctaattcccaagaaatctttcctgctaccaaactttatcaactccttgacacattaggccgcgggactaactcaataacttacaaagggttaaacctcgtcaatgaccagcttgtaacgattcagatcttcgataaaaaatctccaagttgcatcacttccagccaaatcgacatgctgcgacgtcttaatcaccctcaattgctcaaacttcttgatattctcattacgcctcaacaagtctggcttatcttcgaatattgccaacttggctcattaaatgacctcactacacaagtcttccatgacttctccgaaggtgaaatcgcttggatttgcttcaatattctcaacgctttggagtatttacaaagtttcagcggttatcaaggaactcttactctttccaacatccttatcaacgcttctggacaaataaaaatgactggttttagcctcgctaatgaagaatatctcctcgcaaatcttgatcattcgagaaatgactttgatggaaccagtcctgcagaatatcttcatgaactctcaacttgcattcgacaaattttacatctcagccctatggatatatcaaaagaacttgaagattttctcaaaatttgctcggaaaagacagaagaagagattattgagctctctgagcttgtagaccatgaattcttgcagctctataagccagagttcttcgcgataagaaagaggtttagcgcccaagctttacaggaagttgaagattaccgccagaaacttaatataaacccaacagaaagtagtgttccattagaaatttccgaagaagaaactaacagtcctattgacagtcagccaagtttcaaccttacacaaagattggaaacattgggccaatttggacaattggaggtcactttggagactgtgaatgaggatcaagatggtgctgttatgtttggagattggagggaatcgttatcaacgtcgctgtttagaattaaatcggattctcaaaaagatgaattggatgttattgaagagattcctgatacgtcaagagcgaatattgaaacaaaaagcttgatcccttctttgaagaaaatcagaaaatcttattgggacaataaggaaaatgaagatttttcgaatatcactgttgctgaagccactccaattaaaccaat

SEQ ID NO: 42111 - protein, 334 aa, Panicum virgatum
  misc_feature: Ceres CLONE 2010667
  misc_feature: SWISSPROT Homolog: EC 2.7.11.1 Non-specific serine/threonine protein kinase
MLRRLNHPQLLKLLDILITPQQVWLIFEYCQLGSLNDLTTQVFHDFSEGEIAWICFNILNALEYLQSFSGYQGTLTLSNILINASGQIKMTGFSLANEEYLLANLDHSRNDFDGTSPAEYLHELSTCIRQILHLSPMDISKELEDFLKICSEKTEEEIIELSELVDHEFLQLYKPEFFAIRKRFSAQALQEVEDYRQKLNINPTESSVPLEISEEETNSPIDSQPSFNLTQRLETLGQFGQLEVTLETVNEDQDGAVMFGDWRESLSTSLFRIKSDSQKDELDVIEEIPDTSRANIETKSLIPSLKKIRKSYWDNKENEDFSNITVAEATPIKP

SEQ ID NO: 42112 - DNA, 600 bp, Panicum virgatum
  misc_feature: Ceres CLONE 2010667-R
acacaaaagtcatcaccgagcatcagcaagcacgaatatcacagattcagccagatcagagaatatagagacgccatttgcaaaaggaccaactgaatatcgaagattttgtacaagcacaatgcatattggcgatgaaaataaaatcaaaaatattcctgctagtcacgtgaaaggattgtctgctactggaaatgagagcttggtttgtagagtactgacatatactccaagagaaagtgaatgtaaatctgggagacaaggctgtgaaagtgaaataaaaagtttgaatgagcaaatgaagattaaaagaacgaaattggaagtgcaaatgtcaaaagaattgcaagccattcaaagtaaatatcaagtgaaatttgcagaattattgagagaagaagaacgatattgagatttttgatttttggatgatttttataatgtcgtataatataagagataaacatgtttatattgatttctatgaataccaaaaattaaattttatattataattttataacataattttatgatttctattttaaacattaagaaataagatttttataaaagtttttcaaaaagtctatttacacc

SEQ ID NO: 42113 - DNA, 682 bp, Panicum virgatum
  misc_feature: Ceres CLONE 2010672
  misc_feature: Encodes the peptide sequence at SEQ ID NO. 42114
atcagccaggagaacggcagtgagttacctgaaaaggcttcttgctataaaggagtattctacaattaccttagcattgggatggatgctcaggttgcatatggcttccaccatcttcgtgatgaaaagccgtatcttgcgcaaggaccagttgcaaataagttgatctatgcaggatatagctgcactcaggggtggttctgtacaccttgtacagcaagtcctcagctaagggggcttaagaacattttgcgactttacattaaaaaggccaattgctctgaatgggagcaagttcaaatgccttcaagtgttagatccctagttgtcttaaatttatacaactatggcagtggaaggcatccatggggtgatcttaaaccggaatatcttgaaaagaaaggttttgtagaagctcactcagatgatggcttgcttgaaatatttggactgaaagaaggttggcatgcttcatttgttatggctgagcttattaaggcaaagcacattgcccaggctgcggctataaagttcgaaatgaggggaggcgagtggaatcgagcatatgttcagatggatggggagccatggaaacaaccgcttattcaggaactgtcaacagttctggaaataaacaaagttccttatcactctctcatgatcaatggggatcaatgatttt

SEQ ID NO: 42114 - protein, 225 aa, Panicum virgatum
  misc_feature: Ceres CLONE 2010672
  misc_feature (19)..(196): Pfam Name: DAGK_acc Pfam Description: Diacylglycerol kinase accessory domain
  misc_feature: SWISSPROT Homolog: EC 2.7.1.107 Diacylglycerol kinase
ISQENGSELPEKASCYKGVFYNYLSIGMDAQVAYGFHHLRDEKPYLAQGPVANKLIYAGYSCTQGWFCTPCTASPQLRGLKNILRLYIKKANCSEWEQVQMPSSVRSLVVLNLYNYGSGRHPWGDLKPEYLEKKGFVEAHSDDGLLEIFGLKEGWHASFVMAELIKAKHIAQAAAIKFEMRGGEWNRAYVQMDGEPWKQPLIQELSTVLEINKVPYHSLMINGDQ

SEQ ID NO: 42115 - DNA, 705 bp, Panicum virgatum
  misc_feature: Ceres CLONE 2010677
  misc_feature: Encodes the peptide sequence at SEQ ID NO. 42116
atcatcccccctccctccactagccgaggagtatcccgcggcgaccggacccctcctccccggccgatccacagctcgatcagccagattgggaggaaactagacggcaggcagcatggcggcgaggcggtggtggctggcggcggcgtggtgcgcggtggcggcggtggctgcagcggcgcagtcgtcgccgccgccggcggacccgctgcaggccaagtgctcggcggacttcgggaagctgacggactgcatggactacgcgacggggcacgaggggcagccctcgtcgacgtgctgctccgacgccgccgacacgcagaaggcgcggccgcagtgcctctgctacatcatccagcaggtgcacagcggccggaacgaggtgcagtcgctggggctgcgcttcgaccgcctcatggcgctccccgccgcctgcaagctcaccaacgccaacgtcacgctctgcatcaccctgctgaacctgaagccgggctcgccggactacgccctcttcgccaacgcctccaagatcacgccgtcgactggcggcactccggcgagcgacgccaccgccggcggcggcttcaagcttcagacggggttccgcggcagcgtcgtgctcgccgtgctctccgcggtgctctcgtccgtgttctgaacttctgattcctcgagcaagcagagcagtttttaccctgtgggatt

SEQ ID NO: 42116 - protein, 180 aa, Panicum virgatum
  misc_feature: Ceres CLONE 2010677
  misc_feature (36)..(117): Pfam Name: Tryp_alpha_amyl Pfam Description: Protease inhibitor/seed storage/LTP family
MAARRWWLAAAWCAVAAVAAAAQSSPPPADPLQAKCSADFGKLTDCMDYATGHEGQPSSTCCSDAADTQKARPQCLCYIIQQVHSGRNEVQSLGLRFDRLMALPAACKLTNANVTLCITLLNLKPGSPDYALFANASKITPSTGGTPASDATAGGGFKLQTGFRGSVVLAVLSAVLSSVF

SEQ ID NO: 42117 - DNA, 657 bp, Panicum virgatum
  misc_feature: Ceres CLONE 2010679
  misc_feature: Encodes the peptide sequence at SEQ ID NO. 42118
aactcatcatctggctcagttatcaaaagaaaaagaaaaggtatgagaagtgcagtcctggccatgaaggccctcgtcctgagcgcgctgctcctcacctttgccggggtgatcactcacgcccagcagtgcggcagccaggcgggtggcaagaagtgccctaacaatctgtgctgcagcccgtgggggtactgtggcaccggccccgactactgcggcaacggctgccagagcggcccgtgctcgggctttggcacgctcagcgctgagcagtgcggcaggcaggccgggaacaaaaactgccctaacaacctctgctgcagccagtgggggttctgcggcttaggcggcgactactgcggcaatggatgccagagcggcccgtgctacggtgagctcggcgccgagcagtgcggcaggcaggctggaggtaagaagtgccctaacagtctctgctgcagccgcttcggatactgcggctccggcggcgactactgccgcaacggctgccagagcgggccctgccacaccaccgccggcgccgtgcccaagctcagccgggcctttctggaccaggtgtaaaatatcacgtcgtgccgacgtctgcgtgcagcactcctactctatgaaataaagggtgctgctactacgtatgtg

SEQ ID NO: 42118 - protein, 172 aa, Panicum virgatum
  misc_feature: Ceres CLONE 2010679
  misc_feature (68)..(108): Pfam Name: Chitin_bind_1 Pfam Description: Chitin recognition protein
  misc_feature (20)..(60): Pfam Name: Chitin_bind_1 Pfam Description: Chitin recognition protein
  misc_feature (114)..(154): Pfam Name: Chitin_bind_1 Pfam Description: Chitin recognition protein
  misc_feature: SWISSPROT Homolog: EC 3.2.1.14 Chitinase
MKALVLSALLLTFAGVITHAQQCGSQAGGKKCPNNLCCSPWGYCGTGPDYCGNGCQSGPCSGFGTLSAEQCGRQAGNKNCPNNLCCSQWGFCGLGGDYCGNGCQSGPCYGELGAEQCGRQAGGKKCPNSLCCSRFGYCGSGGDYCRNGCQSGPCHTTAGAVPKLSRAFLDQV

SEQ ID NO: 42119 - DNA, 666 bp, Panicum virgatum
  misc_feature: Ceres CLONE 2010681-R
  misc_feature: Encodes the peptide sequence at SEQ ID NO. 42120
attgatattggtgtgtttgatgccctcaagaggaaatttcaatgtgcaaccctacagctggattttcagctcccccttcgcttcaagctgacttactctgccgaggatgaagccaaacttgaaagacctgtgatgatacacagagcaatcttaggatccgttgaaaggatgtttgccattcttttggagcattacaacggtaaatggcccttgtggctaagccctcgccaggtcattgtttgctcagtatcttctggttcaacggaatatggaaaacaggtccttgccaggctacatgaagctgattttcatgttgacattgacattagtgacagaacaatccaaaagaaggtacttcccagcagcaacagaagcccagggcaggacgggacagcccagcccagcccaccttgttgaggctcaggaggaggcccacccaccttgtttgcttgctgttgctgcagtccgtccatcagcttattaatcatcagaatcagaggtgcttactggataatcgattgtcatctgtgaggtctgaaaatcattgcattcctaggactggcctggtttagatgcaaaatttaaaattccaaaactatcacatacgatgtgtgccgtacatgtatggagtattaaatctagaccaaataaaaaaactaattgcat

SEQ ID NO: 42120 - protein, 138 aa, Panicum virgatum
  misc_feature: Ceres CLONE 2010681-R
  misc_feature: SWISSPROT Homolog: EC 6.1.1.3 Threonine--tRNA ligase
IDIGVFDALKRKFQCATLQLDFQLPLRFKLTYSAEDEAKLERPVMIHRAILGSVERMFAILLEHYNGKWPLWLSPRQVIVCSVSSGSTEYGKQVLARLHEADFHVDIDISDRTIQKKVLPSSNRSPGQDGTAQPSPPC

SEQ ID NO: 42121 - DNA, 1406 bp, Panicum virgatum
  misc_feature: Ceres CLONE 2010681
acttaaaacatacggaccgcttccccggcattccgcgttccgcctccgcctccctcgcccgcgcctgctcctcctccccgttccgccgcctcctctccctcccacctccttgctccgcaccgcctcccatggcctccggcagatctgccgctggccgcctcctcccgccctcccccgctcccttccctcctcggccgtcatccgcgccgcccctccatcctctgcggatctgcaccagctcggccgctgctccgcgtccccagctccgcgcctatagaaccggtccgtgccgtcctcactccccggccgccgcctcccatcccaacacagtgccacccttcctgcacctgcacctcctcgccagacgcctcatgcgcggtgtccctatcctcgatccggagcatccgcggaggacggatccatggaggtactgatggttcctttttcttaaatgaaccatcgctgcccaaaagagagcggagatggaggcgatggcattggcagaaaggtggcagcgaaggcagtggtggtccgggtgctggtggccgctatcctaggctccgccgcgtgactccgccgtcgcgcgccccacggatccgcgatcactacgcgatgactaccgccctgccgcggagtcgctgcggcgaccaacatttcccgtgcccccaccttatctccatcgagccgggccttccctgacgctcttgacggttcccctgcgccgtcgtggtcatgctgtccccaccaccctcgctacaccactgttgccacttgctgccgtcacgccatccacaacgcacccgatggctccctgtgtcaccaagaggctggtgctgatttgggtccgagatgtgccgcatgtcgtgctgaccagccttgggctgctcgatgaccgccagccgcttcagttactttagccttccgaggagatcgcctatcaggtattttctttctcatccaattttcaatccttggtttgaatcctttaaatcctggacaattggagcaaatccaaaattctgacggcgtctattcctgctgcttgaattgatcggcctgctgatggctcaccaccatttggaggatgggatcacgtggtcacccctgcgacgctcgacaacggctgcaaacgtgcaacttgaggcaggtcgcctctatctgtttgccaccacataagtgtcatgccgatggtggggactgtgttcacgcactcccttgagaggatggagcatgttaattgagagagcagcattatcctaacgaagctgtttctcgaagtatgcaagctcacgcttcatgtgctagggaaatttgggttaaccatgtctattgtcaagattgatatagaaggcagtatcatatttatggcaacacattggtgatgttcttgagcagaggccggagac

SEQ ID NO: 42122 - DNA, 720 bp, Panicum virgatum
  misc_feature: Ceres CLONE 2010683
  misc_feature: Encodes the peptide sequence at SEQ ID NO. 42123
acgaacccgtcataattccattgcttaattgcgcctcgcctctcccgcgtatataacctcggccgccggggccgccgggcggaggtgctcattctccccgttccctctcgcgcgcgcgaaggccaaggccggatcgggagggccctctcagatctcgcgcgcttcgccggccgcgcagcaacccagggagtaggagctagggggatcggggcgaggatgtttagcgggacgcagcagaagtgcaagatgtgcaccaagacggtgtacccgatggaccagctctccaccgacggcgtcgtcttccaccgctcctgcttcaagtgccagcactgcaagtccaccctctccctgagcagctattcctcgttcgaaggagtgccatactgcaaggcccatttcgagcagctgttcaaggagacagggagctacaacaagagcttccaatcacaatcacccgcaaagactactccagaaaagtcggcacctgagctgaccagaacaccaagcaaagctgcaaggatgttttcaggaacacaagacaagtgtgcaacttgtggcaaaaccgcatatcctcttgagaaggtaacagttgaagaaaaggcctaccacaagtcctgcttcaaatgctcccatgggggctgtgccatcacaccatccaactatgcagccttggaggggatcctctactgcaggcaccatttctctcaacttttcaaggaa

SEQ ID NO: 42123 - protein, 167 aa, Panicum virgatum
  misc_feature: Ceres CLONE 2010683
  misc_feature (110)..(166): Pfam Name: LIM Pfam Description: LIM domain
  misc_feature (9)..(65): Pfam Name: LIM Pfam Description: LIM domain
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Functional homolog of the protein sequence given in SEQ ID NO 50126
  misc_feature: Useful for making plants with altered carbohydrate content
MFSGTQQKCKMCTKTVYPMDQLSTDGVVFHRSCFKCQHCKSTLSLSSYSSFEGVPYCKAHFEQLFKETGSYNKSFQSQSPAKTTPEKSAPELTRTPSKAARMFSGTQDKCATCGKTAYPLEKVTVEEKAYHKSCFKCSHGGCAITPSNYAALEGILYCRHHFSQLFK

SEQ ID NO: 42124 - DNA, 716 bp, Panicum virgatum
  misc_feature: Ceres CLONE 2010684
  misc_feature: Encodes the peptide sequence at SEQ ID NO. 42125
acgctctcatttctctgcctctcatctctctaccttatcctttggagtgcggggcgcgcgggccgccgctgtggggcgctgctgcgggccacgccggccgccactacggggcaagctggccgccgccgggggtccgggtccggccaagcaggcagcatggcagaggaggcgctgatggacgggctgggcctccgccgcggccacgtcgccctccttctcacgcccagctcgctccacttccccgtcgtctccctcggcgccgtgctctccaccgccaacccgctcctcacgcccggcgagctcgccgaccaggcccgcgactcggagcctttcctcgcgctcacgaccaccgagctcgcccccaagctcggctccctgctgcccgcctcgcgggtcgtcctcgtcgaccagctcctcgccggcctcgacggccacgatgcgtgggcgggcgcgtctggcaccggccgcgacgacccgacgcaggacgccgccgaccgccgctaccgggcgctcgccgggggtccgggtccggccaagcaggaagcatggcggaggaggcgctgatgggcgctcgccaaggccgcgtcctcctcgccaccacaacctggctgctggagctgggactcgtcacggatgagctgcgggagcttccccgccctgccacgccctacccacttttcagctagaacgcagccgtgctctgcaccgcccacggc

SEQ ID NO: 42125 - protein, 135 aa, Panicum virgatum
  misc_feature: Ceres CLONE 2010684
  misc_feature: SWISSPROT Homolog: EC 6.2.1.12 4-coumarate--CoA ligase
MAEEALMDGLGLRRGHVALLLTPSSLHFPVVSLGAVLSTANPLLTPGELADQARDSEPFLALTTTELAPKLGSLLPASRVVLVDQLLAGLDGHDAWAGASGTGRDDPTQDAADRRYRALAGGPGPAKQEAWRRRR

SEQ ID NO: 42126 - DNA, 732 bp, Panicum virgatum
  misc_feature: Ceres CLONE 2010687
  misc_feature: Encodes the peptide sequence at SEQ ID NO. 42127
caataacagcatcaaagttgcacaatgatatcaaagcacacaaagatattgcacattttgaaactgcatatgttgtcaaactacaccgcatagcgacactggcacctccacaacaggtttttactttcacacatccaaatttctcaccaaatgcaagcaatcaaaggtataccaagttgcaatttgaaatgccaccagatatgggatcatgccttgtgcacggatttgctggatattttgactctgttctatataaggatgttcatcttggaattgagccaaacactgctacaccaaacatgtttagctggttcccgatcttcttcccgttgagaaagcccatctacgtgcccgacggatctcctatagaagtgcacttctggcggtgctgtgctcccacaaaggtgtggtacgagtgggctgtgacgacaccgactccgtcacccatccataacagcaatggccggtcatattgggttggtctttaagtcaccaagatcattgtggtcttatattttgtaacagggaaaaaaagatttaggcatactaatatctggagttccgctggtgcctggaggatccttaagagtttcaagcatgtgctgatcaaaggtcaaaggacatcatccggttcaagctggtgcctggaggaacattggaacttgtatctcaaaggggtcgttcggcttccaagttccaacgttgtgtgctcgattttgatagcattattag

SEQ ID NO: 42127 - protein, 161 aa, Panicum virgatum
  misc_feature: Ceres CLONE 2010687
  misc_feature (1)..(143): Pfam Name: PRMT5 Pfam Description: PRMT5 arginine-N-methyltransferase
  misc_feature: SWISSPROT Homolog: EC 2.1.1.125 Histone-arginine N-methyltransferase
ITASKLHNDIKAHKDIAHFETAYVVKLHRIATLAPPQQVFTFTHPNFSPNASNQRYTKLQFEMPPDMGSCLVHGFAGYFDSVLYKDVHLGIEPNTATPNMFSWFPIFFPLRKPIYVPDGSPIEVHFWRCCAPTKVWYEWAVTTPTPSPIHNSNGRSYWVGL

SEQ ID NO: 42128 - DNA, 667 bp, Panicum virgatum
  misc_feature: Ceres CLONE 2010688
  misc_feature: Encodes the peptide sequence at SEQ ID NO. 42129
gaacatggaggagaccctccaccggcgcgtcgtcggccaagacgaggcggtggcggcgatctgccgcgccatccggcgtgcccgtgcaggcctcaacgagccaggccggccgatcgggagcttcgtattggccggcccaaccggcgtcggcaagacggagcttgccaaggccgtggcggccttctactacggctcggaggacgccatagtccggctggacatgagcgagttcatgcaaaggcacacggtgtccagactgatcggctcgcccccaggctacatcgggcaccgcgagggcggccagctgacgaacgccgtgcggcagcggtcgcacacgctgatcctgctggacgagatcgagaaggcgcacccgcgggtgttcgacgtcatgctgcagatcctggacgacggacggctgacggacggcgagggcaggacggtggacttcaggaacacgctcatcgtcatgacgtccaacatcggcggcggcgccgtcgtcgccagcggcgcgggcgccagctacgacgcgatcagggaggtggtaggcgaggagatgaagcggcgcttccggccagagttcctgaaccggctggacgagacgatcgtgttcaggcagctcgccagggccgaggtcaaggagatcgccggcatcttgctgagcagtgtc

SEQ ID NO: 42129 - protein, 221 aa, Panicum virgatum
  misc_feature: Ceres CLONE 2010688
  misc_feature (36)..(200): Pfam Name: AAA_2 Pfam Description: ATPase family associated with various cellular activities (AAA)
  misc_feature: Functional homolog of the protein sequence given in SEQ ID NO 50876
  misc_feature: Useful for making plants with modulated heat sensitivity
NMEETLHRRVVGQDEAVAAICRAIRRARAGLNEPGRPIGSFVLAGPTGVGKTELAKAVAAFYYGSEDAIVRLDMSEFMQRHTVSRLIGSPPGYIGHREGGQLTNAVRQRSHTLILLDEIEKAHPRVFDVMLQILDDGRLTDGEGRTVDFRNTLIVMTSNIGGGAVVASGAGASYDAIREVVGEEMKRRFRPEFLNRLDETIVFRQLARAEVKEIAGILLSS

SEQ ID NO: 42130 - DNA, 1445 bp, Panicum virgatum
  misc_feature: Ceres CLONE 2010692
  misc_feature: Encodes the peptide sequence at SEQ ID NO. 42131
aggcgataaaaatcattcctttggcccctctctgtcatggagtaccatttatctttccgcaacaaaagcaacgtcttctcgctcgctcgtctacgcagggtggagattgaagagtggccattggagcgcgacgtcttagctgagcggtacgcaaatttgacggcgaagatgtctgtgagccatgcggaggacatcgagatatcgctgtgcgatggcaactcggaggacgagcggcggcggcggaagatcggctcgctgcggcggaaggccatccacgcgctcaagaagcgtgggaggcggcgcgtcgacttccgcttcccgccggcggccatctccatcgaggacgtccgcgacgccgaggaggaacgcgccgtcgccgccttccgcgaccgtctcaacgcacacgggctcctccccgacaaacacgacgactaccacatgatgctgaggttcttgaaagccaggaagtttgacgcggagaaggctctgcagatgtgggcggagatgctgaaatggaggaaggacttcggagctgacaccatccttgaggaatttgagtttgaagaactggatcaagtgctgcgctactaccctcagggctaccatggtgtcgaccgtgagggccggccggtgtacattgagaggctcgggaaggtggatccgaacaagctcatgaacatcacctcgacggatcgctatatcaagtatcatgtccaggagtttgagagggccttcagggaaaggttcccagcctgcacattggccgctaagaggcacattgactccaccaccaccatcttggacgtccagggtgtggggcttaagaatttctccaagactgccagggaacttattaaccgtatgcagaagattgacagtgactattatccagagacgctgcatcaaatgttcgtcgtgaatgctggcagtgggttcaaattgatctggaacagtgtgaagggcttccttgacccaaaaacttcatccaagattcatgttcttggttcgaactaccagagtaggcttcttgaagtaatagactcgagtgagttgccagaattcctaggcggttcatgcacatgtagtgacaagggtggttgtcttggatcaaacaaagggccatggaatgatccttatatattgaagctgatacataatttggaggctggatgtgtgagggaaatcaaacctgtttctgagggggaggaaagaagctgctcttcatttcgattggaacagttgaaatggcagggtatgttaagtgatacatcaaatgctgaatcaggatctgacgttgatgattttggtccatcatatgttcagaaagtttctgactatggttgcctgactccagttcatgaggaagtaaaaggtacagactgtgcaacatacttcagctgtgacgatcagagtcatccggacatggctcctgtatcttatagtgg

SEQ ID NO: 42131 - protein, 469 aa, Panicum virgatum
  misc_feature: Ceres CLONE 2010692
  misc_feature (186)..(371): Pfam Name: CRAL_TRIO Pfam Description: CRAL/TRIO domain
  misc_feature (100)..(169): Pfam Name: CRAL_TRIO_N Pfam Description: CRAL/TRIO, N-terminus
MEYHLSFRNKSNVFSLARLRRVEIEEWPLERDVLAERYANLTAKMSVSHAEDIEISLCDGNSEDERRRRKIGSLRRKAIHALKKRGRRRVDFRFPPAAISIEDVRDAEEERAVAAFRDRLNAHGLLPDKHDDYHMMLRFLKARKFDAEKALQMWAEMLKWRKDFGADTILEEFEFEELDQVLRYYPQGYHGVDREGRPVYIERLGKVDPNKLMNITSTDRYIKYHVQEFERAFRERFPACTLAAKRHIDSTTTILDVQGVGLKNFSKTARELINRMQKIDSDYYPETLHQMFVVNAGSGFKLIWNSVKGFLDPKTSSKIHVLGSNYQSRLLEVIDSSELPEFLGGSCTCSDKGGCLGSNKGPWNDPYILKLIHNLEAGCVREIKPVSEGEERSCSSFRLEQLKWQGMLSDTSNAESGSDVDDFGPSYVQKVSDYGCLTPVHEEVKGTDCATYFSCDDQSHPDMAPVSYS

SEQ ID NO: 42132 - DNA, 634 bp, Panicum virgatum
  misc_feature: Ceres CLONE 2010692-R
gacaatctcgagttgttgtgcaaccatcttgccacgaaaccaccgcagatcccagaagataaggaactcgtgctgctgaactcatttgagcggatcaaatctgttgaggctgaccttgagaggaccaaaagagtgttgcatgccacggtggcgaagcaaaaggcattggtggaggctctggaatctgtacaggagtctagaattaggaagaggatgttctgttcataggatatggagtaacaccagatccggaccatttcgtcgacattaaccacctgtgaagctgatgcacgaagctgccagtgccatttttgaccgccgacttcagccgcctcccaagaaaccttcgtaatttgaaagagaagatcgcaacccctgttttcttcctttcattctccattttgtagctggtacttgtactcccgtggccctggtgattggtgaataccgtgccgcgccggaccctccttctttctttttgcttggccatgtcgtcccacggcctagcatccagtgctgagagccgaggtgacggtgagttgccatcgagaactgctgaagttgttgtactgaccccctccctccctggctggagctggaagaaacacattggcgagctttgtatccatgtccg

SEQ ID NO: 42133 - DNA, 660 bp, Panicum virgatum
  misc_feature: Ceres CLONE 2010694
  misc_feature: Encodes the peptide sequence at SEQ ID NO. 42134
acaacaacctgtgacgtcgcagcctcctcttcgcccccaccgaaccgaatcccagccgcagaaaccccccgagcagcagccgcatcgatggcccccaaggcggagaagaagccggcggcgaagaagcccgcggaggaggagcccgcgacggagaaggcggagaaggccccggcggggaagaagcccaaggccgagaagcggctgcccgcgggcaagtccgccggcaaggagggcggcgcgggcaagagggggcggaagaaggggaagaagtcggtggagacctacaagatctacatcttcaaggtgctgaagcaggtgcaccccgacatcggcatctcctccaaggccatgtccatcatgaactccttcatcaacgatatcttcgagaagctcgccggcgaggccgccaagctcgcgcgctacaacaagaagcccaccatcacctcccgcgagatccagacctcggtccgcctcgtcctccccggcgagctcgccaagcacgccgtctccgagggcaccaaggccgtcaccaagttcacctcgtcgtagatgctagtctcccccttctgctccttgtggcttggtgcttttgctagtgatgctagtttgctcgatttggctggtaggatggtgtagttaggtgctggtggttcctggtaa

SEQ ID NO: 42134 - protein, 153 aa, Panicum virgatum
  misc_feature: Ceres CLONE 2010694
  misc_feature (60)..(130): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAAKKPAEEEPATEKAEKAPAGKKPKAEKRLPAGKSAGKEGGAGKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 42135 - DNA, 715 bp, Panicum virgatum
  misc_feature: Ceres CLONE 2010695
  misc_feature: Encodes the peptide sequence at SEQ ID NO. 42136
caaaaaaaaaaaaaaaaaaaatagcttccgccgctagggttttgacctgcagcttcctcgccactccaccacttcaacccctgttcgatcccggccatcggatcgatggcgtcggacgcagcggcggggaaggacaagatgctgacgctgatcagctgcgacaaggagaacttcgaggtggaggagtcggtggcgagggagtcgcggaccatcctgcacatgatcgaggatggctgcaccgacaacggcatcccggtccccaacgtcaactccaagatcctcgccaaggtcatcgagtactgcaagaagcacgtcgaggcgcgccgcggcgccgacgcggacgccgttgagccaactgccgcgaccaacaaggcctccgacgacgagctcaagaccttcgatgctgacttcgtcaaggtggaacaggccaccctcttcgacctcatcctggctgcaaactacctggacatcaaggggctcctggatctgacctgccagaccgttgcggatatgatcaaggggaagactccggaggagatccgcaagaccttcaacatcaagaacgacttcacccctgaggaagaggaggaagtgaggagggagaaccagtgggccttcgaatgaggaggctgaggctctaacgacagcaatctcctataaccaggccagcggggaacgtgttatgccaggaacttaggatgactcggatgttacg

SEQ ID NO: 42136 - protein, 172 aa, Panicum virgatum; identical to SEQ ID NO: 12120
  misc_feature: Ceres CLONE 2010695
  misc_feature (95)..(172): Pfam Name: Skp1 Pfam Description: Skp1 family, dimerisation domain
  misc_feature (11)..(71): Pfam Name: Skp1_POZ Pfam Description: Skp1 family, tetramerisation domain

SEQ ID NO: 42137 - DNA, 1695 bp, Panicum virgatum
  misc_feature: Ceres CLONE 2010714
  misc_feature: Encodes the peptide sequence at SEQ ID NO. 42138
gatggtggaaattttgtgacgaacttgctggatgtgtaatagatagccatggcatcacatgatgaaaagctcgctacccaccagcagattttcggggccggagaatcggcggaaggttcgagaagtttccggttatagcggtgggcggttgctcgccgtcgactgtgacgatggcggtcctcgagaggccgtcgtccgcccccgaggtcgccgtcgcggccctgatcgcgctcgcgtccgtcgccgccgtcgccggcgaggtctacttccaggagaagttcgacgacgggtgggaggaccggtgggtcaagtccgactggaagaaggacgacagcacggccggcgagtggaaccacacgtctggcaaatggaacggagatgcggacgacaaaggtattcagacctctgaagactacaggttctacgccatttcagcacagtaccccgagttcagcaacaaggacaagacactggtgctgcagttctcggtgaagcacgagcagaagctcgactgcgggggtggctatgtgaaattgcttggtggcgatgtcgatcagaagaaatttggtggggacacgccatacagcatcatgtttgggccggatatctgtgggtattccaccaagaaggtccatgctatccttactaagaacggcaagaaccatttgatcaagaaggaggtgccatgtgagaccgatcagctgacacacgtgtatactctgatcatccgtcctgatgccacatacaacattctcattgataatgctgagaagcaatctggcagcatctatgatgattgggatatccttcctccaaagaagatcaaagatcctgaagccaagaagccagaagactgggatgacaaagaatacattccagatcctgaggacaagaagccagagggttatgatgatactcccaaggaaattcctgaccctgatgcaaagaagccagaggattgggatgatgaggaagatggtgaatggacagccccaaccattcctaaccctgagtacaaaggaccatggaagcaaaagaaaatcaagaaccccaactacaagggcaagtggaaggctcccttgattgccaacccagattacaaggatgatccttacatctacgcttttgacagtttgaagcacattggcattgaactgtggcaggttaaatcaggaactctgttcgacaacattctgatcactgatgaccctgagtacgccaagaagtttgcagaggagacctgggccaagcagaaagatgctgagaaagctgcctttgacgaggctgagaaaaagaggcttgaggaggaatctgcgagcactaatgatgagaacgatgcagatgaggatgaggatgacacggacgatgacaatgctgacacagccgctgaggaggccaaggactctgctgatgagaaatcggaggacggcaaggtcgctgctgatgagaagccggaggagggcagcaaggatgcttctgctgaggagaagaaacatgacgagctctagggagtgcagatgaagagcaagagaggctgacaagttttctgttccggttttagcccgagttaaactgttattggtaaggtggttaccctccgaattgaatagaaagtcatgcgtctcgacatggcgagtagtccgaccctgtacaacactactgaatgaaacaaacaaattcggcaattgccatttt

SEQ ID NO: 42138 - protein, 445 aa, Panicum virgatum
  misc_feature: Ceres CLONE 2010714
  misc_feature (31)..(343): Pfam Name: Calreticulin Pfam Description: Calreticulin family
MAVLERPSSAPEVAVAALIALASVAAVAGEVYFQEKFDDGWEDRWVKSDWKKDDSTAGEWNHTSGKWNGDADDKGIQTSEDYRFYAISAQYPEFSNKDKTLVLQFSVKHEQKLDCGGGYVKLLGGDVDQKKFGGDTPYSIMFGPDICGYSTKKVHAILTKNGKNHLIKKEVPCETDQLTHVYTLIIRPDATYNILIDNAEKQSGSIYDDWDILPPKKIKDPEAKKPEDWDDKEYIPDPEDKKPEGYDDTPKEIPDPDAKKPEDWDDEEDGEWTAPTIPNPEYKGPWKQKKIKNPNYKGKWKAPLIANPDYKDDPYIYAFDSLKHIGIELWQVKSGTLFDNILITDDPEYAKKFAEETWAKQKDAEKAAFDEAEKKRLEEESASTNDENDADEDEDDTDDDNADTAAEEAKDSADEKSEDGKVAADEKPEEGSKDASAEEKKHDEL

SEQ ID NO: 42139 - DNA, 640 bp, Panicum virgatum
  misc_feature: Ceres CLONE 2010732
  misc_feature: Encodes the peptide sequence at SEQ ID NO. 42140
acatgccgcggccgcctccctcagatcctccgtcctcgctcggtcaagtgccgccgctacccccctccgtcactcttctcccgtggccaccacccaccgcatccgccgctctccaccggctggtttggtttgtctctgaaaggcggcggcggagatgtcggaaaagaagcgcggcggcggcggcacccgcaaggacgaggtggtgacccgcgagtacaccattaacctccacaagcgcctccacggatgcaccttcaagaagaaagcaccaaatgccatcaaagagatcaggaagtttgcacagaaggctatgggaaccactgatgtccgaattgatgtgaagctcaacaagcacatctggagcagtggtatccggagcgttccaaggcgagttcgcgtcagaatcgcccggaagaggaatgatgaggaagatgccaaggaggagctctactctctggtcacagttgctgagatccctgcagagggtctcaaaggtttgggtactaaggttgttgaggatgaggattaagccctcccatggattgaatctgctagcacttagtgcatatcatgagagcaagtttgagaatgttaccttagcttattgttatctaccgttgatgacttatgtaatagaaga

SEQ ID NO: 42140 - protein, 124 aa, Panicum virgatum; identical to SEQ ID NO: 12126
  misc_feature: Ceres CLONE 2010732
  misc_feature (12)..(106): Pfam Name: Ribosomal_L31e Pfam Description: Ribosomal protein L31e

SEQ ID NO: 42141 - DNA, 646 bp, Panicum virgatum
  misc_feature: Ceres CLONE 2010737
  misc_feature: Encodes the peptide sequence at SEQ ID NO. 42142
ctcctccattccatcgccgcagccgcagtcaagtgccgctgccagtgagtgagctcgctctcctgttcattgcaaggttggtattgtcttggcgctagctgttgggcgaaagggatggagcaggcaaagggggatgcgaccgcgaggagggcggagctccagctgctgcagcagctggagaaggaggagagcaaggggaagaggaagcgcggccgggtggagctgcggcggatcgaggaccggaccagccggcaggtgcgcttctccaagcggcggagcgggctgttcaacaaggcctacgagctctccgtgctctgcgacgcccgggtcgggctcatcgtcttctcccccgccggccgcctctaccagttcgcctcctctggctccagcattgaagaaatttttggtcgatactgggacctcgccaacacaataaatggtctcaatattgaagcacgagattcaacggttcactgcaacacacaggggcatggaagcaaatgcggaggagatgagcatgactgagataagaaacttggaggaaacagtaacctacgctctggccgctattaggaataagctgaggatgaaggtggttgggttgcccccaacctaagattaggtctggaactagtttttgctgcag

SEQ ID NO: 42142 - protein, 136 aa, Panicum virgatum
  misc_feature: Ceres CLONE 2010737
  misc_feature (38)..(88): Pfam Name: SRF-TF Pfam Description: SRF-type transcription factor (DNA-binding and dimerisation domain)
  misc_feature: The sequence is a functional homolog of SEQ ID NO 919 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: Functional homolog of the protein sequence given in SEQ ID NO 50571
  misc_feature: Useful for making plants with modulated flowering time
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 707 in the 10/666,642 US patent application
  misc_feature: Functional homolog of the protein sequence given in SEQ ID NO 50970
  misc_feature: Useful for making plants with altered alkaloid content
  misc_feature: Useful for making plants with altered terpenoid content
  misc_feature: Functional homolog of the protein sequence given in SEQ ID NO 51642
  misc_feature: Useful for biocontainment applications
  misc_feature: The sequence is a functional homolog of SEQ ID NO 2197 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: Functional homolog of the protein sequence given in SEQ ID NO 51040
  misc_feature: Useful for making plants with modulated biomass
  misc_feature: The sequence is a functional homolog of SEQ ID NO 729 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 32 in the 10/666,642 US patent application
  misc_feature: The sequence is a functional homolog of SEQ ID NO 2195 in the 10/666,642 US patent application
  misc_feature: The sequence is a functional homolog of SEQ ID NO 2189 in the 10/666,642 US patent application
  misc_feature: The sequence is a functional homolog of SEQ ID NO 1701 in the 10/412,699 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 730 in the 10/666,642 US patent application
  misc_feature: The sequence is a functional homolog of SEQ ID NO 4 in US patent 7057087
  misc_feature: The sequence is a functional homolog of SEQ ID NO 30 in the 10/666,642 US patent application
  misc_feature: Functional homolog of the protein sequence given in SEQ ID NO 51058
  misc_feature: Useful for making plants with altered lignin content
  misc_feature: The sequence is a functional homolog of SEQ ID NO 1971 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 28 in the 10/666,642 US patent application
  misc_feature: The sequence is a functional homolog of SEQ ID NO 46 in the 10/666,642 US patent application
  misc_feature: The sequence is a functional homolog of SEQ ID NO 2199 in the 10/666,642 US patent application
  misc_feature: The sequence is a functional homolog of SEQ ID NO 14 in the 10/666,642 US patent application
  misc_feature: The sequence is a functional homolog of SEQ ID NO 6 in US patent 7279615
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: Functional homolog of the protein sequence given in SEQ ID NO 50968
  misc_feature: Useful for making plants with modulated phosphate use efficiency
  misc_feature: The sequence is a functional homolog of SEQ ID NO 2 in US patent 7273968
  misc_feature: The sequence is a functional homolog of SEQ ID NO 2191 in the 10/666,642 US patent application
  misc_feature: The sequence is a functional homolog of SEQ ID NO 2193 in the 10/666,642 US patent application
  misc_feature: The sequence is a functional homolog of SEQ ID NO 42 in the 10/666,642 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1454 in the 10/374,780 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 1453 in the 10/374,780 US patent application
  misc_feature: The sequence is a functional homolog of SEQ ID NO 2 in US patent 7049489
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: The sequence is a functional homolog of SEQ ID NO 1965 in the 10/412,699 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 1963 in the 10/412,699 US patent application
  misc_feature: Functional homolog of the protein sequence given in SEQ ID NO 51059
  misc_feature: Useful for making plants with modulated nitrogen use efficiency
  misc_feature: The sequence is a functional homolog of SEQ ID NO 1967 in the 10/412,699 US patent application
MEQAKGDATARRAELQLLQQLEKEESKGKRKRGRVELRRIEDRTSRQVRFSKRRSGLFNKAYELSVLCDARVGLIVFSPAGRLYQFASSGSSIEEIFGRYWDLANTINGLNIEARDSTVHCNTQGHGSKCGGDEHD

SEQ ID NO: 42143 - DNA, 671 bp, Panicum virgatum
  misc_feature: Ceres CLONE 2010742
  misc_feature: Encodes the peptide sequence at SEQ ID NO. 42144
ctatgtcatccatggattcgtgatcatggagtagctcctgatcgtccacttgatccagctgtcttatctcgcattaaacaattctctgcaatgaataaattgaagaaaatggctttacgagttatagctgagagcctctcagaggaggaaattgctgggttgaaggaaatgttccagaccatggacactgataacagcggtgcaattacatatgataagctaaaagaaggattgagaaaatatggctccacactaaaggatactgaaattcgtgatcttatggatgcggctgatatcgacaacagcggaacaattgactatatagaattcattgctgcgacgttgcatctcaataagctggaacgtgaggaacatcttgtggcagccttttcatatttcgacaaagatggtagtggctacatcacagtggatgaactgcagcaagcttgcaaagagcataacatgccagatgcttttcttgatgatgtcattaacgaagcagatcaggacaatgatggccgcattgactatggagagtttgttgccatgatgaccaagggcaatatgggagtcggtcgaagaacaatgaggaacagcctgaatatcagcatgagggacgcacctggtgcattctagagacttaacacgatgtacagcttgtggcttagctc

SEQ ID NO: 42144 - protein, 211 aa, Panicum virgatum
  misc_feature: Ceres CLONE 2010742
  misc_feature (159)..(187): Pfam Name: efhand Pfam Description: EF hand
  misc_feature (125)..(153): Pfam Name: efhand Pfam Description: EF hand
  misc_feature (53)..(81): Pfam Name: efhand Pfam Description: EF hand
  misc_feature (89)..(117): Pfam Name: efhand Pfam Description: EF hand
  misc_feature: SWISSPROT Homolog: EC 2.7.11.1 Non-specific serine/threonine protein kinase
LCHPWIRDHGVAPDRPLDPAVLSRIKQFSAMNKLKKMALRVIAESLSEEEIAGLKEMFQTMDTDNSGAITYDKLKEGLRKYGSTLKDTEIRDLMDAADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 42145 - DNA, 578 bp, Panicum virgatum
  misc_feature: Ceres CLONE 2010758
  misc_feature: Encodes the peptide sequence at SEQ ID NO. 42146
gcaattctcatcgcaggcaatcgcagcctccaagtccaatggcgcctccccctcctcctcctcacctgctcccgcgctcttccagcttctgcagcagcgccgccacccccgcgtcccaacacaagggcagccacaggtcctacgcgaccatcccaaacgccgccgccgccactccggccgccgcggcgcagctctcgctgctccgcgcccacgcgcgcgccggccggatgcggcccgcgcgggaggtgttcgactcaatgccagcgccgggacggtcgctcgtcgcctggaccgcgctcatgtcggggtacgccacccacggcccggccgccgaggcgctcgagctgctcctctgcatgctcggcctgctcctcaggccagacgccttcgtcttctccgtcgcgctgcgcgcatgcgccgccgtcggtagcctccgcctcggcaggcagctgcacggcgccgtcgccaagctgggcttcgtgggtgcggacctcttcgtcgccaacggcctcgtcaccatgtactcgagctgccagtccctccgttgcgccgagaaggtgttcggcggcatcgacgcg

SEQ ID NO: 42146 - protein, 179 aa, Panicum virgatum
  misc_feature: Ceres CLONE 2010758
  misc_feature (82)..(116): Pfam Name: PPR Pfam Description: PPR repeat
MAPPPPPPHLLPRSSSFCSSAATPASQHKGSHRSYATIPNAAAATPAAAAQLSLLRAHARAGRMRPAREVFDSMPAPGRSLVAWTALMSGYATHGPAAEALELLLCMLGLLLRPDAFVFSVALRACAAVGSLRLGRQLHGAVAKLGFVGADLFVANGLVTMYSSCQSLRCAEKVFGGID

SEQ ID NO: 42147 - DNA, 599 bp, Panicum virgatum
  misc_feature: Ceres CLONE 2010766
  misc_feature: Encodes the peptide sequence at SEQ ID NO. 42148
aagccagaaagattgtctaatcccgtttgcgtcgcgtcccaccaaacatcaaaaccgaattccctccaaatccacccacaccctccgaaatggacgccggcgacccgagaggtgaagaaggcggcggcgggccgcatgctcggcaggccgaagaagaaaccagtgtcgcgctccatcaaggctgggctccaattccccgtcggccgcatcgggcgctacctcaagaagggccagtacgcgcagcgcgtgggctcgggtgcccccgtctacctcgccgccgtcctcgagtacctcgacgccgaggtcctggagctggcgggcaacgcggcgcgcgacaacaagaagaatcggatcatcccgcgccaggacatcctcgccatccgcaacgacgaggagctgggcaagctgctggtcggtgtcaccatcgggcacggaggcgtcctccccaacatctcactcagtgctcctctccaagaaggccgccgagaaggctgagaaggcggccaagtcgaacaagatggccgccgccaaatccaccaagaagtacgctgcacctgatcatgctcgcgctgatctctaatcggatccgatcctagcag

SEQ ID NO: 42148 - protein, 164 aa, Panicum virgatum
  misc_feature: Ceres CLONE 2010766
  misc_feature (57)..(130): Pfam Name: Histone Pfam Description: Core histone H2A/H2B/H3/H4
KPERLSNPVCVASHQTSKPNSLQIHPHPPKWTPATREVKKAAAGRMLGRPKKKPVSRSIKAGLQFPVGRIGRYLKKGQYAQRVGSGAPVYLAAVLEYLDAEVLELAGNAARDNKKNRIIPRQDILAIRNDEELGKLLVGVTIGHGGVLPNISLSAPLQEGRREG

SEQ ID NO: 42149 - DNA, 755 bp, Panicum virgatum
  misc_feature: Ceres CLONE 2010786
  misc_feature: Encodes the peptide sequence at SEQ ID NO. 42150
gaaaaccttgctctggtcctcgtcccgccgccgccgccgccgcctgcaccacccgccgcccagcagcagccgtcgccggagaagaaggggagggagccatgggtcgcgtccgcaccaagaccgtgaagaagacctccaggcaggtgatcgagaagtactactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccacgtcgacaaggagaccatggagatgctcgcttccctcggcatggccgacctcccgggcgtcgagcgccaagctgaggtctccagcgcccctacctacggtcgcccgcagtacggtggcccccgccgcgaccgcgtctaggcttctagccggttgcagtggttggatcttgatcgcttcacttatcgttgttattgtgctactatgtcaaacttattttaggtcagtggttgctttgtggcgattgagtcttgaacctatctgttttgctataaattctgcactgtttttatctgcgtgtgatggacaagatctatattctcgcgcgaatggaatcaaatgcgatttataagttacgatgagattgct

SEQ ID NO: 42150 - protein, 142 aa, Panicum virgatum
  misc_feature: Ceres CLONE 2010786
  misc_feature (1)..(122): Pfam Name: Ribosomal_S17e Pfam Description: Ribosomal S17
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIHVDKETMEMLASLGMADLPGVERQAEVSSAPTYGRPQYGGPRRDRV

SEQ ID NO: 42151 - DNA, 667 bp, Panicum virgatum
  misc_feature: Ceres CLONE 2010792
  misc_feature: Encodes the peptide sequence at SEQ ID NO. 42152
aaaaccctagccccgagcagccgcagcggccagcacttcacgtcccctgccgcccccgccgccggaggaggtcgagatgcgggtctacatgcactgcgaggggtgcgccaggaaggtcaagaagatcctcaggcgcttcgacggagtggaggacgtgattgctgactcaaaggcacacaaggtggtggtgaaggggaagaaggcagccgccgaccccatgaaagtggtggcgcgtgtccagaagaagaccggacgcaaggtggagcttctctcgccgatcccgcctccgccggaggagaagaaggaagaggagaagaaggaggagccggagccacccaagctggaggaaaagaaggagccgcccctgctcgccgttgtactgaaggtacatatgcactgcgaagcctgcgctgaggggctcaggaagaggatcctcaagatgaaaggggtgcaatctgcagagccagacctgaaggcatcggaggtgacagtgaagggtgtgttcggggaggccaagctggccgagtacgtgtacaagcgcaccggtaagcatgctgccatcatcaagtctgagcctgtggctccgccggagagcgcagggggtgacagcaaggccaaggaggagaagaaggcagaaggtggcagcgaggagaagaaggacgacggc

SEQ ID NO: 42152 - protein, 196 aa, Panicum virgatum
  misc_feature: Ceres CLONE 2010792
  misc_feature (100)..(162): Pfam Name: HMA Pfam Description: Heavy-metal-associated domain
  misc_feature (1)..(64): Pfam Name: HMA Pfam Description: Heavy-metal-associated domain
MRVYMHCEGCARKVKKILRRFDGVEDVIADSKAHKVVVKGKKAAADPMKVVARVQKKTGRKVELLSPIPPPPEEKKEEEKKEEPEPPKLEEKKEPPLLAVVLKVHMHCEACAEGLRKRILKMKGVQSAEPDLKASEVTVKGVFGEAKLAEYVYKRTGKHAAIIKSEPVAPPESAGGDSKAKEEKKAEGGSEEKKDD

SEQ ID NO: 42153 - DNA, 685 bp, Panicum virgatum
  misc_feature: Ceres CLONE 2010811
  misc_feature: Encodes the peptide sequence at SEQ ID NO. 42154
ggacgctctatataaaccctccctctctgctcccatccatcccattcctatcccttgctacctgcatccatcgaccttagcgagctcacagttcaatcaggtccggttcggcttcaggccgggctcgtcaccgaggagatggctctctctcgccgcatggccgcgccggtcctcgtcttcctgctcctcctcgtcgccacagcagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcctctcgtctcttgttctctttacctggaataaattaaactcggtgctggtgtctggtgatgcctgtgcgtgtggaacatctcactgttgttctgcacccgtatgcactccattattagtgtagtaggcaagatgatgtaaggtcctcctttcaacattgatgtaataatgtgatgcagtttcgtgctagttcag

SEQ ID NO: 42154 - protein, 81 aa, Panicum virgatum; identical to SEQ ID NO: 14095
  misc_feature: Ceres CLONE 2010811
  misc_feature (33)..(81): Pfam Name: Gamma-thionin Pfam Description: Gamma-thionin family

SEQ ID NO: 42155 - DNA, 1841 bp, Panicum virgatum
  misc_feature: Ceres CLONE 2010816
  misc_feature: Encodes the peptide sequence at SEQ ID NO. 42156
gtcttgcctcgctgctcgcctagccgcgtgcgtgcgactgtgagccgtgaggagcgccgcccctcttctcgtcccggccgctgcactcgcaggtgccggtatcgcatatcttcccgtcaccttcgccgccgcctgctgccctgcctccgcctccgccgtcaaaccctaagtgggccgtcgacttcacccgcgaggtgctaccaattttgaaagatggtggatgacgaacaggcaccaagttctaggaagagggttgctggtacccaaatcaacaaggataatcctgagcctgatgatgacggaccagagcaagagatgggtacatttaagaaagctcccgaggaagtgatggcaacccgaagaattgtaaaggttcggtgccagcagccgtcctcagctccttcttctaatcctttctctgcaatcagatttacccccacggattctagtgttcaagcaagtgcccctgtcacagaacctcaaccttcagaagtcaaagctgatgagggcagcaatggtaatgctaaagaaactttgcctatgtcggacaagaatgctagctctggtgaggtaactgagattcagaaggaagaatcagctgtgaaaactgaatctggtgccacaactgaagcgccgcctcaacctgttgaaaccagtgacaaggcagaatctggtggagacaaagtagtagttggagaacccaaggaaggtgacagtacgccatctgaagttgagggcaaaacgaaggacggagatgctgaagaaaagaaaggggcagatgaagctggaaatgaagataaaatcagtaaggatgatactgagaaaaaagatggaggtgaatcagagaccaaggatgggttatctgatgagcagaaagatgctgatagcaaagggcagtcctcatcatcagcacctcttttctcctttaagaatctgtcaagtggtcaaaatgccttcacaggtctggctggaactggattttcaagcacatcattctcatttggctcggcatctaaagatggatcaagtgctggtcctctatttgggctgaagcctgatggttcttcagtcccttcttttaaccttggtgctaccaacaatggtggttcctccacagtgcgcgctacttcaggagaggcacccaagaaatttgctatgacagaggatcctgttgaaactggtgaagaaaacgagaaggctgtatttactgctgactctgctttgtatgagtatttagatgggggctggaaagaacggggaaaaggtgaactgaagctgaacgtctctgtatctggtgatgagagagcccggctcgtcatgaggaccaagggaaattaccggctggtcctgaacgcgagcctctacgacgacatgtcgctcaaggacatggacaagaagggagtgactttcgcctgcatgaacagcatcggcgagtcgcagactggcctcgcgacgtttgctctgaagttcaaggacaccgccatgagggaggagttcaagggcgcggtggaggctcacaaagtgaggaaggcacctgacacaacgctgaacacgcccgagaactccccaaaggcagccgaggtctgaagcctgccaatcatgcttacgcattcttagtaaccagttcaggaaaaaaggagctgagagatactgtctgttatttgcggagttttaagcaagatgtcgtcctgagttgtattcttagtaaccgtacgagtctttttcaaaagagtaaccgtatgagttttacggatacggtttcctgatgttgttttttgggggaacagtgggtatcctggcgaagcttattaaagtcataatcttggtatagcctggggatg

SEQ ID NO: 42156 - protein, 457 aa, Panicum virgatum
  misc_feature: Ceres CLONE 2010816
  misc_feature (10)..(289): Pfam Name: NUP50 Pfam Description: NUP50 (Nucleoporin 50 kDa)
  misc_feature (319)..(438): Pfam Name: Ran_BP1 Pfam Description: RanBP1 domain
  misc_feature: SWISSPROT Homolog: EC 3.4.21.72 IgA-specific serine endopeptidase
MVDDEQAPSSRKRVAGTQINKDNPEPDDDGPEQEMGTFKKAPEEVMATRRIVKVRCQQPSSAPSSNPFSAIRFTPTDSSVQASAPVTEPQPSEVKADEGSNGNAKETLPMSDKNASSGEVTEIQKEESAVKTESGATTEAPPQPVETSDKAESGGDKVVVGEPKEGDSTPSEVEGKTKDGDAEEKKGADEAGNEDKISKDDTEKKDGGESETKDGLSDEQKDADSKGQSSSSAPLFSFKNLSSGQNAFTGLAGTGFSSTSFSFGSASKDGSSAGPLFGLKPDGSSVPSFNLGATNNGGSSTVRATSGEAPKKFAMTEDPVETGEENEKAVFTADSALYEYLDGGWKERGKGELKLNVSVSGDERARLVMRTKGNYRLVLNASLYDDMSLKDMDKKGVTFACMNSIGESQTGLATFALKFKDTAMREEFKGAVEAHKVRKAPDTTLNTPENSPKAAEV

SEQ ID NO: 42157 - DNA, 778 bp, Panicum virgatum
  misc_feature: Ceres CLONE 2010817
  misc_feature: Encodes the peptide sequence at SEQ ID NO. 42158
aaaccacccaaaaaacattgtcgaatcccgtttccctcgcttccccccaaacccaaaaccgaattccctccaaatccacccacaccctccgaaatggacgccggcgccccgaaggtgaagaaggcggcggcgggccgcaagctcggcgggccgaagaagaagccggtgtcgcgctccgtcaaggctgggctccagttccccgtcggccgcatcgggcgctacctcaagaagggccggtacgcgcagcgcgtgggcacgggcgcccccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaggaaggccgccgagaaggcggagaaggcggccaagtcgcccaagaaggccgccgccaaatcccccaagaagtaggctgctcctggtcatgcgcgcgctgatctctcatcggatccgatcctagcagtcttgcttcctctgtgttgcttgcttttgtgtgtatgtagtgccgcatctctatgtaccgtgccctccgtgcttcggatcctaagtcgtaggtctaggtctagctgtagttgttggtgatggggttatctatgttaccaaaattaaatgaaaaggaagggatcggtttacttttgtg

SEQ ID NO: 42158 - protein, 151 aa, Panicum virgatum
  misc_feature: Ceres CLONE 2010817
  misc_feature (27)..(100): Pfam Name: Histone Pfam Description: Core histone H2A/H2B/H3/H4
MDAGAPKVKKAAAGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPRKAAEKAEKAAKSPKKAAAKSPKK

SEQ ID NO: 42159 - DNA, 285 bp, Panicum virgatum
  misc_feature: Ceres CLONE 2010820
  misc_feature: Encodes the peptide sequence at SEQ ID NO. 42160
gtctctctagcctctcctctttctgtccccccaggcgcgcggagcacgagcccttggtagatcccgatggcctcgcgacggcgcacgctcctccaggtcatcatcctcggcgacagcgcggacgggaagacttcgctgatgaaccactatgagaacagaaagttcagcgatcacaacaaggcttcgaacggcgccgacttcctcacgaaggagatgcagttcgaggacaggctcttcacacttctgatatgggatgctgctggacaggaaaagatccacactctc

SEQ ID NO: 42160 - protein, 72 aa, Panicum virgatum
  misc_feature: Ceres CLONE 2010820
  misc_feature: Functional homolog of the protein sequence given in SEQ ID NO 50193
  misc_feature: Useful for making plants with modulated water use efficiency
MASRRRTLLQVIILGDSADGKTSLMNHYENRKFSDHNKASNGADFLTKEMQFEDRLFTLLIWDAAGQEKIHT

SEQ ID NO: 42161 - DNA, 291 bp, Panicum virgatum
  misc_feature: Ceres CLONE 2010821
  misc_feature: Encodes the peptide sequence at SEQ ID NO. 42162
atccactctcctcgtctctcctgtgacctcacgggtcactagaggccactgggcgcggttaccatcgccgagctgtgcagcagcagcaatggagtcgcctatgctctatgtctcacccctcctcaagttggcgcggtccgcatggtgcgtcctcctcctcgccccgtcggcgaaggtgtctgggctccaccactccgccgcggcggcatccagaaccgggaagaccatgtaccttccggctatctgccgggcgcagacggcatcgctagaggacttcggcgcctcgggcga

SEQ ID NO: 42162 - protein, 67 aa, Panicum virgatum
  misc_feature: Ceres CLONE 2010821
  misc_feature: Functional homolog of the protein sequence given in SEQ ID NO 51107
  misc_feature: Useful for making plants with altered carbohydrate content
MESPMLYVSPLLKLARSAWCVLLLAPSAKVSGLHHSAAAASRTGKTMYLPAICRAQTASLEDFGASG

SEQ ID NO: 42163 - DNA, 577 bp, Panicum virgatum
  misc_feature: Ceres CLONE 2010826
  misc_feature: Encodes the peptide sequence at SEQ ID NO. 42164
taaaacagacttcccaaaggcagaacgcagctcgcggcggcttccttcttccaaacccctcgcttccccgcgtgctcgccccgagatcccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtcgcggcgcggacggcgatcgggttcgtcgtcatgggcttcgtcggcttcttcgtcaagctcatcttcatccccatcaacaacatcatcgtcggttccggctagacctcgagtcctggagaagtgcagaacgagtgactagcatgggtggattgcaatacttttgaggagagcaaaggctaacgatgatcttggtctttcacaaagtattgtaaaagacagtttctcatttgtgtttttggagtaatcctcatactgtttaagacttcaggatgcctgcataccagattctgagttgatcgatcggttatagaagggtacggtggactgctttctttttagataggcag

SEQ ID NO: 42164 - protein, 69 aa, Panicum virgatum; identical to SEQ ID NO: 12598
  misc_feature: Ceres CLONE 2010826
  misc_feature (10)..(66): Pfam Name: SecE Pfam Description: SecE/Sec61-gamma subunits of protein translocation complex

SEQ ID NO: 42165 - DNA, 724 bp, Panicum virgatum
  misc_feature: Ceres CLONE 2010830
  misc_feature: Encodes the peptide sequence at SEQ ID NO. 42166
aaccacaaggacctcagcccaaagctagccccaaacccatctccgatccccaaacccagccgatccgccagggagaaaggtaaagcagcaagcaatgtcgtcaggcgggcagcggtccatggcgtcggccctcctgttcctgaacctcatcatgtacgtcgtcgtcgcggccatcgccggctgggccatcaactacagcatcgacgagagcaggaactcactgcagggcgtgtccccgccggtgcgcctgttcccgatctacttcccgatcggcaacctggcgacggggttcttcgtcgtcttcgcgctcctcgcgggcgtcgtcggcatctccacctccatcaccgggctgcacgacgtcggccaggggctcccggccaacatgatgtccgccgccgccgccgcgctcgtcacctggaccctcaccctcctcgccatggggctggcctgcaaggagatcaccgtcagctggaggcccgcgagcctgcgcaccttggaggcgttcaccatcatcctggccgggacgcagctactctgcgccgggtcgctccacgccggcgcgcacgcggccatcctcgcgacccccgtcggcggcagggtctgatggcgtgatcgactgaggcggcggcggcgacggacatgtatacgagagaacgtgtcatcttgggcagtggtcggcggtctacgcgagcgcgagtgatcgatgtgtgtggccggtgggtgc

SEQ ID NO: 42166 - protein, 169 aa, Panicum virgatum
  misc_feature: Ceres CLONE 2010830
  misc_feature (15)..(156): Pfam Name: AWPM-19 Pfam Description: AWPM-19-like family
MSSGGQRSMASALLFLNLIMYVVVAAIAGWAINYSIDESRNSLQGVSPPVRLFPIYFPIGNLATGFFVVFALLAGVVGISTSITGLHDVGQGLPANMMSAAAAALVTWTLTLLAMGLACKEITVSWRPASLRTLEAFTIILAGTQLLCAGSLHAGAHAAILATPVGGRV

SEQ ID NO: 42167 - DNA, 661 bp, Panicum virgatum
  misc_feature: Ceres CLONE 2010840
  misc_feature: Encodes the peptide sequence at SEQ ID NO. 42168
aatttcaaaacgtgaagctctccttcacgtcgtctccgcgtccggcacccacccaacgacgcggaggagaatcaccgccggccgccccggccggcgatcccttcttccccgcttcccgccggcggcatactccggcagcaatggcgttcgatctcgctgtcgcgggctcggcggcccgcaaggccgaggtccaaaccctagcgcccgtgctgctcatgggccctcctcctacgccaccgatcccgccgacgccggggatgtacctcccgggcccccctcctccgggggtgctcctgccgcggccgatcccttttccgctcactctcgaggtcatcgcgcacatggacgagtgccggagccgctccctcctcaagttcatttccgacgcggggattgtgccttcgcccgacgacgagcagaggaggaagcgggtggtacgcgaactcggcaagatagtgatggattgggcaaagagggtggcgtacgagcaggggaaacagccttggatcacatcagccgcggtgttgacctttggctcctatgccttgggggcatatggacctgaatctgatattgatattctctgtgtcggtccctatattgcatcactgccacatcatttttttgttgtcctccgacacatggcttgaggggaggtcag

SEQ ID NO: 42168 - protein, 169 aa, Panicum virgatum
  misc_feature: Ceres CLONE 2010840
  misc_feature: SWISSPROT Homolog: EC 2.7.7.19 Polynucleotide adenylyltransferase
MAFDLAVAGSAARKAEVQTLAPVLLMGPPPTPPIPPTPGMYLPGPPPPGVLLPRPIPFPLTLEVIAHMDECRSRSLLKFISDAGIVPSPDDEQRRKRVVRELGKIVMDWAKRVAYEQGKQPWITSAAVLTFGSYALGAYGPESDIDILCVGPYIASLPHHFFVVLRHMA

SEQ ID NO: 42169 - DNA, 670 bp, Panicum virgatum
  misc_feature: Ceres CLONE 2010857
  misc_feature: Encodes the peptide sequence at SEQ ID NO. 42170
gcctcgcgacgtaacaagtgtccttcctctgtcttcctcctcgtctctctctcatccactctgctccctcccccaacgccaccctcgccactgcggagcttcggcggttcggctcgagcagaagaaaatgcaacgggcagtgcaagccatcaggtcacatggcagtgtgttcaaatatgctgttctacaacacatcagcgctcccaaaccagccatgcttcctgtcgccttttctcgcttcatgtcagtttcatctgctcgcatagaggatagtggatttgaaactgccactgtagcagatgtcttgaagtctaaagggaagagtgctgatggatcctggctctggtgcaccacggaggacagtgtatatgatgctgtcaaatcgatgactcagcacaacgtgggagctttggtggtggtcaaacctggacaggagaaagcaattgctggcattgtcactgagagagattatctccggaaaatcatagtgcaaggacgatcttccaagtcaactaaggttggagatatcatgactgaagagaacaagctgatcacggtgaagcctgacaccaaggtcctgcaagcaatgcagctgatgacagagaaccgcatcagacacatcccggtgattgaaggcgcggggatgttggggatggtctccattggcgac

SEQ ID NO: 42170 - protein, 180 aa, Panicum virgatum
  misc_feature: Ceres CLONE 2010857
  misc_feature (65)..(180): Pfam Name: CBS Pfam Description: CBS domain pair
  misc_feature: SWISSPROT Homolog: EC 1.1.1.205 IMP dehydrogenase
MQRAVQAIRSHGSVFKYAVLQHISAPKPAMLPVAFSRFMSVSSARIEDSGFETATVADVLKSKGKSADGSWLWCTTEDSVYDAVKSMTQHNVGALVVVKPGQEKAIAGIVTERDYLRKIIVQGRSSKSTKVGDIMTEENKLITVKPDTKVLQAMQLMTENRIRHIPVIEGAGMLGMVSIG

SEQ ID NO: 42171 - DNA, 703 bp, Panicum virgatum
  misc_feature: Ceres CLONE 2010870
  misc_feature: Encodes the peptide sequence at SEQ ID NO. 42172
ccactccgtccatccatccgccatggcgacggccacgctgctgagctcctccttcgccatgcccgccgccgcccggagggcctcctcctcttcctccacctccctgggcttcgccacgtcgcagctcgccggcctctccctctccgccgccgcgcccacttcaaccgccgcggcccccctccacaagaggccgctccagcccatcgtcgcgcgccgggtgtgccccttcactgacaagaagacgaaccgggcgaacaaggtgtccttctccaaccacaagacgaagaagcagcagttcgtgaacctgcagtacaagaagctgtggtgggaggccggcaagcgctacgtcaagctgcgcctctccaccaaggccctcaagaccatcgagaagcacggcctcgacgccgtcgcgcgcaaggccggcatcgacctcaacaagaagtgagccgagcttgagtagtcaagccggtgatggcggtatggtcaggccgagcaatctcgcgaacagatgccactagcttagtcttcatggtatgggtccgtctcgtctgtctcaatgtctgctgctgctgctgctgctgctgctgctcattcagtcatacagtatttttcctttcctccctaatttgatttgcatccaataaccaatgtaggcagatcgaggttgcgtatatttttattctatggaaagagttgaggtttc

SEQ ID NO: 42172 - protein, 140 aa, Panicum virgatum; identical to SEQ ID NO: 40529
  misc_feature: Ceres CLONE 2010870
  misc_feature (65)..(125): Pfam Name: Ribosomal_L28 Pfam Description: Ribosomal L28 family

SEQ ID NO: 42173 - DNA, 660 bp, Panicum virgatum
  misc_feature: Ceres CLONE 2010876
  misc_feature: Encodes the peptide sequence at SEQ ID NO. 42174
atccaattcccaacctcccccaccagaaaacaacaatccccaatttccttcgtgctcgcggcggcggcggcggcggcgatgtcggggcgcggcaagggcggcaaggggctgggcaagggcggcgccaagcgccaccgcaaggtgctccgcgacaacatccaggggatcaccaagccggcgatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgccagggacgcaccctctacggcttcggcggctaggccctggcgccggtgcgcccccgtctgaggcgcggttcctggattggtgccgtgtgtggttagggatgagggttcgttgtcaagggattggctgtgttggctttctgaatgtagtgtattggttttctgaatgtagtctgtctttgtgccgtgaagaaatgcgtactgcctatcttgtacgaggattgaacatgcctgcagcaaagaaatggtcgggtttcaaatgctgtgcttctgactgaatcttatcctgaagaaaagtacacgttc

SEQ ID NO: 42174 - protein, 103 aa, Panicum virgatum; identical to SEQ ID NO: 12044
  misc_feature: Ceres CLONE 2010876
  misc_feature (25)..(94): Pfam Name: Histone Pfam Description: Core histone H2A/H2B/H3/H4

SEQ ID NO: 42175 - DNA, 677 bp, Panicum virgatum
  misc_feature: Ceres CLONE 2010878
  misc_feature: Encodes the peptide sequence at SEQ ID NO. 42176
accaggatattgcattgggagcaacaccaatggaagaccaccatccctacctctaccttggattagctctcgtctcgctgctcatcatcatgctggtgcagcgccgccggcgctgcgccatggagcacgggcacggcctggggctgccacccgggccatggcagctgccaatcctcggcagcctgctgctccggctcggcgaggtgcccacgctggtggtgtcgccccgggaggcggcgcgggaggtgatgaagacgcacgacacggtgttcgcaacgcggccgctgagccccaccatgcgggcgctcaccaagggcggccggggaatcatcatggcgccctacggggcacactggcggcagctccgccggatcaccatcaccaagctcctcagcgcgcgccgcgtcaactccttccgcgccgtccgcgaggaggaggccgccgctatgctgcgcgcgtgcgccgcggcggcggcggggtctcgctctcgccccgtggacatgcgcgcgcggctatccgcgctcatcacggacaccacgatgcgcgccgcgatgggcgaccggttcaaggaccgcgaggtcttcctacgggcgctcgaccgcgccatcgtgctctccgccgggttcaacgcaaaacgacctgtggccatcctcccggatcgttagctggctcagcag

SEQ ID NO: 42176 - protein, 211 aa, Panicum virgatum
  misc_feature: Ceres CLONE 2010878
  misc_feature: SWISSPROT Homolog: EC 1.14.13.68 4-hydroxyphenylacetaldehyde oxime monooxygenase
MEDHHPYLYLGLALVSLLIIMLVQRRRRCAMEHGHGLGLPPGPWQLPILGSLLLRLGEVPTLVVSPREAAREVMKTHDTVFATRPLSPTMRALTKGGRGIIMAPYGAHWRQLRRITITKLLSARRVNSFRAVREEEAAAMLRACAAAAAGSRSRPVDMRARLSALITDTTMRAAMGDRFKDREVFLRALDRAIVLSAGFNAKRPVAILPDR

SEQ ID NO: 42177 - DNA, 1865 bp, Panicum virgatum
  misc_feature: Ceres CLONE 2010887
  misc_feature: Encodes the peptide sequence at SEQ ID NO. 42178
gaacgaacgctaaaaaagtaacagtttctgtactttattgccgtttgaactcctccgtctcccccgtgccatggacaccattcagttcgtgctcctggccatcctcggcgcgatcctgtacggcgtcgtgcagctgatccgcttcaactcgcccgcggcgaacgcgccgccggtgctcaagtcgtacgtgccgttcatcgggcacatcgtgagcttcggcgtgcacccgcgcaacttcatggtcgacgtgaagaagaagctcggcggcgtcttcacgctgaacatgatcggcaaccgcgtcaccttcgtcgcagacccgaagctgcacaacgagttcttccagccgcgcaacgaggtcctctcgccgcgcgagccgtacgctttcatgatccccgtcttcggcgagggcgtcgcgtacggcgccacctacgggcgcatgcgcgagcagctcaacttcctcgcggaggagctcagcatcgccaagttccgcaacttcgtccccgcgatccagctggagacgcgcaagtaccttcaggagcacttcaagggcgagtcgggcaccatcaacctgctcgaccacatgtccgcgctcatcattaacaccgcgtgccagtgcctcttcggcgaggacctccgccgccgcctggacgcgaagcgcttcgccgacctgctggcggagatggagggcagcctcatccccgccgccgtcttcgtcccgtggctgggctacctgccgacgcccgccgcgagccgccgcaacaagtcgcgcaacgagcttcaggacatgctcggcgcgatcgtcgaggagcgccgcaaggaggacgagaagggccacgtcgacacgcgccgctcggacctgctcaatggcttgatgaacgcagtgtaccgcgacggcacacccatgtccttgcacgaggtgtgcggcatgatcatcgccgccatgttcgctggtcagcacacgtcgacaatcacgacgacgtggacgatgctgcacctcgcgcagaaagagaacaaggaatacctcgacaaggtcgttgccgagcacgccgagttcaacgacaacatcgactacgacgttgtcatggaccagatgcccttcaccgaggcgtgcgcgcgcgagtcgatccgccgcgacccgccgctcgtcgtgctgatgcgcaagtgcatgcaggaccacaaggtgggcgactacgttgtccccgcgggcgacatcatcgcgtgctcgccgatgctgaaccactgcgacgagcagtacttccccgaccaccgtaagtggaaccccgagcgcaagtacagccccaacgcgaacatcgcgttcggcgccggcgtgcaccggtgcatgggcgagaagttcggtctgctccaggtgaagacgatcgtgtacacgctgctgcgcgagttcaccttcgagccggtgcgccccctgccggagcctgactatcacacgatggtcgtcggcccgacccgcacccaggccgacatcaagtggacccgccgcgccgccaagaagatctaagcggtccatcgcgccgctctcgcatagagagtggtaaccttcgcaacgctaccacacacacatcttccgcccactcccgtttctagattccctttcgtgcacatgggatacactcaccacgtctctcgaggcagaaggtgctgcgtgggtgccgcggcatggcaccagtcgacgtgggcggcgcaacgacgcgcaaacaagccgttgtgcgttcgcgttcacaacacgcttcgagacgtccgttgctcactgatgagaaacatacaccgcgtgatggcggctcaccgcacgcgtgtctggttaacgcgcggaatcgcaaccactaagcccttgtgttgttaacgctctc

SEQ ID NO: 42178 - protein, 481 aa, Panicum virgatum
  misc_feature: Ceres CLONE 2010887
  misc_feature (33)..(475): Pfam Name: p450 Pfam Description: Cytochrome P450
  misc_feature: SWISSPROT Homolog: EC 1.14.13.70 Sterol 14-demethylase
MDTIQFVLLAILGAILYGVVQLIRFNSPAANAPPVLKSYVPFIGHIVSFGVHPRNFMVDVKKKLGGVFTLNMIGNRVTFVADPKLHNEFFQPRNEVLSPREPYAFMIPVFGEGVAYGATYGRMREQLNFLAEELSIAKFRNFVPAIQLETRKYLQEHFKGESGTINLLDHMSALIINTACQCLFGEDLRRRLDAKRFADLLAEMEGSLIPAAVFVPWLGYLPTPAASRRNKSRNELQDMLGAIVEERRKEDEKGHVDTRRSDLLNGLMNAVYRDGTPMSLHEVCGMIIAAMFAGQHTSTITTTWTMLHLAQKENKEYLDKVVAEHAEFNDNIDYDVVMDQMPFTEACARESIRRDPPLVVLMRKCMQDHKVGDYVVPAGDIIACSPMLNHCDEQYFPDHRKWNPERKYSPNANIAFGAGVHRCMGEKFGLLQVKTIVYTLLREFTFEPVRPLPEPDYHTMVVGPTRTQADIKWTRRAAKKI

SEQ ID NO: 42179 - DNA, 667 bp, Panicum virgatum
  misc_feature: Ceres CLONE 2010897
  misc_feature: Encodes the peptide sequence at SEQ ID NO. 42180
accatcgagcgactcctccacctctggccagtggccacctcctcgctcctcccccgcgctcactccacctccagcctccagctgccgctactctactaatactgaatacccggtcggtgcgggctctgcctttagctagtacaccgaacgcgccaagtcccggaggaggaggaggcggtgatctttgtctcttttctcttccttgtttcctcctcccgcggcgggcggcggcggcggcaatggcggccaccgcgctgctcctccccgcggcggcggtgctgctgctctgcctcgcgggcggctcgcgggcgaccaacgtgacgtacgaccaccgcgcgctggtcatcgacggcgtgcgccgcgtgctcgtctcgggatccatccactacccgcggagcacccccgacatgtggccggggctgatccagaaggccaaggacggcggcctggacgtcatcgagacctacgtcttctgggacatccacgagcccgtccggggacagtacgacttcgagggccgcaaggacctggccgcattcgtcaaggccgtcgccgacgccggcctctacgtgcacctccgcatcgggccctacgtctgcgccgagtggaactacgggggcttcccgctgtggctgcacttcatccccggcgtcaagttccgcaccga

SEQ ID NO: 42180 - protein, 142 aa, Panicum virgatum
  misc_feature: Ceres CLONE 2010897
  misc_feature (33)..(142): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51643
  misc_feature: Useful for making plants with altered cell wall content and/or composition
  misc_feature: Functional homolog of the protein sequence given in SEQ ID NO 51152
  misc_feature: Useful for making plants with altered carbohydrate content
MAATALLLPAAAVLLLCLAGGSRATNVTYDHRALVIDGVRRVLVSGSIHYPRSTPDMWPGLIQKAKDGGLDVIETYVFWDIHEPVRGQYDFEGRKDLAAFVKAVADAGLYVHLRIGPYVCAEWNYGGFPLWLHFIPGVKFRT

SEQ ID NO: 42181 - DNA, 728 bp, Panicum virgatum
  misc_feature: Ceres CLONE 2010903
  misc_feature: Encodes the peptide sequence at SEQ ID NO. 42182
tgaggaaggatcctaccaaacctaccaactcctcctcctcgaccgatcgcccgcgcaaaggggaaacctaaaaaaaactaactcgccattcgccaactagctagcttaactttctctccgcttcgggcgccaccgcgatcgtgcgaggtttcgtgaagacaccagagagtagtagcgggggtgttgaggaactgatctgatcgtcgatcgtgaagacgatgaccgtggtcgacgccgtgtcgtccgcgggcgccggcgacgccgtcgcgctcgccgccgacgccgcggggcagccgccggctgcggggaacgggcagacggtgtgcgtcaccggcgcggccgggtacatcgcgtcgtggctcgtcaagctgctgctcgagaaggggtacactgtcaagggcaccgtcaggaacccagatgacccgaagaacgcgcacctcaaagcgctggacggcgccgccgagcggctcttcctctgcaaggccgacctcctggacttcgacgccatctgccgcgccgtggagggctgccagggcgtcttccacaccgcctcccccgtcaccgacgaccccgagcaaatggtggagcccgcggtgcgcggcacggagtacgtgatcagggcggcggcggaggccggcacggtgcggcgggtggtgttcacgtcctccatcggcgccgtcaccatggaccccaaccgcgggcccgacgtggtggtcgacgaatcctgc

SEQ ID NO: 42182 - protein, 169 aa, Panicum virgatum
  misc_feature: Ceres CLONE 2010903
  misc_feature (33)..(160): Pfam Name: adh_short Pfam Description: short chain dehydrogenase
  misc_feature: SWISSPROT Homolog: EC 1.1.1.219 Dihydrokaempferol 4-reductase
  misc_feature: Functional homolog of the protein sequence given in SEQ ID NO 50646
  misc_feature: Useful for making plants with altered carbohydrate content
  misc_feature: Functional homolog of the protein sequence given in SEQ ID NO 50647
  misc_feature: Useful for making plants with altered cell wall content and/or composition
  misc_feature: Useful for making plants with altered lignin content
MTVVDAVSSAGAGDAVALAADAAGQPPAAGNGQTVCVTGAAGYIASWLVKLLLEKGYTVKGTVRNPDDPKNAHLKALDGAAERLFLCKADLLDFDAICRAVEGCQGVFHTASPVTDDPEQMVEPAVRGTEYVIRAAAEAGTVRRVVFTSSIGAVTMDPNRGPDVVVDES

SEQ ID NO: 42183 - DNA, 713 bp, Panicum virgatum
  misc_feature: Ceres CLONE 2010912
  misc_feature: Encodes the peptide sequence at SEQ ID NO. 42184
gtggtctgtcaaagatgtttgcattgcttcgccggtcaactgtacaactaaaccgtcccgttgttgcaagagggcagatttcctttgcagtccgacatttccaatctaataactggggagacagatccagcagtaacaatcgctatggttcttcttcatcaactagacgatttggagattcattcggtgatgatagaggaagatacggatcaattcaatctcttccaatgaagaaagcctctggagttccttatgagttcaagcgtctttcttttatccctgatcaagttcatgtccaaccaaaagaagcaagttgttggagagaagaaaattcaattacagtggaaggaacaacggaatgtcctcctcctatgctatcattttcccatactccctttcatcctaaggttattgaaagcctttcacaatcattttcaaatccacttcctattcaagctcaaggttggcctgtagctttatctggaacagatatggtagggtgtgcagacactggatgtggaaaaaccctcgccttcgtcctccccgccttagaacacatcaaaaaaaacagagatgctgactattgctcagttttagttcttgcaccgtctagagaacttgctcaacagatcgaacaagaatttcaaaaatttgcaagactttatggatttaatacagcatgtgtatttggaggacaaggaaatagaaacaca

SEQ ID NO: 42184 - protein, 236 aa, Panicum virgatum
  misc_feature: Ceres CLONE 2010912
  misc_feature (148)..(236): Pfam Name: DEAD Pfam Description: DEAD/DEAH box helicase
GLSKMFALLRRSTVQLNRPVVARGQISFAVRHFQSNNWGDRSSSNNRYGSSSSTRRFGDSFGDDRGRYGSIQSLPMKKASGVPYEFKRLSFIPDQVHVQPKEASCWREENSITVEGTTECPPPMLSFSHTPFHPKVIESLSQSFSNPLPIQAQGWPVALSGTDMVGCADTGCGKTLAFVLPALEHIKKNRDADYCSVLVLAPSRELAQQIEQEFQKFARLYGFNTACVFGGQGNRN

SEQ ID NO: 42185 - DNA, 589 bp, Panicum virgatum
  misc_feature: Ceres CLONE 2010919
  misc_feature: Encodes the peptide sequence at SEQ ID NO. 42186
atcagcacacagagacacagcagcagagaccactcggtcactagccttggcccttggtctcgctccaaagagagggaaaattaaagcaacagatcgagagcaagcagctgcagcaagcctggacgtgctgccgccgagaagccgctgccggagcctcagcctctgccacaccccaagcctgaacccaaaccagagcctaaacccgagccgaaaccagagcccttaccgcatccggagcccaaacctgaacccaaaccagagccggaaccaaaaccattgccacatcctgagccaaaacctgagcctcaccctaagcccgtgcccaaaccagaacccaagccagagcctaaacctgaacctaagccggagccaaaacctgaaccaaaacccctacccgagcctaagccggagcccaagcccgaaccaaagcccgaaccaaagccaatgccagaacccaaacctgagcccaagccaaagcccaaacctgagccaaaaccagaaccgaaaccaaagccagaacccaagcctgagccaaagccagaaccaaaaccagaaccaaaaccaaagccagagccgaagccggaaccta

SEQ ID NO: 42186 - protein, 48 aa, Panicum virgatum
  misc_feature: Ceres CLONE 2010919
  misc_feature: Functional homolog of the protein sequence given in SEQ ID NO 50619
  misc_feature: Useful for making plants with altered lignin content
  misc_feature: Functional homolog of the protein sequence given in SEQ ID NO 50172
  misc_feature: Useful for making plants with modulated biomass
  misc_feature: Useful for making plants with modulated flowering time
MPEPKPEPKPKPKPEPKPEPKPKPEPKPEPKPEPKPEPKPKPEPKPEP

SEQ ID NO: 42187 - DNA, 528 bp, Panicum virgatum
  misc_feature: Ceres CLONE 2010921
  misc_feature: Encodes the peptide sequence at SEQ ID NO. 42188
tcttcaccactctaaacaatggtattgcaaactgggccatcttgctaatgcattttgatggctttgcatacaaaaggtttccactttccattctatatgtcatttgttttccttcacgcttattagcatttttgataagtttgttttccatttcggtacattctggcaggcaatcagtgattacttgtcgggactgctcattcttattcctctgtccaaattatctacataaattctcgtttgcagatcttgttggactctgctcgctgtagttataatgcgctgctgtcatgctaataattttctatgcaggtagatcttgacaacatcaatttgaaggagttccctagggccgaaaacctggaattcatggattgcatactggaggacggtgagctgctttacatcccaccaaaatggtggcattacgtcagatctctctccacaagtttctccgttagcttttggtggcgtgcaacagttcaaccttcaggcggttcatagcattaccccccccccccccccaac

SEQ ID NO: 42188 - protein, 65 aa, Panicum virgatum
  misc_feature: Ceres CLONE 2010921
  misc_feature: SWISSPROT Homolog: EC 1.14.11.16 Peptide-aspartate beta-dioxygenase
MQVDLDNINLKEFPRAENLEFMDCILEDGELLYIPPKWWHYVRSLSTSFSVSFWWRATVQPSGGS

SEQ ID NO: 42189 - DNA, 331 bp, Panicum virgatum
  misc_feature: Ceres CLONE 2010921-R
cgccggaatcagattgcagaagactaaagaaacccgacatgacccttcgtttcaggtgacatcctcttttaatggatgtaggcacacgtcacatatgtggcggtgttagttttacctgtgattcagatactgaaactgctcatatgcttcttgtaacaatgcaacgacgatcgatcatcgcgctaccatctgattcatgagagttgaggttcaaggggtgcagtagtccccactccccagtgtcattttcttcaaattaggctgccttactgttggtgtcaccgttcttctcctttttttttttttttgaaaagaatggtgccacctttcc

SEQ ID NO: 42190 - DNA, 1412 bp, Panicum virgatum
  misc_feature: Ceres CLONE 2010922
  misc_feature: Encodes the peptide sequence at SEQ ID NO. 42191
aacaaacgctaaaaaagtaacagtttctgtactttattgcaatggaggtcaagactgtccaaactattcgttgcctcgccgcggacatcgtccaaaaggcgaacagtggtcacccgggcgctccaatgggcctcgcgccgttggcgactctactttggggcgaaattatgacattcgatgcaaaggatcccgactggcatgatcgtgaccgctttgtgctttccaatgggcacgcctgcgcattgctgtactccatgctccacctcaccggttacgaagacatgacgatggagcaactcaagaatttccgtcaactcaagtcgatcactcctgggcatccagagcgccacatggcgaagggtgtcgaggtgtcgacaggtccacttggccaaggaatttcaaacgccgtcggaatggcgatggcggaagctcaccttgctgccaccttcaacaaggatggtttgaacattgttgaccatcgcacgtgggtgatcgtgggcgatggttgcctcatggaaggagtcacgcaagaagctctttcgcttgcgggtcacttgcaactggagaagctgaccgtcatttacgacgataatcacatttccattgacggcaacaccaactgcacttttaccgaagaatcgaccaagaagttccagtcccttggattccacaccatcgtcgttgccgacggcgacaacgatttcgctgcaattcgagcggcactcgaagaagcacagaacactcgcggcaagccaacagttatcttgctgcgcaccaccattggcaaggattcaaagatggagaacacaggtaaagttcacggctcgcctcttggcgatgaggatatcgccaatctcaagaaaaagtatggacgcgatccgcagcaacgatttgtgattgaacaggacgtctacgatttcttccacaaagcatccgagcgaggcgccgcgaagaagaagcagtggaaggcgacaatggaacaataccgtgagaagttccctgagcttgcggcgttgtacgactcgttctggaactcgactctgcccgagggatggaaggcaaagcttccgcgcaacaacggtaaatcgattgcaactcgcaagtcttcggagaacaccctgcaagagatcctcaacatggcgccgtttgtcatcggtggctcggcagatctgaccgggagcaacttaacgcgccccgatggtgctaagcttgttgatttccagccgaaaactccagaggggcgctacattcgcttcggtgtgcgcgagcacgggatgtgtggcgtgttgaacggaatcaacgctcacggcggtctcattgcttatggaggaactttcctcaacttcatctcgtacgcaatgggagcagtgcgcttggctgccctctccggtcatgggtcaatcttcgtcgcg

SEQ ID NO: 42191 - protein, 456 aa, Panicum virgatum
  misc_feature: Ceres CLONE 2010922
  misc_feature (1)..(335): Pfam Name: Transketolase_N Pfam Description: Transketolase, thiamine diphosphate binding domain
  misc_feature (348)..(456): Pfam Name: Transket_pyr Pfam Description: Transketolase, pyrimidine binding domain
  misc_feature: SWISSPROT Homolog: EC 2.2.1.1 Transketolase
MEVKTVQTIRCLAADIVQKANSGHPGAPMGLAPLATLLWGEIMTFDAKDPDWHDRDRFVLSNGHACALLYSMLHLTGYEDMTMEQLKNFRQLKSITPGHPERHMAKGVEVSTGPLGQGISNAVGMAMAEAHLAATFNKDGLNIVDHRTWVIVGDGCLMEGVTQEALSLAGHLQLEKLTVIYDDNHISIDGNTNCTFTEESTKKFQSLGFHTIVVADGDNDFAAIRAALEEAQNTRGKPTVILLRTTIGKDSKMENTGKVHGSPLGDEDIANLKKKYGRDPQQRFVIEQDVYDFFHKASERGAAKKKQWKATMEQYREKFPELAALYDSFWNSTLPEGWKAKLPRNNGKSIATRKSSENTLQEILNMAPFVIGGSADLTGSNLTRPDGAKLVDFQPKTPEGRYIRFGVREHGMCGVLNGINAHGGLIAYGGTFLNFISYAMGAVRLAALSGHGSIFV

SEQ ID NO: 42192 - DNA, 592 bp, Panicum virgatum
  misc_feature: Ceres CLONE 2010922-R
  misc_feature: Encodes the peptide sequence at SEQ ID NO. 42193
aaacggaaaccagcgctgcgtgggccactgccatcgaacgacgcaatgggccaaccactctctgcctgtctcgtcaaaacgctgaaccaatcgacggctctgatttcgacggcgcaaacaaaggcgcgtatgccgtggtgaagtgcgagaatccgaagctcattattgttgccagcggcaccgaagttggactcgcggttgccgcgtcgaagaagcttgagagtgtgcgcgttgtttccatgccttcttgggaactcttcgagaaccaatctgctgactatcgtcggactgttttcacccccggtgttcccgtgttgtcggtcgagccctactgcgcgtttggctggcaacgctactctcacgcgcattgcggaattgagtcattcggcgaatctgctccagcggagaacgtgtacgagcatttcggactggtgccggatgtgatcgcggacaagggtcgtaagctgctgactgcgctgaacggtcaacccgcaccggtgctcggccacattccgctttgatgcgaatgaagttcagttcgtgcatcccgataaccaatcatcgtgaacaccatatcatttacccgggcgtc

SEQ ID NO: 42193 - protein, 172 aa, Panicum virgatum
  misc_feature: Ceres CLONE 2010922-R
  misc_feature (42)..(148): Pfam Name: Transketolase_C Pfam Description: Transketolase, C-terminal domain
  misc_feature: SWISSPROT Homolog: EC 2.2.1.1 Transketolase
TETSAAWATAIERRNGPTTLCLSRQNAEPIDGSDFDGANKGAYAVVKCENPKLIIVASGTEVGLAVAASKKLESVRVVSMPSWELFENQSADYRRTVFTPGVPVLSVEPYCAFGWQRYSHAHCGIESFGESAPAENVYEHFGLVPDVIADKGRKLLTALNGQPAPVLGHIPL

SEQ ID NO: 42194 - DNA, 663 bp, Panicum virgatum
  misc_feature: Ceres CLONE 2010943
  misc_feature: Encodes the peptide sequence at SEQ ID NO. 42195
actcagttcacagtcactcgatcgctcagcaaaatctagctgacaggacagcggcaccactacaagctgcacgcacacagctgaccgagcgagcggagtagatcgaaccaaccacaaccatggccgacggatcagagcagagcgtccacgtcctcctgctcccgtacccgagccagggccacatcaacccgatcctccagttcggcaagcgcctcgccgcgcgccgcggcgtccggtgcacgctcgccgcgacgcggttcgcgctcagccagagccagcctgccaccggcgacgccgtccgcgtcgccgccatctcggacggctgcgaccggggcggcttcggcgaggccggcggcttcggcgaggccggcggcgtcggcgcgtacctgcgccggctggaggcggccgggtccgagaccctggacgcgctcctccggtccgaggtggagcggggccgccccgtgcgcgtgctcgtgtacgacgcgttcctgccgtgggcgccgcgcgtcgcgcggcggcgcggcgcggcggccgcggcgttcttcacgcagccgtgcgcggtggacgtggcgtacgcgcacgcattcgccgggcggatccggcctccgctcgccgacgacggggaggtggcgctggcggagctgcccgggctgccggccgggc

SEQ ID NO: 42195 - protein, 181 aa, Panicum virgatum
  misc_feature: Ceres CLONE 2010943
  misc_feature: SWISSPROT Homolog: EC 2.4.1.121 Indole-3-acetate beta-glucosyltransferase
MADGSEQSVHVLLLPYPSQGHINPILQFGKRLAARRGVRCTLAATRFALSQSQPATGDAVRVAAISDGCDRGGFGEAGGFGEAGGVGAYLRRLEAAGSETLDALLRSEVERGRPVRVLVYDAFLPWAPRVARRRGAAAAAFFTQPCAVDVAYAHAFAGRIRPPLADDGEVALAELPGLPAG

SEQ ID NO: 42196 - DNA, 633 bp, Panicum virgatum
  misc_feature: Ceres CLONE 2010951
  misc_feature: Encodes the peptide sequence at SEQ ID NO. 42197
ccttccgtggagggggaagaaggcgggggggtgggtaccgtgatggtgagtttggcgatgactctgaaagggcctaccggaagaactatgaacgccctaacggtaccgggcgtgggtttgaaatgaagcgtgagggtgcagggcgtgggaactggggaactaccactgatgaaattatcccccaagaaactgaagaagggctgaagctggatgaaaaggcccctgttccagaaaagcagggtggactggaagatgctccccagggagaagaaaaccaggattaccaggaccccaatgaagaagaagaaaaggaagaagattaggagatgaccctggaagaatttgaaaaaataagggaagaaaagcggaagggacttcctgcccttaagattgaagaaaggaagggtgaagttgattaggacctgcagtctatgccgccgctttccactaaaaaaggaaatgaccaaattttcctaaaactgggttctgattaggatgctctgaagaagaaagaaaatgctgaacgtgatgaacgtgcttagaagtctctgaacatccatgaattcttggaacctgctgaaggagaaaagtactatggtggcccaaggcgtggtaggggtcgtggtgaacgtg

SEQ ID NO: 42197 - protein, 106 aa, Panicum virgatum
  misc_feature: Ceres CLONE 2010951
  misc_feature (26)..(106): Pfam Name: HABP4_PAI-RBP1 Pfam Description: Hyaluronan / mRNA binding family
FRGGGRRRGGGYRDGEFGDDSERAYRKNYERPNGTGRGFEMKREGAGRGNWGTTTDEIIPQETEEGLKLDEKAPVPEKQGGLEDAPQGEENQDYQDPNEEEEKEED

SEQ ID NO: 42198 - DNA, 711 bp, Panicum virgatum
  misc_feature: Ceres CLONE 2010962
  misc_feature: Encodes the peptide sequence at SEQ ID NO. 42199
aaccgccaatcccaaatcgattccgctgcgctccccaaaacagaagcagacgcaatggcttccgccgccgcgcctccgcctttgctccccgtgactaacccggcggccggcggcggctccgcgccgtcctccggcacggtcctctccgacgcgccgctcgccgcgccggccttccgcctcttcgtgggccggctggccgacacggcgcggcgctcgctcgcggaccggcggccgtggacggagctgctggaccgctcggccttgtcccgcccggactcgctctccgaggccacctcgcggctgcgccgcaacctcggctacttccgcgtcaactacgccgccgtcgtcgccttctcgctcgcggcctcgctcctggcgcaccccttctccctcctcgccctcctcggcgtcctcgccgcctggtgcttcctctacgccttccgcccctccgaccagcccgtcgtgctcttcggccgcaccttcaccgaccgcgagacgctgctcggcctcgtcgtcgcgtccgtgctcgccttcttcctcacctccgtcgcttcgctcatcatctccgggctgctcgtcgggggcgccatcgtcgccgcgcacggcgcctgccgcatgccagaggacctcttccctgatgatcccagcgctgcgtccagtggcaacaccaccaccaggctgctatccttccttgcgtcgcccggatctggg

SEQ ID NO: 42199 - protein, 218 aa, Panicum virgatum
  misc_feature: Ceres CLONE 2010962
  misc_feature (50)..(203): Pfam Name: PRA1 Pfam Description: PRA1 family protein
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
MASAAAPPPLLPVTNPAAGGGSAPSSGTVLSDAPLAAPAFRLFVGRLADTARRSLADRRPWTELLDRSALSRPDSLSEATSRLRRNLGYFRVNYAAVVAFSLAASLLAHPFSLLALLGVLAAWCFLYAFRPSDQPVVLFGRTFTDRETLLGLVVASVLAFFLTSVASLIISGLLVGGAIVAAHGACRMPEDLFPDDPSAASSGNTTTRLLSFLASPGS

SEQ ID NO: 42200 - DNA, 849 bp, Panicum virgatum
  misc_feature: Ceres CLONE 2010972
  misc_feature: Encodes the peptide sequence at SEQ ID NO. 42201
atcctcgacctcccccaaaaaaaaaaagtccgcagacccgtgtccgtaggatcaaacttcatctttggcttcgttcagctcaatagaccgagtctccccactaaaaatcatcaaaaatgtctcgttcaggcgttggtctcgcttccgactgcgtaacgactttcgaggagcttaagcttagaaagtcctcccggttcatcatctataagctgaatgaccacaggacagaaattatcgtcgaaaagtcctctcctgaaaccgactacgagaagttcctcgaggaactccctgagaacgactgtagatgggctgtctacgacttcggatacaaattaagcgagggcgagggcgatagaaacaaaattgtgttcatctcttgggcccctgataatgcccccatcagaagcaagatgacttacgcttcttctaaggacgctttgaggcgtgctttcaacggtatcggcgctgagattcagggtaccgattacgccgaagtttcctacgaggcccttctagacaaggttactaggaaatagatggaatatcttgaactccgggactactgaacctcgccatgctactctttggaaacaaaattctctatacataccttgctgtcgatgcgactgattggatggttgggattatctagcaaacctcgccgactctttgttccgtcttatttttctgttcgcgaccattgtcctttccgtgaagcacgtttaagtgagaaagatctttcatcccgagaggtccctttttgtcttttcggatgaaatgcatttctgcgtgctgcatgctgtttcttttgtctctaaggtctatggatacatgataatacgcatacag

SEQ ID NO: 42201 - protein, 139 aa, Panicum virgatum
  misc_feature: Ceres CLONE 2010972
  misc_feature (10)..(137): Pfam Name: Cofilin_ADF Pfam Description: Cofilin/tropomyosin-type actin-binding protein
MSRSGVGLASDCVTTFEELKLRKSSRFIIYKLNDHRTEIIVEKSSPETDYEKFLEELPENDCRWAVYDFGYKLSEGEGDRNKIVFISWAPDNAPIRSKMTYASSKDALRRAFNGIGAEIQGTDYAEVSYEALLDKVTRK

SEQ ID NO: 42202 - DNA, 683 bp, Panicum virgatum
  misc_feature: Ceres CLONE 2010994
  misc_feature: Encodes the peptide sequence at SEQ ID NO. 42203
tccacctcctttgccctccccacttcaccccggcggcggcgcagcagcagctgaagatggtgaagttcctgaagcccggcaaggccgtgatcctccttcagggccggttcgccggccggaaggcggtgatcgtgcgcgtgttcgaggagggcacccgcgaccgcccctacgggcactgcctcgtcgccggcctcgccaaataccccaagaaggtgatccgcaaggactccgccaagaagacggccaagaagtcccgtgtcaagtgcttcatcaagctcgtaaacttcacccacctcatgcccacccgctacacccttgacgtcgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagattccgggcgtccagcatagtacctgctttagttgtcaatttcatgtatcgcaaacccttatctctgttttggtattgccatgaagacttcgtgcttactgttatggatcttggagaggttgacatgtcgatgatgttttaaatgatgtcaatcatagaccttgtccaaattttgttcagaatcattgcgtggaatgtgctgttttcaatctt

SEQ ID NO: 42203 - protein, 137 aa, Panicum virgatum; identical to SEQ ID NO: 10158
  misc_feature: Ceres CLONE 2010994
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 42204 - DNA, 726 bp, Panicum virgatum
  misc_feature: Ceres CLONE 2010998
  misc_feature: Encodes the peptide sequence at SEQ ID NO. 42205
aaaacaccacgcgcggagagggcagcagtggcggcagctgcgattaacgccagacagataggtggtagaggaagaaagggggagaggggaagggccagcgagagctagctgagaggcgaactgaaggagagggcagccgcaagtactgtatagcttgtaggcaatgaggtcgagggcgccgtcgttgcggcggagcgtggttgccgcggccgcagtggcgctggcggcggcgtggtgcgcggcggcgcagctgagccagagctactacgcgtcgacgtgccccaacgtggacaccctggtccgcggcgccgtcacccagaagctgcaggagaccttcaacgccgcgccgggcacgctgcgcctcttcttccacgactgcttcgtcaggggctgcgacgcgtcggtgctgctgtcgggccccgacgacgagcacagcgcgggcgccgacacgacgctgtccccggacgcgctggacctcatcacccgcgccaaggccgccgtcgacgccgacccgcgctgcgccaacaaggtctcctgcgccgacatcctcgcgctcgccgcccgcgacgtcgtctcgcagacgggcgggccgtactacccggtggagctgggccggctggacggcaaggtgggcacgcgcgccgtggtgaagcacagcctccccggcgccggcttcgacctcgaccagctcaacaagctcttcgccgccaacggcctcacccagac

SEQ ID NO: 42205 - protein, 187 aa, Panicum virgatum
  misc_feature: Ceres CLONE 2010998
  misc_feature (46)..(187): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51490
  misc_feature: Useful for making plants with altered carbohydrate content
  misc_feature: Functional homolog of the protein sequence given in SEQ ID NO 51637
  misc_feature: Useful for making plants with altered cell wall content and/or composition
MRSRAPSLRRSVVAAAAVALAAAWCAAAQLSQSYYASTCPNVDTLVRGAVTQKLQETFNAAPGTLRLFFHDCFVRGCDASVLLSGPDDEHSAGADTTLSPDALDLITRAKAAVDADPRCANKVSCADILALAARDVVSQTGGPYYPVELGRLDGKVGTRAVVKHSLPGAGFDLDQLNKLFAANGLTQ

SEQ ID NO: 42206 - DNA, 627 bp, Panicum virgatum
  misc_feature: Ceres CLONE 2011005
  misc_feature: Encodes the peptide sequence at SEQ ID NO. 42207
gccagtcgctccggttgctcgtttcgcctgcctccccacgtctggactcctcgttcgccgcggcgtcaacgcggcttccttcccgcggtctctccgcctccgcctcccagatccggcgcccatggcgaggaacccgggctgcaccgtcttcataggtaacttggatgacagggttcctgagagggttctgtatgagattcttattcaggtaggtcgagttgtagacctacacatacctcgtgacaaggaaactagtcggccaaaaggttatgcttttgctgagtatgaatcagaggagattgcccagtatgctgttaagctattttctggccttgttcgacttcataataaaacacttagatttgcgatgtctgggcaagacaaaccctcatcaaatagcaatatgcctgtaactcctaggttaaaccctctaccaacaccaaagcctcctcatcttatgaggtctagtgatactcctgcatcacagaaaacagtagtgaatggcaggattgcagggtatggtatctcaccaagtcattcatatgacacacattctcaagcatcatcaagtgggttaccaagtagaggactaagcaatggtacgtatgaatgcatgattatttgttc

SEQ ID NO: 42207 - protein, 168 aa, Panicum virgatum
  misc_feature: Ceres CLONE 2011005
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MARNPGCTVFIGNLDDRVPERVLYEILIQVGRVVDLHIPRDKETSRPKGYAFAEYESEEIAQYAVKLFSGLVRLHNKTLRFAMSGQDKPSSNSNMPVTPRLNPLPTPKPPHLMRSSDTPASQKTVVNGRIAGYGISPSHSYDTHSQASSSGLPSRGLSNGTYECMIIC

SEQ ID NO: 42208 - DNA, 659 bp, Panicum virgatum
  misc_feature: Ceres CLONE 2011018
  misc_feature: Encodes the peptide sequence at SEQ ID NO. 42209
gaaagggcggaaaggggcaaaagtaaagtctaagcgacatatggcacgaaaaggaaatccaatttcggtaagacttgatctgaatcgtagttcagattcaagttggtttagtgattattattatggtaaattattgtatcaagatgtcaatcttagatcttatttcagttcgatacgtccacctacgagactcacctttggctttcgtctcggtaggtgtattattctacattttcccaaaaggacattcattcatttctttcttccccgtcgaccactacgactaaaacgacgcgacaaatcaagacccggaaaggataagggacggtggtgggcatttgggaaagtcgggccgatcgggtgtcttcattcaagcgagggtacagaggaagaacgaaacgaagtgagaggccggggggcagggaaaagagtcgagtcgatcgaccgggagaagcaaaacgaaatcaggatttggccgaaaaagatgcaacgttatggataccatgaccgatcaccatcgagaaagaagaatttttctaaattacttcgggtgagcggggccttcaagcatccgaaatacgccggggttgtaaatgacatagccttcctgatagaaaatgacgactccttcagaaaaaaaccgagagagagagagatcg

SEQ ID NO: 42209 - protein, 219 aa, Panicum virgatum
  misc_feature: Ceres CLONE 2011018
  misc_feature (14)..(75): Pfam Name: Ribosomal_S3_N Pfam Description: Ribosomal protein S3, N-terminal domain
KGRKGAKVKSKRHMARKGNPISVRLDLNRSSDSSWFSDYYYGKLLYQDVNLRSYFSSIRPPTRLTFGFRLGRCIILHFPKRTFIHFFLPRRPLRLKRRDKSRPGKDKGRWWAFGKVGPIGCLHSSEGTEEERNEVRGRGAGKRVESIDREKQNEIRIWPKKMQRYGYHDRSPSRKKNFSKLLRVSGAFKHPKYAGVVNDIAFLIENDDSFRKKPREREI

SEQ ID NO: 42210 - DNA, 574 bp, Panicum virgatum
  misc_feature: Ceres CLONE 2011025
  misc_feature: Encodes the peptide sequence at SEQ ID NO. 42211
ccacttttccttgacttgaccccgcgcgccggacggagctctttttttaaaggcagcaagcccaaccaaacccttcttcgagaggtcgccgaggagagctgcgcctgcgagggaggaggaggagcttcggaggggaagaagaagaagaagaagaagaagaagaagaagaggggggagccatgctggaccatctcgtcgggctggtgagggtgcgcgtggtcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggtatgcatgcatccccttccgtctcatttccccctttctttcctgaatccgttatcttgtttttttttctttttacccctactactccttcgaactcttaagaaagaaattcagaaccatgcatgagtagcacaaggaattagtttactgctccaccttgcacacatgacatttttattataagt

SEQ ID NO: 42211 - protein, 111 aa, Panicum virgatum
  misc_feature: Ceres CLONE 2011025
  misc_feature (9)..(86): Pfam Name: C2 Pfam Description: C2 domain
MLDHLVGLVRVRVVRGVNLAIRDLRSSDPYVVVRIGKQRLRTKVVKKNTNPEWNEELTLSIEDPAHPVRLVCMHPLPSHFPLSFLNPLSCFFFFLPLLLLRTLKKEIQNHA

SEQ ID NO: 42212 - DNA, 416 bp, Panicum virgatum
  misc_feature: Ceres CLONE 2011027
  misc_feature: Encodes the peptide sequence at SEQ ID NO. 42213
ttccagctctcaagaaagcacgcgggatcatggcgcctctccttcgcccgctcgtcctcgcgctcctggtcgcgtcctgcgccgcgcagcaggcgccgccggcgcagcccccgcagacgccgaacgccccgccgcgggcgcctccggctccccaggcgcctccagcatggaacccaccgccggctccccatgcacctccggacggcaacccgcctcccgaacccaccacccctcctccggctccgagcacgccgcccccggcaccgaccacccctcctccggcacccaccacgccgccccccgccccggtgactcccccgccagcccccaccacgccgccgccggcctctcccccgcccgctccgaggaccccgccgtcgtctcccgcggagaccccgccacccgctcccgccacc

SEQ ID NO: 42213 - protein, 128 aa, Panicum virgatum
  misc_feature: Ceres CLONE 2011027
  misc_feature: Functional homolog of the protein sequence given in SEQ ID NO 51459
  misc_feature: Useful for making plants with altered cell wall content and/or composition
MAPLLRPLVLALLVASCAAQQAPPAQPPQTPNAPPRAPPAPQAPPAWNPPPAPHAPPDGNPPPEPTTPPPAPSTPPPAPTTPPPAPTTPPPAPVTPPPAPTTPPPASPPPAPRTPPSSPAETPPPAPA

SEQ ID NO: 42214 - DNA, 683 bp, Panicum virgatum
  misc_feature: Ceres CLONE 2011035
  misc_feature: Encodes the peptide sequence at SEQ ID NO. 42215
gaagccggattcaaagctcgagaacagcgcgcgcagccatggggaagaagacgctcgtgctgtacccgtcgctaggcgtgggccacctcacccccatggtggagctcgccaaggccctcctgcgccacggcctcgccgcgctcatcgccgtcgtcgacccgcccgacgccgacgccgtgtcggccgccgcggtcgcgcgcctcgccgccgccaacccggacatcgcgttccgcctcctccctgtcccggcgccggccagccccgacgtcggggtgcacccggtgaggcgcagcctcgacacgctccagctcgccaaccccgcgctccgggacctcctccgctcgctgcgcgccggtcgcggaggcgtccacgcgctgctgctcgacatgttctgcgtcgacgcgctcgacgtcgcggccgagctcggcgtccccgcctacttcttcttcccctccgcggccagcgacctcgccgtgttcctcaacctgccctacttctaccccactgtgccgtcgttcagggagatgggcagggacgcgcccgtgcgctgctgccccggcatgccgccgatccgcgcggcggacatgctgcagacggtgcaggacaaggaaagcgaagcggccaaggtccggctctaccagttcaagcgcatgggcggagggggcgggcgtgctggtcaacac

SEQ ID NO: 42215 - protein, 214 aa, Panicum virgatum
  misc_feature: Ceres CLONE 2011035
  misc_feature: SWISSPROT Homolog: EC 2.4.1.218 Hydroquinone glucosyltransferase
MGKKTLVLYPSLGVGHLTPMVELAKALLRHGLAALIAVVDPPDADAVSAAAVARLAAANPDIAFRLLPVPAPASPDVGVHPVRRSLDTLQLANPALRDLLRSLRAGRGGVHALLLDMFCVDALDVAAELGVPAYFFFPSAASDLAVFLNLPYFYPTVPSFREMGRDAPVRCCPGMPPIRAADMLQTVQDKESEAAKVRLYQFKRMGGGGGRAGQ

SEQ ID NO: 42216 - DNA, 1734 bp, Panicum virgatum
  misc_feature: Ceres CLONE 2011052
  misc_feature: Encodes the peptide sequence at SEQ ID NO. 42217
attccctcccttcactttgacatccctcacacatctgccctccagcaaccagcccaatccatcgagacttctcatctgagtagcagaaaagcaaaaccagcaaggactgaaaacgaaggagaaggttgcccactcaccagcaacatgtccgcaaagagcatcctcgaggccgatggcaaggccatcatcaactaccacctcactcgcgctccggtgatcaagcccagcccgctcccgcctccgaccaagcacaacccgcctcccaggctcgcctcccttcacttctccgaggatgccgacgtgaacgccgtcctcgaccaggccgagatcacatacccgtggctgctgcacgccgacgccaagttcgttgcgaagccagaccagctcatcaagcgccgtggcaagagcggcctgctcgcgctcaacaagacctgggccgaggcgagagcgtggattgctgagcgcgccggcaaggtgcagaaggttgagcacaccgagggcgtcctccggcagttcctcgtcgagccgttcgtgccgcatcccgctgacaccgagtactacatcaacatcaactcggttcgcgatggcgactggatcctcttcacccacgagggtggtgttgatgtcggcgatgtcgatgcgaaggctgagaagctcctcattcctgtcgatctcacacaatatccctcaaacgaggagattgcttctgctctcctgaagcacgtccccaagggcatacacaatgtccttgttgacttcatcacccgcctctatgccgtctacgttgactgccagttcacctacctcgagatcaaccccctggttgtgattcccaacgaggatgccacctccgcggcggtgcacttccttgatctggctgccaagctggaccaaacagcagactttgagtgcggtgtgaagtgggccatcgcccggtcgccgtccgctctcggcatcaccgtcccgacgaccagcaatggaactgtcaacatcgatgctggccctccgattgagttccccgcccccttcggccgtgagctctccaaggaggaggcttacatcgctgagcttgatgccaagactggcgcctcgctcaagctgacggtcctgaaccccaacggcaggatctggaccctggttgccggtggtggtgcctcggtcgtctacgccgatgccatcgcctcggccggctttgccgacgagcttgccaactacggcgagtactctggcgcccccacagagtcgcagacctaccactacgcccgtacggtgctcgacctgatgctccgggccccgatggaccccaagggcaaggttctcttcattggtggcggtattgccaactttaccaacgttgccagcacctttaagggggtgatcaaggcactccgggagtacgccaaggcgctcaacgagcacaatgtccagatctgggtccgccgtgccggccccaactaccaggagggtctcaagaacatgaaggcggctacccaggagctcggcctcaacgccaagatctttggccccgagatgcacgtgtcgggcatcgtgccccttgcgctgattcccggcaagtgggaggagagcaaggctgaggagttcaagggttaaggggtggttgcttcggttagagcggacgttattcatcttgccgtttgatagttcttattacggcgcatttatgacgggaaacgagattcccaatagaaagtataatacagcatttgtgatgcc

SEQ ID NO: 42217 - protein, 488 aa, Panicum virgatum
  misc_feature: Ceres CLONE 2011052
  misc_feature (269)..(473): SWISSPROT Homolog: EC 2.3.3.8 ATP citrate synthase
  misc_feature (68)..(255): SWISSPROT Homolog: EC 6.2.1.5 Succinate--CoA ligase (ADP-forming)
MSAKSILEADGKAIINYHLTRAPVIKPSPLPPPTKHNPPPRLASLHFSEDADVNAVLDQAEITYPWLLHADAKFVAKPDQLIKRRGKSGLLALNKTWAEARAWIAERAGKVQKVEHTEGVLRQFLVEPFVPHPADTEYYININSVRDGDWILFTHEGGVDVGDVDAKAEKLLIPVDLTQYPSNEEIASALLKHVPKGIHNVLVDFITRLYAVYVDCQFTYLEINPLVVIPNEDATSAAVHFLDLAAKLDQTADFECGVKWAIARSPSALGITVPTTSNGTVNIDAGPPIEFPAPFGRELSKEEAYIAELDAKTGASLKLTVLNPNGRIWTLVAGGGASVVYADAIASAGFADELANYGEYSGAPTESQTYHYARTVLDLMLRAPMDPKGKVLFIGGGIANFTNVASTFKGVIKALREYAKALNEHNVQIWVRRAGPNYQEGLKNMKAATQELGLNAKIFGPEMHVSGIVPLALIPGKWEESKAEEFKG

SEQ ID NO: 42218 - DNA, 756 bp, Panicum virgatum
  misc_feature: Ceres CLONE 2011057
  misc_feature: Encodes the peptide sequence at SEQ ID NO. 42219
atcccaaacacaggctactcagaagctagctgtagcaagcagctcatagcacacttgaagctatagctagctaatagaaatggcgcagcatgccctgtttctcgccctgactgtccttgccttcgcggcggcagtgcacggctgtacgccgtcctgtcctaccccaccagtggttcccaccccgccggtcgtgccgccgccgtccggtggcggcggttcctgcccaatcaacgcactgaagctggaggtgtgcgccaatgtgttgaacctcctgaagctcaacatccctgtctcggggaacgaccagtgctgcccgctgctgcaggggctcgtcgaccttgacgccgcactctgtctctgcactgctatcaaggccaatgtcctcggcatcaacctcaatgtgcccatcgacctgagcctcctcctcaaccactgtggcaagatctgccctgcagatttcacctgccccaactaactagctactgaaacgttccacaggcccatgcatcatctgaatcttcatctatccactgccttagcttgttgcctgcgatcttgtgtacctatatatgccttctgtctatgtgttggtttgcatcagcatgcacccctatatgtgttctcttctgttaaggttcgagtgatgcatggctcaggagaggtgatgtcatgcaaagtgttgttctcgttcttcgtacaatatgttatgtttgtctgtaacttcatgatatacatggaataaaagtttatacaaag

SEQ ID NO: 42219 - protein, 131 aa, Panicum virgatum
  misc_feature: Ceres CLONE 2011057
  misc_feature (48)..(129): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MAQHALFLALTVLAFAAAVHGCTPSCPTPPVVPTPPVVPPPSGGGGSCPINALKLEVCANVLNLLKLNIPVSGNDQCCPLLQGLVDLDAALCLCTAIKANVLGINLNVPIDLSLLLNHCGKICPADFTCPN

SEQ ID NO: 42220 - DNA, 711 bp, Panicum virgatum
  misc_feature: Ceres CLONE 2011060
  misc_feature: Encodes the peptide sequence at SEQ ID NO. 42221
gttcagcatcgctggtgccgtccactggtgactgatcctgcaacgagactaagccgctcaaggtcgtagtcgcgatcttgagtggaaaggcaccaaccaccgagagggttggtgttgctgagatgaaggttgttgtggagagaactggtggaatagttgtgcttgcagaaagttttggtcattatgtttttaaagattcacttcaacacatctttcagtcaagtgacaatgatcttgatttttcattcaatggtatatttgagattaactgctcaaaggacatcaaaatcctaggaattattgctgtcatgtacttccctggagaaaagagaagttctctatcctcagattcagttgtaggtcagggaaacactgacgcatggaagatgtgtggtctagacaggaaagcatcactctgtttagtatttgatattgcaaagaaggatggggccatatttggttggtcaatcaggaagtaatcagttctacttccaattcttaacctacttgggaatctgtttgccccccttcatcatttttaggtttttaacaacagtcaagatgaaactgcatatttcacaatgatgttaaatagagagaatgtatcaaatgcagttgtgatgatccagccatcactcttgcaatcaggtccagagccagttctattggatgtaactgcaattgcagctgattcccctttgttggattctc

SEQ ID NO: 42221 - protein, 118 aa, Panicum virgatum
  misc_feature: Ceres CLONE 2011060
  misc_feature (41)..(115): Pfam Name: Sec23_BS Pfam Description: Sec23/Sec24 beta-sandwich domain
MKVVVERTGGIVVLAESFGHYVFKDSLQHIFQSSDNDLDFSFNGIFEINCSKDIKILGIIAVMYFPGEKRSSLSSDSVVGQGNTDAWKMCGLDRKASLCLVFDIAKKDGAIFGWSIRK

SEQ ID NO: 42222 - DNA, 689 bp, Panicum virgatum
  misc_feature: Ceres CLONE 2011066
  misc_feature: Encodes the peptide sequence at SEQ ID NO. 42223
aaccagacacccaccagcgaggcagcaagctagcctcccaaatctatcatcccatcgatcgtcatgtcggtttccctcccctccatcttcctcgccgccgcctccctcctcgccgccgccatctacatccgcagctacgacacggttgccaccaccaccaccacgcacctccacttcttcatgcacgacgactacaccggcccgcgccccaccgctgcgcgggtcgtgtctggccgctccctcctgccaacgccgtccagccaaggcggcgacggcgacggcgacgacaacgccaccgccaccggtcggagcgcgctgtcgcggctgctgacatcgccacggcagttcggggacgtggtggtgctgaacaacgcgctgacggaggggccggacgggcgcagcgcgcgcgtcggcaccgcgcaggggttcgccgtgcgcatgtcggagggcggcatcgtgtcgcacctgaccttgcacatggtcctggacgccggcgagcaccggggcagctccgtcacggcgaacggccggattgacatggacgcggaggtgcgggagtcggtggtcatcggcggcaccggcaagttccggttcgcgcgcgggtacatgctcaccaggaactacgactacgacctcgcccgtggcggcatcgtcgagatcgatgtctacgtgcagcactagtgcagcag

SEQ ID NO: 42223 - protein, 205 aa, Panicum virgatum
  misc_feature: Ceres CLONE 2011066
  misc_feature (12)..(205): Pfam Name: Dirigent Pfam Description: Dirigent-like protein
MSVSLPSIFLAAASLLAAAIYIRSYDTVATTTTTHLHFFMHDDYTGPRPTAARVVSGRSLLPTPSSQGGDGDGDDNATATGRSALSRLLTSPRQFGDVVVLNNALTEGPDGRSARVGTAQGFAVRMSEGGIVSHLTLHMVLDAGEHRGSSVTANGRIDMDAEVRESVVIGGTGKFRFARGYMLTRNYDYDLARGGIVEIDVYVQH

SEQ ID NO: 42224 - DNA, 605 bp, Panicum virgatum
  misc_feature: Ceres CLONE 2011067
  misc_feature: Encodes the peptide sequence at SEQ ID NO. 42225
gtgctctctcagaggtgggttggcttctcctccccctcttaccaagtcctcggctctagggttttagtgggaagggagatggcggcggcggatgtggagtaacgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcatcaccttctccatcgagcagtcgatgctggacgccatcgaagccatgaacggcaaggagctcgacggccgcaacatcaccgtcaaccaggctcagtcccgcggcggcggcggcggcggctccggaggtggtcgccgtgagggcggctacggcggaggcggtggcggatacggcgggtagttgagtaccttagcgtatcaccgtattgcgggtagttgaggtgatacagctaccagccgctacacagctggtacagtattcacccaatcccagccgaacagggcattgatctgcgcgcatgctggccgattgacaatattaggtttttatccaacaaaacttttgttttggacgcaataatttcatcc

SEQ ID NO: 42225 - protein, 51 aa, Panicum virgatum
  misc_feature: Ceres CLONE 2011067
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: Functional homolog of the protein sequence given in SEQ ID NO 51202
  misc_feature: Useful for making plants with altered cell wall content and/or composition
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 60 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 791 in the 10/374,780 US patent application
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
  misc_feature: Functional homolog of the protein sequence given in SEQ ID NO 51203
  misc_feature: Useful for making plants with altered carbohydrate content
  misc_feature: The sequence is a functional homolog of SEQ ID NO 2854 in the 10/374,780 US patent application
  misc_feature: The sequence is a functional homolog of SEQ ID NO 464 in the 10/225,066 US patent application
  misc_feature: The sequence is a functional homolog of SEQ ID NO 1755 in the 10/374,780 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
MLDAIEAMNGKELDGRNITVNQAQSRGGGGGGSGGGRREGGYGGGGGGYGG

SEQ ID NO: 42226 - DNA, 1136 bp, Panicum virgatum
  misc_feature: Ceres CLONE 2011097-R
  misc_feature: Encodes the peptide sequence at SEQ ID NO. 42227
cggatcgttcgtcgaactccacgctgccgaggatgtcgaccttggcccagctctcgtccagcttctacgcggagtcctgcccgggcgtggagctggcgctgagagatgtggccaggtctgcctccaccctggacccctccctccctggcaagcttcttaggctggtcttcgatgactgcttcggcgagggatgcgatgcatcagtactgatacaaggtaacggcacggagagaaccgatcctgcaaatctgtcgcttggtgggttcaatgtcattgatgctgccaagagattgcttgaggtggtgtgccctgcaactgtttcttgcagtgatattatcgtcctcgccgcaagggatgccgttgtgtttaccggaggaccgtccgtgcccgtgcccctggggagacgagacggcctggyctcgttggcatccaacgtccggcgaaacatcatcgacaccggcttctccgtcgacgccatggcggccagcttcaccttcaagggtctcaccctggacgacctcgtcaccctctcaggggggcacaccatcgggtcggcgcactgcaacacgttccgcgagcggttccaggtggcgaacgggagcatggcgcccgtggacgcgtcgatgaacgcggactacgcgaacgagctgatccggccgtgcgccgcgtcggcgggcgcggccgtggactgcgactccggctcggcgtcggccttcgacaaccgctacttcgccaacctgctggcggggcggggcctgctgcgcacggacgccgtgctggtgcggaacgccaccacgagggccaaggtggaggagttcgcgcggagccaggaggggttcttcgcgagctgggcgggctcgtacgccaggctcaccagcctcggcgtcaagaccggcgccgacggcgagatcaggcggacctgctccagcgtcaacggctgatgatggaccatgaatgggtcaggggagcaaagtaatgtagagcgatctgcttgcatttgtctaccaatatatgtgtattagtaggcgttatgttgtgcacttgcaaaattagaaaaaaaaatgatgcccataatcatagtcacagattgaccgacagcatccatatgaatagaaccatgcaaagatgtctccttg

SEQ ID NO: 42227 - protein, 302 aa, Panicum virgatum
  misc_feature: Ceres CLONE 2011097-R
  misc_feature (23)..(265): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51568
  misc_feature: Useful for making plants with altered cell wall content and/or composition
  misc_feature (129)..(129): Xaa is any aa, unknown, or other
MSTLAQLSSSFYAESCPGVELALRDVARSASTLDPSLPGKLLRLVFDDCFGEGCDASVLIQGNGTERTDPANLSLGGFNVIDAAKRLLEVVCPATVSCSDIIVLAARDAVVFTGGPSVPVPLGRRDGLXSLASNVRRNIIDTGFSVDAMAASFTFKGLTLDDLVTLSGGHTIGSAHCNTFRERFQVANGSMAPVDASMNADYANELIRPCAASAGAAVDCDSGSASAFDNRYFANLLAGRGLLRTDAVLVRNATTRAKVEEFARSQEGFFASWAGSYARLTSLGVKTGADGEIRRTCSSVNG

SEQ ID NO: 42228 - DNA, 662 bp, Panicum virgatum
  misc_feature: Ceres CLONE 2011097
ctccaggagggaaagggccttttcttgcgcgcggtgacgtgcccgtgagcttccggttttaccgttctagtagggaaaggcgtgctcggtgctctcgtcctggtctgcgcaagatggggcgggggctaggcggcgccgtcgtctgctcaatgctggtgctgccggcgctgctggcgctcgccgcctcgcagccggcgaccccggctctgtcgccggctcagagcgcgccgcggcctccgccggcgccggccgcgagggcgtcctccccagcgcccgcggcgccggctccgaggcagtcgagcccgccggtgccagcggtgaacccgtcgtctccgccacacgcggcgccagctgggaagccatctccgtctccgaggccggctccagtgccgcctccgccccgcgcggcgccgacgccaatgccgttgctgccgcctgcctcgcctgttcctgtcccagctgcgccacgaccggcccccaaaccgtccccgcccgcggccccggcgccaggccagtcacaaccacctgccacgcagccgccgccgccctcgtcgtcgctggcgccaaggccgtcacctgccacaccggccccacagccgccaccggctccgaaacagtctccatcaccggcttcaccaaagacaccgcccccgccgcagcct

SEQ ID NO: 42229 - DNA, 1081 bp, Panicum virgatum
  misc_feature: Ceres CLONE 2011111
  misc_feature: Encodes the peptide sequence at SEQ ID NO. 42230
cgccgcctgcgcccacctccgacctcccctcaccccgcgtcctccctctcgcgcgccgctcgtcgaggtaaggttagccaccgcgccgcacactgttgccgttgccgccctcgccgttcgccgcgcgtttcgatctgttgcctgaggagccgtggttcggttggtctgtggccgtgccgatgtcgtccgaggcggcgaaggtggcggtgccggagtcggtgctccgcaagcggaagcgcgaggagcagtgggcggccgacaagaaggagaaggccctggtcgagaagaagaagtccatcgagagccgcaaactcatctccagccgcgccaagcagtacgccgaggagtacgacgctcaggagaaggagctggtgcagcttaagcgtgaggcccggttgaagggtggtttctatgtcagtcctgaggcaaagctgctgtttgtgatccgcatccgtggtatcaatgccatgcacccgaagaccaggaagatcttgcagcttttgcggttgaggcagatcttcaatggtgtgttcctgaaggtcaacaaggctaccattaacatgctgcgcagggttgagccttacgttgcatatgggtacccgaacttgaagagcgtcagggagttgatctacaagcggggctatggaaaactgaacaagcagaggattcctctgtccaacaaccaagtcattgaggagggcttgggcaagcacaacatcatctgcattgaggatcttgttcacgaggtcatgactgttgggccacacttcaaggaggccaacaacttcctttggcccttcaagttgaaggcaccactgggaggcctgaagaagaagagaaaccactacgtcgagggtggtgacgctggtaaccgtgagaactacatcaatgagctcatcaaaaggatgaactagttcacgagcaatattgtagtgtgcccttggaatgagactttgtgtgctatccctattttacattaggaagttggatcgtggatgaatatgcatgcaattttgatgtttggaactagatgtgtatggaagaaatctgaccttttatccggaggtttgggattttattt

SEQ ID NO: 42230 - protein, 244 aa, Panicum virgatum
  misc_feature: Ceres CLONE 2011111
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
MSSEAAKVAVPESVLRKRKREEQWAADKKEKALVEKKKSIESRKLISSRAKQYAEEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEVMTVGPHFKEANNFLWPFKLKAPLGGLKKKRNHYVEGGDAGNRENYINELIKRMN

SEQ ID NO: 42231 - DNA, 1153 bp, Panicum virgatum
  misc_feature: Ceres CLONE 2011115
  misc_feature: Encodes the peptide sequence at SEQ ID NO. 42232
acccatctccgcgtccccgcgagcgagccctccgccctcgtcgcctcgaatcccccgcccccagcgcggccgcgcggcgggaaggcgcgcctccgcacgggccccgcggcctcggcggtgaaggcgaagcgcgcgtcggcggcggcggccgaggggagctcgccgtcaggggagctctcgctgcagctggagcacgtctccctcatctcgtttctctccgaccgctgccccggcgccccagcctccgggctcacgcccttcgaggcgctcctggaggaggaggacgaagacggctcccgcagtgacctgtccctgccgccgccttcgcttcctcagcagccgccgccgcaggcctcgccgatggactcggacgagcccatggaggagaaagactgctgcatcctcagccaggatttcttctgcaccccagactacatcacgccggagatgccgcaggtggccaatgaattcgatgatgataaggagaatatcccttgccccaaatcaccggagaagtcagcgaatcctcggagcaagaggtacagaactgattgttcatccaaaggcatggaatctgcagacttctctttcgaccagcagattactccagtccagtttgatagtttgattccagatgattcggaggaagacaagccgatgcaacctgtattgcatacaaggggcggttatgtttcacagtcggcagtggctctgcgctgccgggtgatgcctccaccatgcgtcaagaatccgtatctgaatacagatccatgtatagatgatcatgtttatggtgggaggcaatgcaactcagcacggttttctccttcaattggtggcaatggtctttcacgttaccggactgattctcatgaaattgacaaaattggtcatggaaacttcagtgttgtgttcaaagttctgaacaggatagatgggtgcgtgtatgcagtgaagcggagcatcacacaattgcataatgacatggaaaggaggcaagcggtgaaggaagtccaagctatggcacccttaggttctcatgagaacatagctcgatatctcacctcttggtttgagaatgagcaactttatattcacatggaactgtgtgatcgctgtctatctatgaatcgaaaccatccactgaagtgtg

SEQ ID NO: 42232 - protein, 384 aa, Panicum virgatum
  misc_feature: Ceres CLONE 2011115
  misc_feature: SWISSPROT Homolog: EC 2.7.10.2 Non-specific protein-tyrosine kinase
THLRVPASEPSALVASNPPPPARPRGGKARLRTGPAASAVKAKRASAAAAEGSSPSGELSLQLEHVSLISFLSDRCPGAPASGLTPFEALLEEEDEDGSRSDLSLPPPSLPQQPPPQASPMDSDEPMEEKDCCILSQDFFCTPDYITPEMPQVANEFDDDKENIPCPKSPEKSANPRSKRYRTDCSSKGMESADFSFDQQITPVQFDSLIPDDSEEDKPMQPVLHTRGGYVSQSAVALRCRVMPPPCVKNPYLNTDPCIDDHVYGGRQCNSARFSPSIGGNGLSRYRTDSHEIDKIGHGNFSVVFKVLNRIDGCVYAVKRSITQLHNDMERRQAVKEVQAMAPLGSHENIARYLTSWFENEQLYIHMELCDRCLSMNRNHPLKC

SEQ ID NO: 42233 - DNA, 770 bp, Panicum virgatum
  misc_feature: Ceres CLONE 2011115-R
  misc_feature: Encodes the peptide sequence at SEQ ID NO. 42234
gcacaccttgacgtgaagcctgataacatatatttcagaaatggtatctataagcttggagattttggttgtgctacactaattaaccggagtttggcaattgaagatggagattcacgttatatgcctccagaaatgctgaatgataagtatgagcatcttgacaaggttgacatcttttctcttggggcagccgtctatgagcttataagaggcaccccgcttccagagtctgggcctcactttacaagtcttagagagggcaagatcgcattacttccaggatgcccaatgcagtttcagagtttaattaagtccatgatggatcctgatccggtgaggcggccttctgcaaaggagatcctgagacaccccgcttttgagaagatccgcaaggtggtgaagaagtagaaacaccgatgtcccatcagatcccaccagcaagagagcaagtggggctcagctgccattcatcagctgttcccaaattttgtatatctaatgagatgactctctgaacgattcaactcgaatcgtttttctcccagtgatggccaacatgcctgccccgatctgatgttgtatagatacttttgaaaccaagcggtgatccgatcttaacgactggaatttgagcactgcttgtaagttatggctgcgccatttgttaaggctaccaccctttggttgcagatacctgactcatcctatttttgccatggctgtgcttggcttttgtgctggaagaattggccatgtgctgttcttat

SEQ ID NO: 42234 - protein, 136 aa, Panicum virgatum
  misc_feature: Ceres CLONE 2011115-R
  misc_feature: SWISSPROT Homolog: EC 2.7.10.2 Non-specific protein-tyrosine kinase
AHLDVKPDNIYFRNGIYKLGDFGCATLINRSLAIEDGDSRYMPPEMLNDKYEHLDKVDIFSLGAAVYELIRGTPLPESGPHFTSLREGKIALLPGCPMQFQSLIKSMMDPDPVRRPSAKEILRHPAFEKIRKVVKK

SEQ ID NO: 42235 - DNA, 1627 bp, Panicum virgatum
  misc_feature: Ceres CLONE 2011121
  misc_feature: Encodes the peptide sequence at SEQ ID NO. 42236
gagcaccgcctccccgcgcgcgcctcttcccggcctcccggcggcgcgggcggcgccatgccgcttgccctccccttcctccacctcccgcccaaccccgcccctttctatccctcccggatccagcgcacccaacagtcccaccctcacctctccctccgcacccgacgcccctcggcggcggcggcggcggcggcggccgaagcagggaacccgtcagcatcggtggacgtcgacgtcgagatggttcgcgggcgggacggagtgtggacggcgcggtctccgacggtggtagtcatgtgggacctcgacaacaagcccccgcgcggggcgccgttcccggcggccacgtccctcatcgccgccgcctccctcctcggccgcgtcgtctccatctccgccttcgccaaccgccacgccttctcccaccttcccgcctgggtcgctgccgagcgccgcgaccgccgcgccctggaccgcgccgagcgcgcggggctcgccgcaccttccgtgccctactcgtgcgccgtctgcggccgccgtttccccacccgccccgatttcacccgccacttccggcagctccacragcgggagcgcaacaagaagctctctcgcctccgctccctcaagggcaaaaagcggcagaaattccgcgagcggttcatccccggcaacaccaagtacaaggacgccgcacgggagctcctcacccccagggggggatacgggctcgcctccaagctccggcgcgcgggcgtccacgtccgcaccgtctccaacaagccgcaggccgcggaccacgcgctcatgcgccaggtgaagcactccggggcttgtggcgtcaactggatggtgctcgtctctgacgactctgacttcaccgacacggtgcgcaatgcacacgccgccgacctgaggaccgtggtggtaggggacgggtgccgcgcgcttggcaaggttgctgacatttggttgccatgggatagagtcragaatggtgaggttgatgaggagatgctaaggagttgtacacttccgggttatggagaagaccaggaagatgaccggggtgaggagttcagattggattgggataccagtgacttggatgatgttattgatgatattgttggaagaaccagtttggttggggctacgacaatatcagcgtttgccgacgaggatgttacagatggtatatttggagttgaattgaatggagatagcatgttttggagtagtgacgacgaggaagaggatggttacttgtgagattcacatggggatttacaggtaaacagtaaacagtaaacacatggatggatacatttctagttttctgtacatctgatgatcaaattggtcatgcagcaattagcaaactattgtagaattagcaactagattgtattccctggaaaattaactggatcatgaatgttgcctccctgcacaccctcctgaactaacttctcatacgtcatacggatgtgcaattgcttcgctcactgctattctacctaagattagagtgattcttttctaggatctactattttgtcaaataattcagccattgttccttggaacatttaccagtaaagacagacccttcagtgctttc

SEQ ID NO: 42236 - protein, 405 aa, Panicum virgatum
  misc_feature: Ceres CLONE 2011121
  misc_feature (154)..(177): Pfam Name: zf-C2H2 Pfam Description: Zinc finger, C2H2 type
  misc_feature (178)..(178): Xaa is any aa, unknown, or other
  misc_feature (313)..(313): Xaa is any aa, unknown, or other
MPLALPFLHLPPNPAPFYPSRIQRTQQSHPHLSLRTRRPSAAAAAAAAEAGNPSASVDVDVEMVRGRDGVWTARSPTVVVMWDLDNKPPRGAPFPAATSLIAAASLLGRVVSISAFANRHAFSHLPAWVAAERRDRRALDRAERAGLAAPSVPYSCAVCGRRFPTRPDFTRHFRQLHXRERNKKLSRLRSLKGKKRQKFRERFIPGNTKYKDAARELLTPRGGYGLASKLRRAGVHVRTVSNKPQAADHALMRQVKHSGACGVNWMVLVSDDSDFTDTVRNAHAADLRTVVVGDGCRALGKVADIWLPWDRVXNGEVDEEMLRSCTLPGYGEDQEDDRGEEFRLDWDTSDLDDVIDDIVGRTSLVGATTISAFADEDVTDGIFGVELNGDSMFWSSDDEEEDGYL

SEQ ID NO: 42237 - DNA, 1677 bp, Panicum virgatum
  misc_feature: Ceres CLONE 2011128
  misc_feature: Encodes the peptide sequence at SEQ ID NO. 42238
ccacttgcagccttcgtcttcctgcgcccgccgccgccactctctgttctcccttataaaccgcccaccaaccccgacggatggggtggtgctccccgtctactccccggcagctcctctccacggcctccctcttcgccctcggcgcgggcctcctcgccttcggcatccacctctcctacgccaacatcgagccgcagcgcgcgcgcacgctcgctcgcgaccagttcgtccgcgattacctccgcaagaagcacgacaagtagcccgctcccgggccccggggtcctcttcccccgacccgggcggtcgctcggtactcggaaacgatggccctggctccagcgagctccggcggcgaatccgtgatcgcggaggtagagatgaacgccggcgccgaccaggggggcgccaccgtgcgggtcaccgtcgtgcaggcgtcgtccgtgttctatgacacccctgccactctcggtgatgttaatcttagtcatatgtacgaagcaatgggttttctcagggtgaatgaactagatggaaaaggtggatacaacttagatagtggtgggtgagtagcgtggacagttttcttgcttggaggatgagataaagtggagaaattgatagcggaggcagctggatatggttcacagttggttttatttccagaagtcttcattggtggctaccctcatgggtctacctttggactggttgttggcaatcgcactgccaagggaaaggaagactttcggaagtatcgtgcagcagccatagatgtgcctggcccagaagtatcccagctagctgcattagctggaaaatataaggtgtttttggtgataggcgtggttgaaagggcaggatatactctatacaacacagtgctcacctttgatccactgggaaaatacctagggaagcaccgcaagctcatgcctaccgcactggaacgagtgttttgggggtttggagatggatctacaatacctgtctatgatactcctattggaaaaatcggtgccctcatttgctgggaaaacagaatgccacttctcaggacggccatgtatgccaaaggtgttgagatatattgtgctcccactgttgattgcatgacaagttggcaggcttctatgacacatattgcccttgaagggggatgcttcgttctgtcagcagtcccgttcacccgcagaaagaactatcctccccctcccgagtatacatttggtggcctagaggaagagccatcaccggaatctgttgtttgttctggggggagtgtcatcatttcaccatctggaacggtgctggcaggtcccaactatgaaggcgaggccctccttacagctgacctggaccttggagagattgttcgagccaagtttgatttcgatgtggcgggccactactcgcgacctgaggtgctgagtttggtggtgaagacagatccaaaacccgctgtctccttcacttccgatgacgagcagagttttgctggaaagagggatgacgttttgaagaagacctagtggccacctatctttaatgacgttataaagatacaacgattgaaagtggccttcgcatcacaataattgcgggcttttgtttttttgcgagtgaattgtgggcttttgctgtacatttcataataaacttttatgttcagtc

SEQ ID NO: 42238 - protein, 199 aa, Panicum virgatum
  misc_feature: Ceres CLONE 2011128
  misc_feature: SWISSPROT Homolog: EC 3.5.5.1 Nitrilase
MPTALERVFWGFGDGSTIPVYDTPIGKIGALICWENRMPLLRTAMYAKGVEIYCAPTVDCMTSWQASMTHIALEGGCFVLSAVPFTRRKNYPPPPEYTFGGLEEEPSPESVVCSGGSVIISPSGTVLAGPNYEGEALLTADLDLGEIVRAKFDFDVAGHYSRPEVLSLVVKTDPKPAVSFTSDDEQSFAGKRDDVLKKT

SEQ ID NO: 42239 - DNA, 637 bp, Panicum virgatum
  misc_feature: Ceres CLONE 2011132
  misc_feature: Encodes the peptide sequence at SEQ ID NO. 42240
ataggcacacctcctctcgcgttcccctttcccctacctcgcggggggggcgagagatctgctcgggggcccctatccggtcgattacctcgggcccagcggctccgacgccaaaaaacacactcccctccacgcaccgaccccgggccgggggcttggtgccgccggcgagggcggcggggccgccgctatataaaaccctaagctgcggtggtcggcggccgctgaagctccaggagaggacgagatggacgcgaggttcccgtactcaccggccgaggtggccaaagtccattctcgtgcagatcggaatcctcagccccgacgagatcagacgaatgtgggtggttcaaataaaatatgcatacacaatggagagggggaagcctaagcccggagggctcaatgacctacaattgtgaactattgaacgaaaaataagatgatatacatgcatggtaggcatagtagactgtccaggccactttggacaccttgagcttgcaaagtctaagttacacatcggcttcattagaactgagctgtccattatgctctgcatctgctttaactgcaccaagatcctcgcagatgaagatgatacgtaatttaagcatgctctgaacatcaggaatcc

SEQ ID NO: 42240 - protein, 50 aa, Panicum virgatum
  misc_feature: Ceres CLONE 2011132
  misc_feature: SWISSPROT Homolog: EC 2.7.7.6 DNA-directed RNA polymerase
MVGIVDCPGHFGHLELAKSKLHIGFIRTELSIMLCICFNCTKILADEDDT

SEQ ID NO: 42241 - DNA, 683 bp, Panicum virgatum
  misc_feature: Ceres CLONE 2011134
  misc_feature: Encodes the peptide sequence at SEQ ID NO. 42242
tacgtggtctgaaatatccatacatggccaagcggcttgcttgcatggtaatatcaggagctgctaacgcggattgtcttaacatacttcagccagcccgcttgcaccagggtacgctcatcgagatggaggaggagttcgagttgttggagtccacttttaggaaagctgggtttcgggaagtcacaacctttttgaccaaagagtggtacatcaatgtattggcaaggatacgcataaatgcatttcgcattgaattggttgccggctcatatgaggatcttctatcctcagctgcagcctcagtatcatgtgatgcgtctgttggcaatgcagtttatatgcttccctcattctataaccatgactgtgatccgaatactcacatagtttggctggaaaacgtggatgctaaattgaaggccctccgtgacattgaagaaggagaggagctgcgcatctgctacatcgatactagcatggatgtcaatgctcgccagaagattcttgctgacggattcggctttgagtgccactgccttcggtgcttgtctggagattagagtccatggccttgagtcttcctagcatgattaactgtcatgtagaccggttcttgaagcagcttgaggtccatggccttgagcactatcctgcagagctgcagtcctctgtacactagc

SEQ ID NO: 42242 - protein, 186 aa, Panicum virgatum
  misc_feature: Ceres CLONE 2011134
  misc_feature: SWISSPROT Homolog: EC 2.1.1.43 Histone-lysine N-methyltransferase
RGLKYPYMAKRLACMVISGAANADCLNILQPARLHQGTLIEMEEEFELLESTFRKAGFREVTTFLTKEWYINVLARIRINAFRIELVAGSYEDLLSSAAASVSCDASVGNAVYMLPSFYNHDCDPNTHIVWLENVDAKLKALRDIEEGEELRICYIDTSMDVNARQKILADGFGFECHCLRCLSGD

SEQ ID NO: 42243 - DNA, 693 bp, Panicum virgatum
  misc_feature: Ceres CLONE 2011138
  misc_feature: Encodes the peptide sequence at SEQ ID NO. 42244
aaccccattcgcatcgcagcgcagcgcagcgcgtcgcggcgggcgagcgacagctcgggaagaagaaaaaggaaggaaagccagggggaagcgggcgcgacccgcgcacgaccaccgccacccgcctcccctccccattccgagcctcccgtcgagtggaatccccgtggactccccccgcccccgcttctgcctccgccgacgcgcctcgccggggcgagcccccgccgatctgcaccctcggccccgccggcctcctcaggtacccaaccgaggaggatatagagctgggcacaagaagcttgatttgaaagggagccatgaagaaagcgttcaatcaaacggttcgggacataaaaagagaggtgaataagaatgtcctcaaggttcccagaatagaacaaaagattctcgacgccacaagcaatgagccatggggcccacatggatctctcctggcagacattgctcaagcaactcataactatcatgagtatcagatgatcatgaatattgtgtggaagaggatcaatgacactggtaaaaattggcggcatgtttacaagggattgattgtcttggattacctggttgcgcatggtaccgagcgagttattgatgacataagagagcatgcttatcagatatcgacacttgctgacttccagtacattgattcttctgggagagatc

SEQ ID NO: 42244 - protein, 124 aa, Panicum virgatum
  misc_feature: Ceres CLONE 2011138
  misc_feature (23)..(123): Pfam Name: ENTH Pfam Description: ENTH domain
MKKAFNQTVRDIKREVNKNVLKVPRIEQKILDATSNEPWGPHGSLLADIAQATHNYHEYQMIMNIVWKRINDTGKNWRHVYKGLIVLDYLVAHGTERVIDDIREHAYQISTLADFQYIDSSGRD

SEQ ID NO: 42245 - DNA, 716 bp, Panicum virgatum
  misc_feature: Ceres CLONE 2011142
  misc_feature: Encodes the peptide sequence at SEQ ID NO. 42246
tggattgagagagagggtggtacttagggtggatggtggattcaggagtggtcaagatgttcttatggctgctgccatgggcgctgatgaatatggctttggttctgtagctatgattgctactggatgtgtcatggcacgcatttgccacacaaataattgcccagttggagttgctagtcagagagaagagcttcgtgccaggtttcctggtgttcctggtgatcttgttaactacttcctctttgttgcagaggaggtacgagctgcgttagcccagttgggttatgagaagctggatgacatcatcgggcgaacagatttgcttaagccaaaacatgtctctttggtgaaaacacagcacattgatcttggatacctcttatctaatgctggattgcccgaatggagcagctctaagattaggagtcaagacgtccacactaatggccatgttcttgacgagacgatccttgcagaccccgagatagctgatgcgattgagaatgagaaagaggtttccaagacatttcaaatttttaatgttgatagagctgtatgtggacgagtagctggtgtgattgcaaagaagtatggagatacaggctttgcaggacagctcaacatcacgtttaattgaagtgcaggacagtccttttggtgttttcccgactcctgcgatgaaggtccggcctagttggaaagggccaatgact

SEQ ID NO: 42246 - protein, 212 aa, Panicum virgatum
  misc_feature: Ceres CLONE 2011142
  misc_feature (1)..(97): Pfam Name: Glu_synthase Pfam Description: Conserved region in glutamate synthase
  misc_feature: SWISSPROT Homolog: EC 1.4.7.1 Glutamate synthase (ferredoxin)
GLRERVVLRVDGGFRSGQDVLMAAAMGADEYGFGSVAMIATGCVMARICHTNNCPVGVASQREELRARFPGVPGDLVNYFLFVAEEVRAALAQLGYEKLDDIIGRTDLLKPKHVSLVKTQHIDLGYLLSNAGLPEWSSSKIRSQDVHTNGHVLDETILADPEIADAIENEKEVSKTFQIFNVDRAVCGRVAGVIAKKYGDTGFAGQLNITFN

SEQ ID NO: 42247 - DNA, 638 bp, Panicum virgatum
  misc_feature: Ceres CLONE 2011162
  misc_feature: Encodes the peptide sequence at SEQ ID NO. 42248
ccgaccagatcgttgttcagtcgcagactcgcaggccgcctctcctctgcctcctcctttcccctccacctcctctccggtgtacggctccgacgagatggccgccccgctccggcggagcctcccctccctcggccgcgcgctcctctctccggcgccggtgaggatgttctccgcggaggcctccgacgccctggtcgagatcaagccgggggagatcgggatagtctccggcatccctgaggagcacctccgccgtaaggttgtaatttattcacctgctaggactgcatcccagcaaggttcaggcaaagtcgggaggtggaaaattaactttttgtcaacccaaaagtgggagaacccattgatggggtggacatctactggggatccatatgctaatgttggtgaagccggacttacattcgacagtgcggagtcagcaaaggcattcgctgaaaaacatggatggaattatgtggttcggaaacgccatacacctcttttgaagcccaaggcttacgcggagaacttcaagtggagaggtcccccgaagccggagcaagcttgagctctagacctctagtctgtgagcctgacattcagacgatgttgttttcctcctggactgcttttgc

SEQ ID NO: 42248 - protein, 157 aa, Panicum virgatum
  misc_feature: Ceres CLONE 2011162
  misc_feature (54)..(156): Pfam Name: ETC_C1_NDUFA4 Pfam Description: ETC complex I subunit conserved region
MAAPLRRSLPSLGRALLSPAPVRMFSAEASDALVEIKPGEIGIVSGIPEEHLRRKVVIYSPARTASQQGSGKVGRWKINFLSTQKWENPLMGWTSTGDPYANVGEAGLTFDSAESAKAFAEKHGWNYVVRKRHTPLLKPKAYAENFKWRGPPKPEQA

SEQ ID NO: 42249 - DNA, 641 bp, Panicum virgatum
  misc_feature: Ceres CLONE 2011176
  misc_feature: Encodes the peptide sequence at SEQ ID NO. 42250
acccaccccaaagaaaagaacaagtccaactctaactctcccaggcggcaactaggcgcatcattcatcacagcaaaaacctccaccaccttggaaacaagcaatggcgaggcagcagctcaagttgtggccttcttcgtgggtgtcggcggcggcggacacggcgtcgtggtgcttggcgctgtcgctggtggcgctgctgctggtgtgctcgctcggcgccggcggggcgggggcaggggagggcatgctgccgcaggtgcgcggcgcggcgctgtcggcgcggccgtgcgaggagatctacgtggtggcggagggcgagacgctgcacagcatcagcgacaagtgcggcgacccctacatcctggagcagaacccgcacgtgcacgaccccgacgacgtcttccccggcctcgtcctcaagatcacgccatccaagcccaggtagaagtagaaccatcgatccaagtcatcactcatcacccgccgtgtgatctgttgtcatctatgattgagggcaagcacaaaacacaactacacaattgctctgttgctgttctgttggagcaaatcaaggatgctctgcactctgcatcagtgtagtgtagcaatgcagagtaggtagcagctctgactgaatg

SEQ ID NO: 42250 - protein, 114 aa, Panicum virgatum
  misc_feature: Ceres CLONE 2011176
  misc_feature (67)..(109): Pfam Name: LysM Pfam Description: LysM domain
MARQQLKLWPSSWVSAAADTASWCLALSLVALLLVCSLGAGGAGAGEGMLPQVRGAALSARPCEEIYVVAEGETLHSISDKCGDPYILEQNPHVHDPDDVFPGLVLKITPSKPR

SEQ ID NO: 42251 - DNA, 614 bp, Panicum virgatum
  misc_feature: Ceres CLONE 2011179
  misc_feature: Encodes the peptide sequence at SEQ ID NO. 42252
agtctcctcctcctccctcccctacccccccccccccccccgtatcgccgctccgtttctcccccctgcctgcggccctgtccctgaatccgcggcggctcctgaggcgggcggcgcagcggcgggctcccgaggcgccgcctggtgagcggcgaggcgccgcctggtgagcggcgaggcgccggatctgcggcggcgatggaggagtgatttgggcgggaggtaggcgagaggtggggtgctggttttctcccgcgcaggagatggcggcgacggcggaggcgcggggaggggacttccccgtggggatgaaggtgctggtggtggacgacgacccgacttgcctcgtcgtgctcaagaggatgctcctcgagtgccgatacgacgtaacaacgtgtcctcaggctacaagagcactaactatgttgcgagagaataggcgcggttttgatgttataataagtgatgtccacatgccagatatggatggattcaggttacttgaacttgtaggccttgagatggaccttccagttattatgatgtctgctgattcaagaacggatattgtaatgaagggaataaagcatggagcgtgcgactatttgataaaa

SEQ ID NO: 42252 - protein, 116 aa, Panicum virgatum
  misc_feature: Ceres CLONE 2011179
  misc_feature (16)..(116): Pfam Name: Response_reg Pfam Description: Response regulator receiver domain
  misc_feature: SWISSPROT Homolog: EC 2.7.13.3 Histidine kinase
  misc_feature: The sequence is a functional homolog of SEQ ID NO 934 in the 10/666,642 US patent application
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: The sequence is a functional homolog of SEQ ID NO 936 in the 10/666,642 US patent application
  misc_feature: The sequence is a functional homolog of SEQ ID NO 1410 in the 10/666,642 US patent application
  misc_feature: The sequence is a functional homolog of SEQ ID NO 476 in the 10/412,699 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: Functional homolog of the protein sequence given in SEQ ID NO 51192
  misc_feature: Useful for making plants with altered lignin content
  misc_feature: The sequence is a functional homolog of SEQ ID NO 937 in the 10/666,642 US patent application
  misc_feature: The sequence is a functional homolog of SEQ ID NO 580 in the 10/666,642 US patent application
  misc_feature: The sequence is a functional homolog of SEQ ID NO 1104 in the 11/479,226 US patent application
  misc_feature: The sequence is a functional homolog of SEQ ID NO 2404 in the 10/374,780 US patent application
  misc_feature: The sequence is a functional homolog of SEQ ID NO 550 in the 10/225,066 US patent application
MAATAEARGGDFPVGMKVLVVDDDPTCLVVLKRMLLECRYDVTTCPQATRALTMLRENRRGFDVIISDVHMPDMDGFRLLELVGLEMDLPVIMMSADSRTDIVMKGIKHGACDYLI

SEQ ID NO: 42253 - DNA, 720 bp, Panicum virgatum
  misc_feature: Ceres CLONE 2011194
  misc_feature: Encodes the peptide sequence at SEQ ID NO. 42254
acctcagcaactaggctctcttcacacgagcgcaaccaccaccccccccccactacaagcgccgccgcttcagtacccggagtagccgccgccgcgaacacaggaaggagcagcgggaacatccagggccggcaagatgcagatcttcgtgaagacgctgaccgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaacatccaaaaggagtccacgctccacctcgtgctcaggctccgtggtgggattattgagccctcgctgcaggcgctcgcgcgcaagtacaaccaggacaagatgatctgccgcaaatgctacgcacgcctgcaccccagggccgtcaactgccgcaagaagaagtgtggccacagcaaccagctgaggcccaagaagaagatcaagaactgaggtgtgttgctgctaatcagtttcatcgaccgtttaaatcatctgttgtagtggtgtaccgtatgctgtgttgtgttgttgtcgggatgttggaccgtgtctgtttagccaaacttttcggcctgccgtgatgtttcaccttgttgtcgacgatgacagttctatatgggaatacagccactgctcttgcaatt

SEQ ID NO: 42254 - protein, 129 aa, Panicum virgatum; identical to SEQ ID NO: 41506
  misc_feature: Ceres CLONE 2011194
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency

SEQ ID NO: 42255 - DNA, 773 bp, Panicum virgatum
  misc_feature: Ceres CLONE 2011196-R
  misc_feature: Encodes the peptide sequence at SEQ ID NO. 42256
tccacagggatgtcaagactaccaatattttgctggatgataatttcgttgcaaagatggcagatttcggtatctcaaaagatggtccaccattggatcatactcatgttagtactgctgtgaaagggagttttggttaccttgatccagagtactttatgagacaacagttaacacagagttcagatgtgtactcttttggtgttgtgctgtttgaggtgctatgcgcttgaccagtcatcaacccgacattaccaagggatcagataaaccttcctgagtgggctttgaagtggaaaaggcaaaacttacttgagaccataattgaccctcgattagatggaaattacacaccggagtccgtcaggcaattcagtgagatagcagaaaaatgccttgcagatgaggggaagagccggccatcaatgggtgaagtcctgtggcacctagagaacgctttgcaattgcaccaagcgcatttgcaaagtgcaactactgatggtttatcaggacatgagctgaagctttttgattcatttactgatatgcggtgcatgtttgaagaagaatttgctcattcagactgtcaggatgcagatggggaagcggttgatatcaaaattgaggtgccaggggctgtttgaattggtggtttcaattgactgaatagggtgagtgtccaattaacaatattgctcagctgcgctaccatttgcagtactgtaaaccccatatatggttaccccaacaatatactgaaattctttttgttc

SEQ ID NO: 42256 - protein, 76 aa, Panicum virgatum
  misc_feature: Ceres CLONE 2011196-R
  misc_feature: SWISSPROT Homolog: EC 2.7.11.1 Non-specific serine/threonine protein kinase
  misc_feature: Functional homolog of the protein sequence given in SEQ ID NO 51141
  misc_feature: Useful for making plants with modulated biotic stress sensitivity
  misc_feature: Functional homolog of the protein sequence given in SEQ ID NO 51140
  misc_feature: Useful for making plants with altered carbohydrate content
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
HRDVKTTNILLDDNFVAKMADFGISKDGPPLDHTHVSTAVKGSFGYLDPEYFMRQQLTQSSDVYSFGVVLFEVLCA

SEQ ID NO: 42257 - DNA, 1240 bp, Panicum virgatum
  misc_feature: Ceres CLONE 2011196
atttgttgagctcaagcctaccatattacgcaatcctccgccggactcttgtgtggcccggtctggtgcttccttgttgctgagttgcttctttcttgttcttcttcttcttcttcttcttttggcggcggcgctcaaacccttcttcctcctgactgcgagagaggaagctctccgagtcgtggaggaacctacgtctgcacaatccatcaggctcagaggctgcattttcttggcattcgggagatcctggttattctccaagggtcggctcgacggggaagatgagatcttttccgcatctgctgctgattctggtggtgttcctgatcctgggcaacgcgcgagcacaatccaagccgcttctgatcaactgcggctcggattccagcgccgacgtcgatggcaggacatgggtgggggactcccgtcctgacggcagcaacttcactgtcagtttacctggtgccattgccccggctccgaaagttgctgctggagaggatgtgtatggggatctgtacaggactgctcgcgtcttcaacgcgtcgtccagctacaggttcagggttgccgccggaagctacttcctccggctccatttcagtcagctgttcagcaatctcagttccaaggaatcggttttcgatgtcacggccaatgacctgaagctgatttccaagttcagtgtccctggagaggtctactggaggaactccaagatcaactccaccagcaacgtcatcgtgaaggagtaccttctgaatgtcacctctgggaagctggaggttgagtttgctcctgatgctgggtcgtttgccttcatcaatgcaatggaggttgtgcctgtgcccggcagctcggtcttcgattcggttaacaaggtgggtggtgttgggttgaagggccctttcagccttgcagatagtggcatcgagaccatgtacagggtgtgtgttggaggcggcaaaattgagaggaaggaggatcctcgcttatggcggaagtgggattcagatgagcattacatattctctctgaatgctgctcatgctatcaaaaacacatccaacataagctatgtgtcaggtgatgactcaacctctgcaccactaaggctctatgagacggccagggtaacggaggagacattcgtagtggataagaagttcaatgtgtcatggaggttcaatatagaccctggctttgattacttggtccggctgcatttctgtgagct

SEQ ID NO: 42258 - DNA, 612 bp, Panicum virgatum
  misc_feature: Ceres CLONE 2011212-R
  misc_feature: Encodes the peptide sequence at SEQ ID NO. 42259
attcatttggagtttggctcttcgtcctctaagttccgactccctatgatgtactcgccacaaaacgaacacctcctgctgcaggaacagacgctaagtgctcgtcctccggagaagaggcaacgggtcccatcagcgtacaacagattcatcaaggaagagatccgcaggataaaagcaaacaaccctgacattagccacagggaagccttcagcacagcagccaagaactgggcacattatccaaatatccattttgggctaagccccggaagggagggtggcaagaagctggtcgacgaggctgtctcagcgtctccggcgcctaagaagatccaaggtctctactgatagatatccgtgtgtccataaactgcatggatgcaagaatcaataccacaaattaaaatatactgtgagtaaagaattaagaggaagaggggaaaataagttactacttattaatgggtgaaaaaaaacttgtcaagagatacgtaagtacatagtagcgagtgataaagtggcgggatcgaggtgaaatgtacaatcacatgaattgctattaggcgcttcgttgaactaagacgacttaataaatcatttcaccatatt

SEQ ID NO: 42259 - protein, 116 aa, Panicum virgatum
  misc_feature: Ceres CLONE 2011212-R
  misc_feature (1)..(88): Pfam Name: YABBY Pfam Description: YABBY protein
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
IHLEFGSSSSKFRLPMMYSPQNEHLLLQEQTLSARPPEKRQRVPSAYNRFIKEEIRRIKANNPDISHREAFSTAAKNWAHYPNIHFGLSPGREGGKKLVDEAVSASPAPKKIQGLY

SEQ ID NO: 42260 - DNA, 687 bp, Panicum virgatum
  misc_feature: Ceres CLONE 2011212
ctgtctcgcactccagtccgtttcacgggctcagcactgtcgcgcagcgcacaccctgctagctctgcacgccagcatcccaaagcacaggagaagaggaggaggacggagaagccgggccatggcgagagtggaagccgtggtcgtctgcctcctggtcctcgccatggacgccgccgccggcgtgctcgggatccacgcggagaaggctcagagccaggggcggcacctgcggatcctgttcatcgagtgccggcagccggtgcggcgcgcctacgagctcggcatcgcggcggccgccgtgctggcggcgtcgcacgccatcgccaacgccgccggcggctgcgcgtgctcctgctccggcgacaagctccgccgggcgtcgcccaaccgccagatggcgtccttcgccctcgtcctcacatggatggtgctcgtcgtcgggctcgcgctgctggtcctcggcgcgctgcccaaccggaagcacaagctggcggactgcggggtggcgcgccaccggttcctgtccatcggcggcgtcctctgcttcgcgcacgcgctcttctgcgtcgtctactacgcctccgccagcgccgcggcgcgggaggaacgccgcgcggcgccgcacgtgtagccggccggaccggccctgtccgtggccgcgcgcgtcgtgctgacatcttcttt

SEQ ID NO: 42261 - DNA, 625 bp, Panicum virgatum
  misc_feature: Ceres CLONE 2011223
  misc_feature: Encodes the peptide sequence at SEQ ID NO. 42262
aactcaaccaagctgctcccaactctccacaccctgacacccatctctcttctcttcatcacgttgctctcttctctgcgtcacattacgagctgcaagcctgcaaacactctctctgcacctcttggcattgggcgccgtcgggcattgtcaccgttgagcagcatcatcgtctccatggagccgatctcggcgtctgtgccccggcccgcgtgctcggcgtacgggcggcggcggcgggcgacggcggcgaagcccgtgggcggcctcgcctggcggtgcaacgccgtgctgaagcagcacaagacgaggctgtacatcctcagcaggtgcgtctccatgctcgtgtgctggcgcgaccacgacgccgactgacctcttggcatcagccggcagcgcgagcgagcttgctggaggggatcggccggtctgaccatgttgggtttcggtgtgtagggcggcttgaaatactttagagaggctagtgcgaaacagtaatgtggtgtattgcagtaaactggttgctaaattggactgattataggtgatggtgaagtgatgaagtccagaagtgtaaatgaatggaatatacttatatacatatatactgaggtgatcatttagt

SEQ ID NO: 42262 - protein, 65 aa, Panicum virgatum
  misc_feature: Ceres CLONE 2011223
  misc_feature (40)..(58): Pfam Name: DVL Pfam Description: DVL family
MEPISASVPRPACSAYGRRRRATAAKPVGGLAWRCNAVLKQHKTRLYILSRCVSMLVCWRDHDAD

SEQ ID NO: 42263 - DNA, 843 bp, Panicum virgatum
  misc_feature: Ceres CLONE 2011235
  misc_feature: Encodes the peptide sequence at SEQ ID NO. 42264
acatttcctgctgcgcttcacacacacatctcttcgaattttgagagttgtgaaggtagcaagcactggacattaggtgtggcctgttgtctctcaaacgaagggatacacgcgagggtcatgacactatggcctcttcacagccaaagaagcgcgtgctcttcgtatgcagccacaactcaaaccgttctattgcagctcatgctgtagccagaaagctccgtccagaccttgacgtacaaagtgcaggaacagcagcagccggaacactcaaccctgtaatgataactgctctagaagttaggggtttctcaacagaaggcctctactccaaggggatcgatgacaaagctgttcaaggattgaacaacaattgggacattatttgcaccatgggttgtctgaccaagggccttccatacgaccctcccaagtctaccaaggtttatgattgggcactccctgacccagcggcacagccggagttgctcaacatggtggtggacgaagttattgagaatgtaaagaacataaagtaatggttccaggcttagagagcagtttaatcgggatcaactgtatgaatcatgtaacgtcatgaggactttgacacactagttacttgaatgactgtgtgcaatgtccaagttcatacgctgaactccgattttgggaccctcttgagtaaaagaagtctaatgcccttggaccagcaacagagtttgggtggcgacaagtcgcaagtcgtcattgccattaggtacctggacttggatagtgttttgcaagcccgaggctttaagcgaattaatccgtcgatgttagttaaagaccttcgagtcc

SEQ ID NO: 42264 - protein, 136 aa, Panicum virgatum
  misc_feature: Ceres CLONE 2011235
  misc_feature (8)..(134): Pfam Name: LMWPc Pfam Description: Low molecular weight phosphotyrosine protein phosphatase
  misc_feature: SWISSPROT Homolog: EC 3.1.3.48 Protein-tyrosine-phosphatase
MASSQPKKRVLFVCSHNSNRSIAAHAVARKLRPDLDVQSAGTAAAGTLNPVMITALEVRGFSTEGLYSKGIDDKAVQGLNNNWDIICTMGCLTKGLPYDPPKSTKVYDWALPDPAAQPELLNMVVDEVIENVKNIK

SEQ ID NO: 42265 - DNA, 545 bp, Panicum virgatum
  misc_feature: Ceres CLONE 2011241
  misc_feature: Encodes the peptide sequence at SEQ ID NO. 42266
ctaccctagccgccgttccaaccaaagcgcgcgaactcccagctcggcggcggcggcggcggcgaggaggggatcgcagtcgcagtcctgcgatggggagcgacacggaggcagagaataatagggctccggtggccctggcccccatcgcgaagccgcttgcgggcaagaagctctgcaagcggaccctcaagctagtccgccgagcatctgaggccaaatgcttgaagcgaggagtcaaggaggttgtcaagagtattcgccggggcaacaagggattgtgtgtgattgctggcaacatttctcccatcgatgtaataactcatgttccgatactctgtgaagaagccaatattccttacatatatgttccatcaaaagaggatctcgcaaccgctggcaccaccaagaggccgacctgttgtgtgctggtgatgaccaagccagccaagggggagctcgagggcgaggtcaaggagaagctcaagatggactacgaccaggtcacgtctgaagtcaccgaggtcacgtcagcgatgttttaa

SEQ ID NO: 42266 - protein, 150 aa, Panicum virgatum
  misc_feature: Ceres CLONE 2011241
  misc_feature (30)..(124): Pfam Name: Ribosomal_L7Ae Pfam Description: Ribosomal protein L7Ae/L30e/S12e/Gadd45 family
MGSDTEAENNRAPVALAPIAKPLAGKKLCKRTLKLVRRASEAKCLKRGVKEVVKSIRRGNKGLCVIAGNISPIDVITHVPILCEEANIPYIYVPSKEDLATAGTTKRPTCCVLVMTKPAKGELEGEVKEKLKMDYDQVTSEVTEVTSAMF

SEQ ID NO: 42267 - DNA, 682 bp, Panicum virgatum
  misc_feature: Ceres CLONE 2011246
  misc_feature: Encodes the peptide sequence at SEQ ID NO. 42268
agaccggcagagcaagaccaagatcgatcgacaccacggcttgagagagaggagaagcaagtgagcgagcgacctgcctgttactactagcatggacggggcggcggcggcggcgattcggcaccggacggtggaggcgaacggcatcgcgatgcacgtggcggagtgcggcggcgaggaaacgagcccgcgggcggtggtggtgttcctgcacggcttcccggagctctcgtactcgtggcgccaccagatggagcacctggccgcgcggggctaccgctgcgtggcgcccgacctccgcggctacggcggcaccggcgcgccgcccgacgtcccctcctactccgccttccacgtcgtcggcgacgtcgtcgcgctcctcgacgcgctcggcctcgccaaggtgttcgttgtgggtcacgactggggcgccatcatcgcgtggtacctgtgcctgttccggccggaccgcgtgacggcgctggtcaacaccagcgtggccttcatgcgccacatcttcatccgcgccggcgccggcgccgtcaagcccaccgacttcttcaaccgcacctacgggcccacctactacatctgccgcttccaggagcctggggttgcagagaaggaattctccccggccaacgcccggtacatcgtcaggcagatcctgtgcaaccgcttc

SEQ ID NO: 42268 - protein, 196 aa, Panicum virgatum
  misc_feature: Ceres CLONE 2011246
  misc_feature: SWISSPROT Homolog: EC 3.3.2.10 Soluble epoxide hydrolase
MDGAAAAAIRHRTVEANGIAMHVAECGGEETSPRAVVVFLHGFPELSYSWRHQMEHLAARGYRCVAPDLRGYGGTGAPPDVPSYSAFHVVGDVVALLDALGLAKVFVVGHDWGAIIAWYLCLFRPDRVTALVNTSVAFMRHIFIRAGAGAVKPTDFFNRTYGPTYYICRFQEPGVAEKEFSPANARYIVRQILCNR

SEQ ID NO: 42269 - DNA, 643 bp, Panicum virgatum
  misc_feature: Ceres CLONE 2011255
  misc_feature: Encodes the peptide sequence at SEQ ID NO. 42270
ataccctatcctcctccccccacccgccgcgcctcaaccctacccagtcgccgctgtcgccgccgtcgccgcgcggaggcgaccccctaccgccgccgcgatgcccatcttcgagaagaccctgacgggtaacaccatcacgttggaggtggattcctcggacaccatcgacgacgtggaggccaagatcgaggacgaggagggcatccccccggaccacctccggctcgtcttcgccagccagcagctcgaggacggccgcaccctcgtcgactacaacttccagatcgattccactctccatctggtgctccgcctccgtggtggcgcctgcaagcgcgataagatgacctacaccatgccctgtaaaatcgagcactcttatattagggtgaagctcgccgagcttcgattctacgaggtcgaccacgccaccggccatgtcaccctgctccgcaaggagtgccccgacacctactgcggttcgggtaccttcatggcctatcacttctagcgccgctactgcggctagtgcggcctcacctacgtctacaaacagaaggagtaatcacttgtatcgcttttgttaacaatgctcatctgtctatcatgagattgactgattggtttctcgaatgaatat

SEQ ID NO: 42270 - protein, 137 aa, Panicum virgatum
  misc_feature: Ceres CLONE 2011255
  misc_feature (6)..(74): Pfam Name: ubiquitin Pfam Description: Ubiquitin family
  misc_feature (101)..(137): Pfam Name: Ribosomal_S27 Pfam Description: Ribosomal protein S27a
  misc_feature: Functional homolog of the protein sequence given in SEQ ID NO 50597
  misc_feature: Useful for making plants with modulated cold sensitivity
MPIFEKTLTGNTITLEVDSSDTIDDVEAKIEDEEGIPPDHLRLVFASQQLEDGRTLVDYNFQIDSTLHLVLRLRGGACKRDKMTYTMPCKIEHSYIRVKLAELRFYEVDHATGHVTLLRKECPDTYCGSGTFMAYHF

SEQ ID NO: 42271 - DNA, 691 bp, Panicum virgatum
  misc_feature: Ceres CLONE 2011265
  misc_feature: Encodes the peptide sequence at SEQ ID NO. 42272
gctagaatgtttggcagtgatgacgcagaaatcaatactctaagaatagttggcacatacggttatatggccccggagtatgcaatggatggagtgttttcggtgaaatcagatgtatttagctttggtgttataatgctggaaatcattgctggtaaaaggaaccgaggtgtctacagctactctggccacctcaaccttctagcacatgcctggagcttactgaatgaggggaagggcctagatttagtagacgaaaatctgaatggctccttcgactcagatgaagtgcataaatgcctcaaagtagggcttctgtgtgtgcaagagaaccccgacgaccgtcccctgatgtcccaggtgctgatgatgttggccagcactgacattgcctcgttgccaactccgaagcagccaggctttgctgcaagaactgccgccgccgccgaagacacgtcgtggagcaagcccgactgcagcattgtggacagcatgaccatcaccatggttgagggtcggtagaaggctgtgccttctacttatcataacaggaaaagtatatcttagagtactagagtggcatttattggctccattgttatcttgtttggcgaatgcagaaatgcagggggggttatagttttgtgggttgtggttgtttgcatttaggatcgaatagtgtgtcacccgc

SEQ ID NO: 42272 - protein, 173 aa, Panicum virgatum
  misc_feature: Ceres CLONE 2011265
  misc_feature: SWISSPROT Homolog: EC 2.7.11.1 Non-specific serine/threonine protein kinase
  misc_feature: Functional homolog of the protein sequence given in SEQ ID NO 50857
  misc_feature: Useful for making plants with altered cell wall content and/or composition
ARMFGSDDAEINTLRIVGTYGYMAPEYAMDGVFSVKSDVFSFGVIMLEIIAGKRNRGVYSYSGHLNLLAHAWSLLNEGKGLDLVDENLNGSFDSDEVHKCLKVGLLCVQENPDDRPLMSQVLMMLASTDIASLPTPKQPGFAARTAAAAEDTSWSKPDCSIVDSMTITMVEGR

SEQ ID NO: 42273 - DNA, 656 bp, Panicum virgatum
  misc_feature: Ceres CLONE 2011268
  misc_feature: Encodes the peptide sequence at SEQ ID NO. 42274
agttcatcgagcagtgcctgtccacggtggaccggaagcaccagccatggctcatcttcgccgcgcaccgcgtgctgggctactcctccaactcctggtacgccatgcagggctcgttcgaggagcccgaggggcgggagagcctgcagaagctgtggcagaagtaccgcgtggacatcgccttcttcggccacgtgcacaactacgagcggacctgcccgctgtaccagaacgagtgcatgaccaaggagaagagccactactccggcacgatgaacggcaccatcttcgtggtcgccggcggcggcggcagccacctgtcggactacaccacggccatccccaggtggagcgtgttccgcgaccgcgacttcgggttcgtcaagctcaccgcgttcaaccactcctcgctgctgttcgagtacaagaagagcaacgacggcaaggtctacgactccttcaccatcgacagggactaccgcgacgtgctcagctgcgtgcacgacagctgcttcccgacaacgctcgccacctaaaccatttctattctaagcgagtaatgggaagatgatggcatcatccagcagctgaggatcttgtgttgtcatgagtgatctgtcggagccctggtcgtggctcttgagagcatgtagttg

SEQ ID NO: 42274 - protein, 177 aa, Panicum virgatum
  misc_feature: Ceres CLONE 2011268
  misc_feature: SWISSPROT Homolog: EC 3.1.3.2 Acid phosphatase
FIEQCLSTVDRKHQPWLIFAAHRVLGYSSNSWYAMQGSFEEPEGRESLQKLWQKYRVDIAFFGHVHNYERTCPLYQNECMTKEKSHYSGTMNGTIFVVAGGGGSHLSDYTTAIPRWSVFRDRDFGFVKLTAFNHSSLLFEYKKSNDGKVYDSFTIDRDYRDVLSCVHDSCFPTTLAT

SEQ ID NO: 42275 - DNA, 610 bp, Panicum virgatum
  misc_feature: Ceres CLONE 2011269
  misc_feature: Encodes the peptide sequence at SEQ ID NO. 42276
ctcttcagctcaagaactgacgcgatgaggcggagagtcaggcggtgcagtcgcagctccggtgctcgcgtaattgtttgtcgattcagtcgctgggccttatgttcgaggcacaggcaacagggatggatcgaataactggccaagatctgccggatgatgggggagcagccggtctcgccgccccttgggatcacttcagtctgactagttctcggcgcaagccagcaagggaagggccgaatgcacgtatagtttgcaatgaagaaagtgctgttgttgctgcattgaagcgtggattcaagggaccagggtgcacaattttctatccatatgaagggacaatattcaatagctgtgaagaagcaagggagttttacaacctgtattcatgggaggtgggttttggtattaggtatggcagaagtaacaagaacaataaaggttacacgacgaggcaagatattgtttgctcatgcgagggttttgatagggacaaacaagcctcatccattaggactgggtgtaaggcgatgataatgctgctgcggactagtgaccatgcttggtttattagtaaagtgtgtgatagtcataatcatgttatgtc

SEQ ID NO: 42276 - protein, 161 aa, Panicum virgatum
  misc_feature: Ceres CLONE 2011269
  misc_feature (83)..(159): Pfam Name: FAR1 Pfam Description: FAR1 family
MDRITGQDLPDDGGAAGLAAPWDHFSLTSSRRKPAREGPNARIVCNEESAVVAALKRGFKGPGCTIFYPYEGTIFNSCEEAREFYNLYSWEVGFGIRYGRSNKNNKGYTTRQDIVCSCEGFDRDKQASSIRTGCKAMIMLLRTSDHAWFISKVCDSHNHVM

SEQ ID NO: 42277 - DNA, 714 bp, Panicum virgatum
  misc_feature: Ceres CLONE 2011286
  misc_feature: Encodes the peptide sequence at SEQ ID NO. 42278
ccccactttcccttttctctgtccctctcctcccttggtcttcctttcctggcctcctggcggcgacgactgggcgagcggcggcgccatttgtcaagtcttcgcccacccctttgccggcgtcgagcatccaccagagatggacacatcaagccccgcagcattcgtcaatggagagaatctgaaaatgtttgtggggcgaagagtgcgcacggtggtccaagtccaacgcatcgaaggtggaatggttgtcgggcagtccactgacgggcgcccgttgactatcaaaagtgccatgaacattcctgtatcgcacttcatggaggtttatggaattgctgaaaatgaccagaccatccgcgctgaagtctgcacagattttggtcccaactttgatgccaaggcatttgaagggttgtgcaagctcgcaagtgacaagttcaagcacctgttcctgtagaggtcatcattgttcggaggacctttagccgactaaagctttttcggtgctgatgacgtctctagatttaagattttgctaaatgttccggcattcagcccagtactgttacttaaaagtcagtattgggcagctattagtacgtattaacccaagcagtgttagggcgaaatctatctagttgaagaacttatggtctttcctgcttctaagcaaagcaaacctatgctttatgttgctgtcacttgcatttg

SEQ ID NO: 42278 - protein, 106 aa, Panicum virgatum
  misc_feature: Ceres CLONE 2011286
  misc_feature (1)..(105): Pfam Name: Rep_fac-A_3 Pfam Description: Replication factor A protein 3
MDTSSPAAFVNGENLKMFVGRRVRTVVQVQRIEGGMVVGQSTDGRPLTIKSAMNIPVSHFMEVYGIAENDQTIRAEVCTDFGPNFDAKAFEGLCKLASDKFKHLFL

SEQ ID NO: 42279 - DNA, 570 bp, Panicum virgatum
  misc_feature: Ceres CLONE 2011291
  misc_feature: Encodes the peptide sequence at SEQ ID NO. 42280
ttctttgtgttttgcccccaccctacagagaaatgggaaccaaggatcttaacagagtaatcgtgtgtgtgctgatactagggataatcttggatgtagagggcgatgacttgctgcaggaacaccacggcgataaactgctaccacatgtgtcctatgaccccgccagcttgtgccgcaagatgtggctgtataatcataaccggcaatcaatgcccatgctaccctagattgaaccttcttccaaactccggtgaaccatatgccgttaagtactgcaacttgggatgtgtgtcttctatgtgcgacacccagaaccatgctccagattgtgtccgagaagacatgaaaatcgacctgtaacactgcggtgatgcatgtgaccgtgtctgccatggggatgcccgcatggcctctgttgctgcttgatcttgcatgtgcctgcaatgtgatttgttgtcgaacgccatcgtctcatcaagatggatgatcttctgtataaaggatctcatgatacagatccaagtccgtgtgtgtcatcttgtacttatgtacgatgtgtgctctctc

SEQ ID NO: 42280 - protein, 85 aa, Panicum virgatum
  misc_feature: Ceres CLONE 2011291
  misc_feature (1)..(43): Pfam Name: Thionin Pfam Description: Plant thionin
MTCCRNTTAINCYHMCPMTPPACAARCGCIIITGNQCPCYPRLNLLPNSGEPYAVKYCNLGCVSSMCDTQNHAPDCVREDMKIDL

SEQ ID NO: 42281 - DNA, 718 bp, Panicum virgatum
  misc_feature: Ceres CLONE 2011305
  misc_feature: Encodes the peptide sequence at SEQ ID NO. 42282
gagtcctccatttagccctcggttctcgagtcttccagactcgcgctcgctgctcgctgctcgctgctcgccttcgcctgagatcacatagacaatggtgaaggctgtcgctgtcctcgctggcagtgatgtcaagggtaccattttcttttctcaagagggagatggtccaaccaccgtgaccggaagtatctctgggctcaagccggggctccatgggttccatgtgcatgcgcttggtgacaccaccaatggctgcatgtccactgggccacacttcaatcctgctgctaaggagcatggtgcaccagaagatgagaatcgccatgccggtgatcttgggaatgtgacagctggagaagatggtgttgctaatgtcaatattactgactgccagattcccctcactgggccacactcaatcattggccgagctgtagttgtccatgccgatccagatgaccttggcaagggtggacatgagcttagcaagagcacgggaaatgctggtggccgtgttgcttgtggtatcattgggctccagggctagatgctgtggcttcattggtgaacattcacatctgagcacctccggtcttgctgcttcatttcccttatattggatacataattggctactcttaataatcgcctgatcaatagtcagagcgctattcctatcattccgtgtttgaacattgcacaaccatcatttttc

SEQ ID NO: 42282 - protein, 151 aa, Panicum virgatum; identical to SEQ ID NO: 9809
  misc_feature: Ceres CLONE 2011305
  misc_feature (1)..(151): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 42283 - DNA, 695 bp, Panicum virgatum
  misc_feature: Ceres CLONE 2011320
  misc_feature: Encodes the peptide sequence at SEQ ID NO. 42284
ggtcttcgcacttccgctccgccgcccccgcctcgccgtctcgctcgctgccgccgcctcgcgccgccgctcgcctctccgcccgccgcgaggatgccgttcaagaggttcgtggagatcgggcgcgtggccctggtgaactacggcaaggactatggccgcctcgtcgtcatcgtcgacgtggtcgaccagaacagggcacttgtggatgcccctgacatggtcaggtgccagatgaacttcaagcggctctcacttactgacatcaagattgacatcaaacgtgtacccaagaagacaaccctgatcaaggcgatggaggaagctgatgtgaagaccaagtgggagaacagctcatggggcaagaagctgattgtccaaaagaggagagcagcgctcaatgactttgataggttcaaggtcatgttggcgaagatcaagaggggtggggcggtccggcaagagcttgccaagctcaagaaggcgtccacagcttagagtatcttttggagttttggtgaatggcatgttgagtttttggtaccttgttggatcagtcattcgtttgagtgttgttaaagccagaattagcactactgtttcctatgaactctttttcaaccttaatcaagaatggctgtgctctggagatttttgtcatggatgttgtgaaatatctaaggtagtttgcgccc

SEQ ID NO: 42284 - protein, 134 aa, Panicum virgatum
  misc_feature: Ceres CLONE 2011320
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAVRQELAKLKKASTA

SEQ ID NO: 42285 - DNA, 803 bp, Panicum virgatum
  misc_feature: Ceres CLONE 2011337
  misc_feature: Encodes the peptide sequence at SEQ ID NO. 42286
aaaaaaaaaaaaaacgccccaaccctctcgcaacgccagcgaccggaattcgcccacaccagcagggctgcaggaactgatgagaatctaagatgaacgtcgccggcgaggcgagggttaccagcagcaagaagtggagcatcctctaccctgtgtacatcaactccaggaagacggtcgcggagggccgccacgtcgccgccggcaaggcctgccccgaccccacctgcggcgagatcgccgattgctgctcgcatctcaagatcccttgccatatcgagccggataaatcgtacccgagggatttcttgcaggtggggagggtgagagtgcagctcaagagggatgatggctcccctgtcaacccagagattgttacaaagaagaagctgatgctccaggttgcggagttggttcctaagcatcttggaacgactaggaagcaggaatctgcttccaattcttcatcaacagccctatcaaagacaggaaagggtggaaggtataaaaagtaatcgtgtcattgcaggaacatgactaaactctgccgagttactcctgagatgtgagaaataatgatcttatggaactatgaaattaagagggggtaggttactgaactttcagtggaactgctttctgcttacttacaggaacttagctggtcgtgcttactgaatcaactggcagatattaagttgttttaagagagaattccctatctagcacccaaaaaaatgttgctcttatttaacatccaaacttgaaaactttatctagcaataattgaaattttgttccct

SEQ ID NO: 42286 - protein, 140 aa, Panicum virgatum
  misc_feature: Ceres CLONE 2011337
  misc_feature (16)..(112): Pfam Name: SRP19 Pfam Description: SRP19 protein
MNVAGEARVTSSKKWSILYPVYINSRKTVAEGRHVAAGKACPDPTCGEIADCCSHLKIPCHIEPDKSYPRDFLQVGRVRVQLKRDDGSPVNPEIVTKKKLMLQVAELVPKHLGTTRKQESASNSSSTALSKTGKGGRYKK

SEQ ID NO: 42287 - DNA, 1029 bp, Panicum virgatum
  misc_feature: Ceres CLONE 2011354
  misc_feature: Encodes the peptide sequence at SEQ ID NO. 42288
atagtgtgtggtcgatctatacacctcacctttcccttgcagctgttggaggagagaagctggtctttctctctatatctccggccctctgctctctctcctccgcagatcacggcctgcagagagacaagagttaggctgtttctacctgatcatatgcccctcccgcaattcttccatccacatagaaattgaaacaagatttgcttgcatatatcttgtttgtcctttcctccattttttctcctcttttatttcaattttgcagcttgttagatagatagatagcagcagtggatatatcatggaggaaacaagctagcagcagcagagaggagaaaaaaaaagagaatccttcatcgtggtctctgccgcttcttcaacagatcatcagatctgtcctctttgtgaccttaaagaggtaacagcttggtagccccccggaaatggcatccccgtcgagcacaagcaacaactccgccgccgccggcatgtacagcggccggaggctggggctcgtcgacggcatagcgccgccgcctccgccagccggctgctacttcatgcggaacaacaacgtcatcagcagcccgggcgctgacgtggcgcccgtgctgccttacgcttccatggctaattgggccgtgaatgccatgagcgccaccacgaccaccacctccggatcagagagcattgggttggatcacaaggaagggggagacagcagcatgtgaagcgccatgaatatgatttgttgtttgccccttgttaagtaagatgtggagacagacatgtgcttcagcccctttgcccttgatgagctgggagtgcttacagaaggaagcttcggggagatagcaggggagccgaatgcaatctcaggttgattaagagctaaggagcaatctacctatctatatctttccatctttcgccgacatgagttctatatatctgcatcccctttttgcatgttgtgcaaaccatactttggagtactaaatgtaatcgaatcgagatcttgatctc

SEQ ID NO: 42288 - protein, 95 aa, Panicum virgatum
  misc_feature: Ceres CLONE 2011354
  misc_feature: Functional homolog of the protein sequence given in SEQ ID NO 51644
  misc_feature: Useful for making plants with modulated biomass
MASPSSTSNNSAAAGMYSGRRLGLVDGIAPPPPPAGCYFMRNNNVISSPGADVAPVLPYASMANWAVNAMSATTTTTSGSESIGLDHKEGGDSSM

SEQ ID NO: 42289 - DNA, 638 bp, Panicum virgatum
  misc_feature: Ceres CLONE 2011360
  misc_feature: Encodes the peptide sequence at SEQ ID NO. 42290
ggaagcctccccttccccatccgtgctccgctcgcatggactcaacggcggctgctgcggcggcgcaggcgccggtgctgctggtgacgaacgacgacggcatcgacgcgccggggctccgcttcctcgtcgaccagctcgtcgccgcgcggcgctaccgcgtcctcgtctgcgcgcccgacacagacaaatcgggtgttagccactgcatcacatggcgccctgcactccgctgtaaacgtgttgatataagtggtgctacagcatttggagtttcaggaactcctgccgactgcgcctctttaggcatctctgggaagctctttgatggtgtggttcctgatctggtacttagcggaatcaacattggaaacaattgtggataccacgtcatttattctggaacagttgctggtgctagggaggcatttttatatgggattccttccatagctatgtcatatgattgggttgcgggtcagagcagcgtcaatgacctcaaggtgtccgcagaggtctgtatgcctctgataaataccatcgtgactgagatcaagaatggaacatatccccaaggatcattcttgaatgtagatgtaccaacagatgctgcacaccacaaggggtataaaattacg

SEQ ID NO: 42290 - protein, 200 aa, Panicum virgatum
  misc_feature: Ceres CLONE 2011360
  misc_feature (13)..(200): Pfam Name: SurE Pfam Description: Survival protein SurE
  misc_feature: SWISSPROT Homolog: EC 3.1.3.5 5'-nucleotidase
MDSTAAAAAAQAPVLLVTNDDGIDAPGLRFLVDQLVAARRYRVLVCAPDTDKSGVSHCITWRPALRCKRVDISGATAFGVSGTPADCASLGISGKLFDGVVPDLVLSGINIGNNCGYHVIYSGTVAGAREAFLYGIPSIAMSYDWVAGQSSVNDLKVSAEVCMPLINTIVTEIKNGTYPQGSFLNVDVPTDAAHHKGYKI

SEQ ID NO: 42291 - DNA, 293 bp, Panicum virgatum
  misc_feature: Ceres CLONE 2011374
  misc_feature: Encodes the peptide sequence at SEQ ID NO. 42292
aataaaccctcgccgcctccgccttcccgcgccgccgaattcctcccacctcctccctctcccacccacccacccacccagctctccccgagcgagcccgcgggcaccacacgcgtcatgcggccaccgagagggcgcggcggaggcggccgcttcggcggcggcggcggccgcggcggcggcgggggccagtacgggggacgcggcggccgctgatgaggggggcgtggcggcggcagatgcttccgcgacgagggcccgcccgacgaggtcgtcaaggtgtcgacgttcct

SEQ ID NO: 42292 - protein, 32 aa, Panicum virgatum
  misc_feature: Ceres CLONE 2011374
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50182
  misc_feature: Useful for making plants with modulated biomass
  misc_feature: Functional homolog of the protein sequence given in SEQ ID NO 51202
  misc_feature: Useful for making plants with altered cell wall content and/or composition
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50185
  misc_feature: Useful for making plants with modulated flowering time
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1466 in the 10/374,780 US patent application
  misc_feature: The sequence is a functional homolog of SEQ ID NO 872 in the 10/666,642 US patent application
  misc_feature: The sequence is a functional homolog of SEQ ID NO 60 in the 10/675,852 US patent application
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 468 in the 11/479,226 US patent application
  misc_feature: The sequence is a functional homolog of SEQ ID NO 1108 in the 10/412,699 US patent application
  misc_feature: The sequence is a functional homolog of SEQ ID NO 665 in the 10/374,780 US patent application
  misc_feature: The sequence is a functional homolog of SEQ ID NO 782 in the 10/666,642 US patent application
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 2854 in the 10/374,780 US patent application
  misc_feature: The sequence is a functional homolog of SEQ ID NO 464 in the 10/225,066 US patent application
  misc_feature: The sequence is a functional homolog of SEQ ID NO 1844 in the 10/374,780 US patent application
  misc_feature: The sequence is a functional homolog of SEQ ID NO 12 in US patent 7087810
  misc_feature: Functional homolog of the protein sequence given in SEQ ID NO 50198
  misc_feature: Useful for making plants with altered terpenoid content
  misc_feature: The sequence is a functional homolog of SEQ ID NO 1091 in the 10/412,699 US patent application
  misc_feature: The sequence is a functional homolog of SEQ ID NO 1279 in the 10/666,642 US patent application
  misc_feature: The sequence is a functional homolog of SEQ ID NO 636 in the 10/374,780 US patent application
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 791 in the 10/374,780 US patent application
MRPPRGRGGGGRFGGGGGRGGGGGQYGGRGGR

SEQ ID NO: 42293 - DNA, 602 bp, Panicum virgatum
  misc_feature: Ceres CLONE 2011380
  misc_feature: Encodes the peptide sequence at SEQ ID NO. 42294
acacacgacacacagatacacgctctcgctcgctcttcctccgctcgtctgacatctcctcccgtcctttcctttcgaagcctcggggatcccggcgatggccaccgccgccaccctggtgtcggtcgacgacaagctcgaccagcttcgcgccgaggtcgccaagctcgacgagatcagcgagaacgagaagtccgggttcatcggcctcgtgtcgcgctacctcagtggggaggcggagcagatcgagtggagcaagatccataccccgaccgatgaggaggtggtgccgtacgacaccctcgcgtcgcctcccgaagatctcgaggagacgaagatgctgctggacaagctcgttgtgctcgagcttaatggagggctcgggacgaccatgggctgcactggccccgagtctgtcattgaggtccgcaacgggttcacattccttgaccttattgtgattcaaattgagtctttgaacaagaagaatggatgcggtgtccctttacttctgatgaactctttcaacgctcatgatgacgcacagaatattgttgagaagtatgccaactccaacattgagattcacactttcaattcag

SEQ ID NO: 42294 - protein, 168 aa, Panicum virgatum
  misc_feature: Ceres CLONE 2011380
  misc_feature (31)..(168): Pfam Name: UDPGP Pfam Description: UTP--glucose-1-phosphate uridylyltransferase
  misc_feature: SWISSPROT Homolog: EC 2.7.7.9 UTP--glucose-1-phosphate uridylyltransferase
MATAATLVSVDDKLDQLRAEVAKLDEISENEKSGFIGLVSRYLSGEAEQIEWSKIHTPTDEEVVPYDTLASPPEDLEETKMLLDKLVVLELNGGLGTTMGCTGPESVIEVRNGFTFLDLIVIQIESLNKKNGCGVPLLLMNSFNAHDDAQNIVEKYANSNIEIHTFNS

SEQ ID NO: 42295 - DNA, 671 bp, Panicum virgatum
  misc_feature: Ceres CLONE 2011392
  misc_feature: Encodes the peptide sequence at SEQ ID NO. 42296
  misc_feature (606)..(606): n is a, c, t, g, unknown, or other
gactgcctactgccgacgcaagcgccgacgccgccgagacccctccgcggctccgcgccgactcgcctccgccgaccgcccctggatttgttgatctaagaaccatggaagggtcgttccagttgaacccaaatgccagtcctttcatacctggatccctgagttcattcgcagacaaggccccagaaaaccaagcagagtcatcgtcaaagggtgactcttctggtgacacttttgatccttctgagtttgaggaaaatgacatggatccacttgctctagccaaaatggtcgtttcaatgttcccaaatgtctccacagatttcattgatgagttactcagatcaactgattttgacataaatctgactattgatatgctgaatgagttgagctcacaagatatgcttcatgatgatgctgaagatatcaatgatctgcatgatgaccagggcctatctggggagagttaccactgtgttgaagtgcctgagagtagcagcaatctcaatcaaggtctgcagaatgagaagtcagcaacaacttctgatgtgaaatctgtcctgccaaagttctcaaatatcaatttgcttgacaatgacctgngcgtgcctgatgacaagtcagcgggggcttcagctgcaaagtgatcttcatgccaagatgctctg

SEQ ID NO: 42296 - protein, 181 aa, Panicum virgatum
  misc_feature: Ceres CLONE 2011392
  misc_feature (2)..(19): Pfam Name: PAM2 Pfam Description: Ataxin-2 C-terminal region
  misc_feature (168)..(168): Xaa is any aa, unknown, or other
MEGSFQLNPNASPFIPGSLSSFADKAPENQAESSSKGDSSGDTFDPSEFEENDMDPLALAKMVVSMFPNVSTDFIDELLRSTDFDINLTIDMLNELSSQDMLHDDAEDINDLHDDQGLSGESYHCVEVPESSSNLNQGLQNEKSATTSDVKSVLPKFSNINLLDNDLXVPDDKSAGASAAK

SEQ ID NO: 42297 - DNA, 688 bp, Panicum virgatum
  misc_feature: Ceres CLONE 2011399
  misc_feature: Encodes the peptide sequence at SEQ ID NO. 42298
acgaagagagagagagagagagagagagagagagagcgaacccggcgtcccggcgatggagttcgtggacgccctcaccggcttccgcatcgatgggcgccgacccaacgagatgcggaagctcaagggcgaggtcggcgtcgtcgcgccggccgacgggtccgcgctgttcgagatgggcaatactagggtcatagccgccgtctacggccctcgagaggtccagaacaaaggtcatcaagtgaacagcaaagaggctttggttcgttgtgagtacaggatggcagaatttagtacaggagatcggagaagaaagccgaaaggtgacaggcgatcaacagaaatttctcttgttattcgacagacaatggaggcaagcatattaacagatttaatgccacgttcacagattgatatatttgtccaagttcttcaagctgatggtggaacaaggtcagcatgcatcaatgccgcaacactagctcttgcagatgccgggattccaatgcgagacattgtcacgtcttgtagtgctgggtatctgtgttccactcctttgcttgatctgaattacgtagaagacagtgctgggggtccagatgtcacagttggtattcttgcaaagatggacaaagtgactcttcttcagatggatgcaaaattaccgatggacacatttgaaaacgta

SEQ ID NO: 42298 - protein, 210 aa, Panicum virgatum
  misc_feature: Ceres CLONE 2011399
  misc_feature (19)..(150): Pfam Name: RNase_PH Pfam Description: 3' exoribonuclease family, domain 1
  misc_feature: SWISSPROT Homolog: EC 2.7.7.56 tRNA nucleotidyltransferase
MEFVDALTGFRIDGRRPNEMRKLKGEVGVVAPADGSALFEMGNTRVIAAVYGPREVQNKGHQVNSKEALVRCEYRMAEFSTGDRRRKPKGDRRSTEISLVIRQTMEASILTDLMPRSQIDIFVQVLQADGGTRSACINAATLALADAGIPMRDIVTSCSAGYLCSTPLLDLNYVEDSAGGPDVTVGILAKMDKVTLLQMDAKLPMDTFEN

SEQ ID NO: 42299 - DNA, 619 bp, Panicum virgatum
  misc_feature: Ceres CLONE 2011407
  misc_feature: Encodes the peptide sequence at SEQ ID NO. 42300
accgccgacctcgtcgccctctcgggcgcgcacacgtccgggcgcgtgcagtgccagttcgtgacgccgcggctgtacaacttcagcgggacgaggcggccggacccggcgctggaccgggggtaccgggcgctcctctcgcggcggtgccccaggggcggcgacgggtcggcgctcaacgacctggacccgaccacgctggacgccttcgacggcagctactacgccaacctcggggcgcgccgcgggacgctgcagtccgaccaggagctgctgtcgacgcccggcgcgcccacggcggcgatcgtcggccggttcgccggcagccagaaggcgttcttcaggagcttcgccaggtccatggtcagcatggggaacatcggggtgctgacggggagccagggcgaggtcaggaggaactgtagaggggtcaatggaagctagccccgtcgaggccggatcaagtatttaatcactagcagctgtgtgtaatgtaaatgtggtgtgctcaactcagatcgagggagcagtgtaaacgcgtattgttgagggtatgtatgatgcaacgatcgattgtctgttccttggagattcaataaagagtctggattttttgttc

SEQ ID NO: 42300 - protein, 147 aa, Panicum virgatum
  misc_feature: Ceres CLONE 2011407
  misc_feature: SWISSPROT Homolog: EC 1.11.1.7 Peroxidase
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51488
  misc_feature: Useful for making plants with altered cell wall content and/or composition
  misc_feature: Functional homolog of the protein sequence given in SEQ ID NO 51174
  misc_feature: Useful for making plants with altered carbohydrate content
TADLVALSGAHTSGRVQCQFVTPRLYNFSGTRRPDPALDRGYRALLSRRCPRGGDGSALNDLDPTTLDAFDGSYYANLGARRGTLQSDQELLSTPGAPTAAIVGRFAGSQKAFFRSFARSMVSMGNIGVLTGSQGEVRRNCRGVNGS

SEQ ID NO: 42301 - DNA, 692 bp, Panicum virgatum
  misc_feature: Ceres CLONE 2011408
  misc_feature: Encodes the peptide sequence at SEQ ID NO. 42302
atccatctcatcccttgctacctgcatccatcggccttagcgagctcacagttcaatcaggtccggttcagcttcaggccgagctcgtcgtcaccgaggagatggcgctctctcaccgcatggccgcgcccgtcctcgtcttcctgctgctcctcgtcgccacagagatggggccggcgacggtggcggaggcgaggcactgcctgtcgcagagccaccacttcaagggcctgtgcgtgagcagcagcaactgcgccaacgtctgcaagaccgagaacttccccggcggcgagtgcaagacggagggcgccacccgcaagtgcttctgcaagaggatctgctagccgccgccgcccccgcccccgccccggcactgcactggtcctcccgccgttgttcgtgtgttcttccttctgttcgtcggttcctcatgcgcgcacggtgcgccgtgaacgctgtagcgggctgtgttcctctcgatcgtcttgttctcttttcctggaataaatttgaactcggtggcggtgctggtgatgccgaggtgtgcgatgcctgtgcgtgtggatcatctcgctgttgttctgcatccgtatgcactccattattagtgtactcgtagtcgtaggcaaggtgatgtaaggtcctccttttcacattgatgtaataatgcaatgcagtttcgtgctagacag

SEQ ID NO: 42302 - protein, 80 aa, Panicum virgatum; identical to SEQ ID NO: 28247
  misc_feature: Ceres CLONE 2011408
  misc_feature (32)..(80): Pfam Name: Gamma-thionin Pfam Description: Gamma-thionin family

SEQ ID NO: 42303 - DNA, 1364 bp, Panicum virgatum
  misc_feature: Ceres CLONE 2011412
  misc_feature: Encodes the peptide sequence at SEQ ID NO. 42304
aagcaccaaccgagcagagcgcgcacgcacacgcacagcggagaccagcagctagctcccaactcggctcgagcaatgccgcctccatcccgctccctcgcttcccatcctccgccccatgagcgcgaccagcactagagccaagggagcagcacggcgagcggcgggggtgcgatggagctgggcggggtggtgatggacgcgggcggcggcgcggcggagctcggtctgctcgtcggcggatctagcaggctgctcaagcacgggcggggcaatgcggcggcggggggcgaggagcacggctggggcggccgggcggccaagcaggccaggacggccgcggaggcggccaaggcggcggtcgcgccgttcctgctcgggtcgtgcagccccgggcacggcggggagcagatgctcagcttctcgtccgcagcggcgtcctcgtgcgcatccaccgccgccgttgccgctgcggcggcggccgtggcagctgacggcgcgatgccgctctactacggaaccccggcttcttgctcaggattgagctcagtgagcttgagcagcagcatgcagggggcaatggcccgggtgaggggccccttcacgccgtcccagtggatcgagctggagcaccaggccctgatctacaagtacctggctgccaatagccccatacctcccagcctcctcgtccccatcaggagcagcatcgcgtcgtctccctacccgccttcctacttcggcacgagcgcattggggtgggggtctttccagctgggctactccggcaatgcggatctggagcccgggcggtgccgccggacggacggcaagaaatggcggtgctccagggacgccgtcgccgaccagaagtactgcgagcgacatatgaaccggggacgccatcgttcaagaaagcatgtggaaggccagcctggccatgccgcgaaagcgatgtccgcggcggtggcggctgccgctgccacccagcctactgctctggctgcctccggcgccggagctactgccgctggcctcactgtcagtcagcaccagcagccagtgaagagctatgccgcgggtgcgactgatccttgctctcttcaatataacagggaactggtgaacaaacagaatgagaatgataacatgcaggactctgacaatctctccatgctgacatctatgaacacaagaaacccgggcagcctgtttccattctcaaaacaaaataatcctttcgaagtgaccagctcaagaccagagtttggccttgtctcatcagattcattgatgagctctcctcatagttccttggagaaatgtcatgtgctcagctcgcaaagtctgaatgaaaaccagag

SEQ ID NO: 42304 - protein, 396 aa, Panicum virgatum
  misc_feature: Ceres CLONE 2011412
  misc_feature (208)..(253): Pfam Name: WRC Pfam Description: WRC
  misc_feature (141)..(177): Pfam Name: QLQ Pfam Description: QLQ
MELGGVVMDAGGGAAELGLLVGGSSRLLKHGRGNAAAGGEEHGWGGRAAKQARTAAEAAKAAVAPFLLGSCSPGHGGEQMLSFSSAAASSCASTAAVAAAAAAVAADGAMPLYYGTPASCSGLSSVSLSSSMQGAMARVRGPFTPSQWIELEHQALIYKYLAANSPIPPSLLVPIRSSIASSPYPPSYFGTSALGWGSFQLGYSGNADLEPGRCRRTDGKKWRCSRDAVADQKYCERHMNRGRHRSRKHVEGQPGHAAKAMSAAVAAAAATQPTALAASGAGATAAGLTVSQHQQPVKSYAAGATDPCSLQYNRELVNKQNENDNMQDSDNLSMLTSMNTRNPGSLFPFSKQNNPFEVTSSRPEFGLVSSDSLMSSPHSSLEKCHVLSSQSLNENQ

SEQ ID NO: 42305 - DNA, 786 bp, Panicum virgatum
  misc_feature: Ceres CLONE 2011412-R
ttgtggattggcccaggacacctgcacagggaggtctttcatgggccgatgctgaagacatgcaagctcagagatcacagctctcaatatctgctccaatggcgtcttctgagctatcgtcggcttccacatctccgattcaggagaagctaatgctgtctccacgtaagctgagccgcgagtatagtccaattgggctaagcattgcagcaagcagagatgaagttagccagttagaagcaaactgggcaacgatgttccgtgattcttcgatgggtgggccattgggggaggttttaaccaagaacagtaacgccgaagcaaggcactgcctgccagcgcctctgaaccttctaaccgactgctgggattcaagccccgggatggagtcatcccccgtgggagttctgcagaagaccaccttcggatcagtctccagcagcaccggaagcagccctagaatggagaaccatggtgcctatgatggtatcagcaacctgcgggatgatctcggttcaattgtagtaaaccatccgagcatccgcctaatgtgagcttctgaccatgaaaatctgcaacaagaggcaggcatgaggaaacagatgagccagctttagcttgttacatatcgatatggtagatccatagtcttgtagtttgtcatttgagactgatcccaacctgttttgccattttcagctctctttctccacccccccccctttttttttctttttaacttggctttgctttgtaagctgtaactttcaccttcctcggattgcg

SEQ ID NO: 42306 - DNA, 712 bp, Panicum virgatum
  misc_feature: Ceres CLONE 2011427
  misc_feature: Encodes the peptide sequence at SEQ ID NO. 42307
tggtctctctcttctcccacgccttcactcccttggtctcgtctcggccttcctttcctagcggcggcgacagggcgagcggcgccgcccgccagttcttcgtcgggcgcttcaccggcgacgagcatccgacagggatccgtaaagcagtaacatggcaactctcaaagatgcagcggcaagaaaaccaattttagcaacaatccgtcttatagttcctgctggcactgcacgccccgcaccaccagttggaccagctctgggtttctataggcttaatttgatggcattctgcaaagatttcaatgccaggacccagaagtacaaggcagatactccgatgcaagttactttgactgcctacaaggatagtacattcgagtttgtagtcaagtcaccttcagtttcatggttcctgaagaaagctgcaggaattgagactgccagcagtcgcccaggccacaacgcagtgtcgtccctcactcttcgccatgtgtatgagattgcaaaactgaagcagtctgatccattttgcaagcacatgtcaatggaggcgttatgcaaatccatcattgggacggctaactccatgggcattgaaattgttagagacctttgagtgggctggcagtctaatcttaagcacaattgtcggaccaattccaagctcagtttgctttctcctctgtatgagttcggttttatttgatct

SEQ ID NO: 42307 - protein, 154 aa, Panicum virgatum; identical to SEQ ID NO: 14237
  misc_feature: Ceres CLONE 2011427
  misc_feature (80)..(150): Pfam Name: Ribosomal_L11 Pfam Description: Ribosomal protein L11, RNA binding domain
  misc_feature (16)..(75): Pfam Name: Ribosomal_L11_N Pfam Description: Ribosomal protein L11, N-terminal domain

SEQ ID NO: 42308 - DNA, 570 bp, Panicum virgatum
  misc_feature: Ceres CLONE 2011437
  misc_feature: Encodes the peptide sequence at SEQ ID NO. 42309
ggcagccaccgcaggagacgagcaagccgcagcacaccaacgcctcccgcaatggcgcgcgccggcgctctctgcctcgcgctgctctgcctcctggccgcgcactccgccgtggcgcataagtccgccacccccgccccggccgccgcgccggccgccgccaccacgccgccggccccgtcgaagaagacgcccgcgcccgccgcagctccccccaccaccccggccccggccaccgcgccgcccaccaccccggccacccctgcgcccgccacggcaccgcccactaccaccacgcctgcccctgccgcggcgccgcccaagacctaccccaaagcggcctcccccgccccggctcccaaggccaaggccaccccgcccgccaccccaccagtggccgagctgccccctgctgccacaccccccgcagcagcagcggacacccccgccgccgcgcacacctagcccgccaaggtccccgcacccgcgccgaacaaaaaaaagaagaagtcggcctcctcccagagcaagaataagaagaccaaggccccccccccagcccccgtcgcc

SEQ ID NO: 42309 - protein, 137 aa, Panicum virgatum
  misc_feature: Ceres CLONE 2011437
  misc_feature: Functional homolog of the protein sequence given in SEQ ID NO 50275
  misc_feature: Useful for making plants with altered carbohydrate content
MARAGALCLALLCLLAAHSAVAHKSATPAPAAAPAAATTPPAPSKKTPAPAAAPPTTPAPATAPPTTPATPAPATAPPTTTTPAPAAAPPKTYPKAASPAPAPKAKATPPATPPVAELPPAATPPAAAADTPAAAHT

SEQ ID NO: 42310 - DNA, 395 bp, Panicum virgatum
  misc_feature: Ceres CLONE 2011468
  misc_feature: Encodes the peptide sequence at SEQ ID NO. 42311
gcctggtcctcctcggtgttggttcgacggcggtggcggccgcctcctcctcctacgccggcggctctgtcgccttctgccccaacgcggaggccgccggggccgctcactgcgagcgtacgctcgaccctgacgtctgtctgtccacactggccgagatcccggatctggacgagaggcccctctcggatgtcatctgcgtccgcccagatacagctgcgaggacttcgtgacggccaccctcttcaactgctcctcgttgctccgggacaggttcctgagggtgcgcgaccgcctcgccatgggcgactgcctggatttcctgttcaccacaaggtacgacctccatgccaccgtggcggacctgaaatcccccactggctgcgacggcgggt

SEQ ID NO: 42311 - protein, 76 aa, Panicum virgatum
  misc_feature: Ceres CLONE 2011468
  misc_feature: Functional homolog of the protein sequence given in SEQ ID NO 51361
  misc_feature: Useful for making plants with altered carbohydrate content
LVLLGVGSTAVAAASSSYAGGSVAFCPNAEAAGAAHCERTLDPDVCLSTLAEIPDLDERPLSDVICVRPDTAARTS

SEQ ID NO: 42312 - DNA, 646 bp, Panicum virgatum
  misc_feature: Ceres CLONE 2011471
  misc_feature: Encodes the peptide sequence at SEQ ID NO. 42313
atgcacagacgagagcgagccaagtgtactactcccagtgaagccacactagctagccacaccagcagtttgacaagctagctagctagctaggccgcagccatgtcggaggagaagcaccaccacttcttccaccaccacaagaaggacgaagaggagcagcccgccggcgggtactcggaggccgtggccgccgaggtggtggccgccggcgagagcgagtacgagaggtacaagaaggaggagaaggagcacaagcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcgagcgagctccggcccggccgccgcgcacccgcctgcttgctccaataattgtggccatgatttcgcaataagtcccttccggacccttagcttgtttgcttgtgtgagactgagaggtggggcccgcgcgtcgaggtgtgttccggcctgtacgtgcttgatttttctttgcgtccgtaattgcgttgaataaacgggagcgatgcacgtgtggctcccagtctgtctgtctgt

SEQ ID NO: 42313 - protein, 99 aa, Panicum virgatum
  misc_feature: Ceres CLONE 2011471
  misc_feature (4)..(88): Pfam Name: ABA_WDS Pfam Description: ABA/WDS induced protein
MSEEKHHHFFHHHKKDEEEQPAGGYSEAVAAEVVAAGESEYERYKKEEKEHKHKITEEIAATAAVGAGGYAFHEHHEKKKDHKDAEEASGEKKHHHLFG

SEQ ID NO: 42314 - DNA, 1314 bp, Panicum virgatum
  misc_feature: Ceres CLONE 2011472
  misc_feature: Encodes the peptide sequence at SEQ ID NO. 42315
agcagcagcagcagcggcagcttgtggccgtgccgcgctggcacgatcgagggcgccgcgcccctccaccaccaccacaacgagctgagacgacggcggaggagaggcggccatggccatggaggtggagtcgaggaacacgacgggcaggaagaagaagggcggcctcagaacaatgcccttcatcttcgccaacgaggtggcggagaagctcgccgtggtggggttctccaccaacatgctcacgtacctcaccacgcagctccacatgccgctcgccaaggccgccaccacgctcaccaacttcggcggcacctccgccgccacgccgctcatcggcgccttcctcgccgacgcctgcatcggccgcttctggaccatcgccgccgcctccgtcgtctaccaactcggcatggcgctgctgacggtgtcggcggcgctgccgcagttccggccttcgccgtgccggcccggcggcgcggcggcgtgccaggaggcggcgccgtggcagctggcggtgctgtacgcgtcgctgctcctcaacgcggtgggcgccggcgggtaccggccctgcatcgtggccttcggcgccgaccagttcgacgagtcgcgggcggcggagcgcgcgcgctcctggggcttcttcaactggtactacttctgcaacggcgcgtccatgctggtggccgtcacggcggtggtgtacgtgcaggacaacgtcggctggggatggggcctcggcgtgccggccgcctgcatggccgcctccgtcgccgccttcgccgccgggtacccggcgtaccgccgcctcgaccccgcggggagccccttcacgcggctcgcgcaggtggtcgccgccgccgccaggaagcggcgcctgccggcggccgacgtcgccaccgcggcgctgtacgagaacgacgacctcgacgcgcccatctccatgtacggcaagctcggccacacggaccagctcagcttcttcgaccgcgcggcggtggtcaccgacggcgacctggtcccgccggccgacgcctcctccggcaaaccgcccgtcccgaacccgtggcgcctgagcacggtgcaccgcgtggaggagctcaagtcggtgatccgcatgggccccatctgggcggcgggcatcctggtgatcacggcgtcgtcgacgcagcacaccttctccctgcagcaggcgaccaccatggaccgccgcctcgcgccgggcctctcggcgttccggatccccgcgggttctatgaccgtcttcgcgctgctcgccatgctcctcaccctcttcgcctacgaccgcgcgct

SEQ ID NO: 42315 - protein, 400 aa, Panicum virgatum
  misc_feature: Ceres CLONE 2011472
  misc_feature (87)..(400): Pfam Name: PTR2 Pfam Description: POT family
MAMEVESRNTTGRKKKGGLRTMPFIFANEVAEKLAVVGFSTNMLTYLTTQLHMPLAKAATTLTNFGGTSAATPLIGAFLADACIGRFWTIAAASVVYQLGMALLTVSAALPQFRPSPCRPGGAAACQEAAPWQLAVLYASLLLNAVGAGGYRPCIVAFGADQFDESRAAERARSWGFFNWYYFCNGASMLVAVTAVVYVQDNVGWGWGLGVPAACMAASVAAFAAGYPAYRRLDPAGSPFTRLAQVVAAAARKRRLPAADVATAALYENDDLDAPISMYGKLGHTDQLSFFDRAAVVTDGDLVPPADASSGKPPVPNPWRLSTVHRVEELKSVIRMGPIWAAGILVITASSTQHTFSLQQATTMDRRLAPGLSAFRIPAGSMTVFALLAMLLTLFAYDRA

SEQ ID NO: 42316 - DNA, 744 bp, Panicum virgatum
  misc_feature: Ceres CLONE 2011472-R
gcgccgccgcagggccgccgcggcggcggcggcggcgggcgccatggacgccggcacgtcgccgctgtccgcctactggctggtgccccagtacgcgctgcacggcgtggccgaggccttcacctccgtggggcacctcgagttcatgtacgaccaggcgcccgagagcatgcgcagcacggccacggcgctcttctggctgtccatctcgctggggagctacgcgagcacggtgctggtggccgccgtgcaccggtggagcgccggccccggcggcgccaactggctgccggacaacatcaactacggcaggctcgactactactactgggtcgtcacgatgctgcaggtcgtgaacctggtgtactacgccatttgcgccaagcggttcacgttcaagcccgtgcagctccgcatggaagccgacgaggaagaagaagaaggcggcaaggcactggtggagctgcaggagaaggtttgagcagcattgcaccgatgtgcaggtacaggtctactaaggtacaaagcaggtaactagattgtctgaaactccaggttgatgcatcagttgtagtcatgtactagatcaggagcagagggaaatattgtagtacctactagcaagcaacctcaaatttgtctgtgactagaaagaaggtactaggtaaccttgatgttattgcatatatgtgtgtaagcatctgcttgtacattatagggataaaaagagagattgttcaggcc

SEQ ID NO: 42317 - DNA, 1258 bp, Panicum virgatum
  misc_feature: Ceres CLONE 2011497
  misc_feature: Encodes the peptide sequence at SEQ ID NO. 42318
aatgaactaggctcgtacagatacagaggcgtcgatgggctcgtacagaggccgtccgcagctttgtttacatgccgccgctccgcagcctccgcgctcgccgccgctcgcagtcgtcgtcgccgccgcgcctccgcatgttcgctgtcgcaccactgccacttgcgcccgcagcttccgcgctcggcctccgcactcgccgctcggcgctcgccgctcgccgctcgcggagggatggggaggataggtacggcggcaacagggagaggggcgcggggtcgggcggacggggagaggccggggcaagcgaggaaatcgatcctcgattctcagatacgcggtcccgagcccgcgtcggagcaaatcgatgtattttcgatttccacataagtagcttctcaaataagcgagaaataagatgtttgggtgagattctcgtttattttcatcgataagcggatcataagcggaaacaaacaggtctagacggcggcggcgactttcgagatcttgttcctccgggctcttggttccctcctcatccggaggtcatctctgcgcgggatccgctgcgctcaggcgccggcgcagatcctagggtcggcgtcgggaaggccaccacgttctctccatatcctgagagatctcgacgctggcgttgggactattggtgcattagccgccggtgggttggctgcgttggtcggaattctctacttccaggaagatgaatctggtatgagttgatccgcctttagattcctatagttgttcgatccattccttgcattgtgactagtcatgaaacaccacatacctgttcctagctcgagaggtgaccgacaggaagggggacatcatccttgatgaaacaatcagggcaacgttcatggacagagacggcaacttcgcctggctcgagtacattgattacatcaacttccgaagaagacatcctgaagtaactgatccagaggtcctggataagatgcttaaaagaagatatactgcgtctgatgaggatgaagctgtgaagcaggataaactgaagatccagaagcatgagggtgtgaacatcgacgatgaagtgatgaaggtgagatttgaggactggatggagtatgacaaggcctacccgagtgaggaagagaaggctaggaggtgcaaagtatttaaggagaatgccatggcagccgacaaggctaatggatcattcacaaatggtgcccatcttgcacctaataatcttggggactgg

SEQ ID NO: 42318 - protein, 122 aa, Panicum virgatum
  misc_feature: Ceres CLONE 2011497
  misc_feature (72)..(122): Pfam Name: Inhibitor_I29 Pfam Description: Cathepsin propeptide inhibitor domain (I29)
  misc_feature: SWISSPROT Homolog: EC 3.4.22.33 Fruit bromelain
MDRDGNFAWLEYIDYINFRRRHPEVTDPEVLDKMLKRRYTASDEDEAVKQDKLKIQKHEGVNIDDEVMKVRFEDWMEYDKAYPSEEEKARRCKVFKENAMAADKANGSFTNGAHLAPNNLGD

SEQ ID NO: 42319 - DNA, 771 bp, Panicum virgatum
  misc_feature: Ceres CLONE 2011497-R
cagaggttcagggaactaaccgcaaggaaggctgagcaagatgcaagggaggctgaactaaccacaaggaagtcccaatgagtgccccagagagagaaggtaatggacactgtcaggcaaagcgtacgagccgtatcagcagaagatgatctcatgagcagtgtgtcgtgatcgctcaagtcaatgaaatacccactgatttatactgctagtcgatctaatgaatacaacacaaacttgtataaaaaagtcaggagtgaactgcattttggaacggagggagcagaagaaaaatccgctaaagagttcgacttctactaggtttcaggtcaaaaatcattgcaaccattcccccaaaaccttgcactatccaattgaaccatccatcaccagtgtatcagaagctgctcagcgcgaaggaatgtgttgatcagcgtcagcccttcggcaggcttgttgaggggcaccaggtgtcctgcgcccctgaccgtcaccatgctcgtgccatggtactccacgaacctcccggcaacctgcattccatgatttgctccttattttaggcttttcggctatcactgactgcagaagtgcagatacattcagtgcacaagaagttctgttagttctgttcataccttttgtcaaggtaccaggattgccactgggtcttgatcggcaggtcgagtgcctgcttccaaacagtaccgatcgatggattttaagcatgtacataagcacttgctataagattgcagacttgcagagccc

SEQ ID NO: 42320 - DNA, 760 bp, Panicum virgatum
  misc_feature: Ceres CLONE 2011507
  misc_feature: Encodes the peptide sequence at SEQ ID NO. 42321
aaaaaaaaaaaaaaattcccccacagcacacacagcagctaatccagactcacactactgcagcatttgctttgcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaagatcaactaaattaatcttacatcagatatgctgctacctgatggtgagaagcttggtccttcagaagatagcaacgagctatttattaggacaataaaataaagttgttaaggcatcgtcatcagcatcatctatactactttgtagtaataattaattaattaattaaatgttgtactcgatctgtgtgtacgtgcgcgtatacatacatgcatgcttatccgaacgatgtatatatatgtgctgcttctctcacaagtacgtgtgctc

SEQ ID NO: 42321 - protein, 126 aa, Panicum virgatum; identical to SEQ ID NO: 42057
  misc_feature: Ceres CLONE 2011507
  misc_feature (37)..(122): Pfam Name: Tryp_alpha_amyl Pfam Description: Protease inhibitor/seed storage/LTP family

SEQ ID NO: 42322 - DNA, 715 bp, Panicum virgatum
  misc_feature: Ceres CLONE 2011515
  misc_feature: Encodes the peptide sequence at SEQ ID NO. 42323
agagctaattgcgacggattcatggtctgccgcgcctgattccttatggcttccaattagcgcgcctagcggctcctgacgtccgtctagggcaaggcattcgctctgtccgcaagcatcccttcccctctcgattgaatcagatggagcttcctgagtgggttgacattgtgaagactgcgaggttcaaggagctccctccttatgaccttgactggtactacaccagggctgcctcgattgcaaggaagatctacctgaggcaaggcattggtgtgggtggattccagaaaatctacggtggccgccagaggaatggttcctgtccgccgcacttctgcaagagcagcggtgccatttcacgcaacatcctgcagcagttgcagaaaatgggcatcattgatgttgatcccaagggtggacggctcattacttcccagggaaggcgtgatctggaccaagtggctgggagggttgctgttgaagcttgagtagtatcatcttctgtttgaatggtgtcatgtttgatggttgagatggctactatatttgcagttttgaattaggacttgtactaccttttttgttctgagaatttaatgttaattcatcgagctatggagcagcactatatctttgctgaggatctaatgcaatatcagaactcctgaaccagagaagtgtttgagctgatatacataatgtgttttgcttc

SEQ ID NO: 42323 - protein, 115 aa, Panicum virgatum
  misc_feature: Ceres CLONE 2011515
  misc_feature (1)..(115): Pfam Name: Ribosomal_S19e Pfam Description: Ribosomal protein S19e
MELPEWVDIVKTARFKELPPYDLDWYYTRAASIARKIYLRQGIGVGGFQKIYGGRQRNGSCPPHFCKSSGAISRNILQQLQKMGIIDVDPKGGRLITSQGRRDLDQVAGRVAVEA

SEQ ID NO: 42324 - DNA, 695 bp, Panicum virgatum
  misc_feature: Ceres CLONE 2011520
  misc_feature: Encodes the peptide sequence at SEQ ID NO. 42325
gggcccacccagtagggataccccggtgggaaggggggaaaacaggagcagcagcagcagcagcagcaaccagcaagcggtggcaaggcggaatggtggtcgccgtcgcgtcgccctcgtcggcggcgccctctgccggccgcccccacccgacgtacaaggagatggtcgtgcaggcgctgacggagctgcgggacccgggcggctcgagccgccgcgccatcgccagctacatcgccgaccacttctccggcctccactctagccacgaggcgctcctctccgcccacctccgccgcctcaggtcccagggccaactacgcctcgtctccggcaactacttcctctccaccgacgctccccctccgcagcagcggcggggccccggccgcccgcccaagcagaagcgtggccgggggcggcctcgcaagaacgcagatttagctccttccgctccgattccgaaccttcaggggcccaagcgagggcctggacgcccgcggaaaaacgcacttgtcccagtggcttcatcatctgctttctcactgctgggagcaattgctgcgtcatctccatctggggtcaagcgggggcgtggacgcccacggaagaacgcccttggcccggtggctgatatctctgcttcgccgctgccgggagcgaccgcttcgccgcctccatctggggtcaagcgg

SEQ ID NO: 42325 - protein, 200 aa, Panicum virgatum
  misc_feature: Ceres CLONE 2011520
  misc_feature (18)..(87): Pfam Name: Linker_histone Pfam Description: linker histone H1 and H5 family
MVVAVASPSSAAPSAGRPHPTYKEMVVQALTELRDPGGSSRRAIASYIADHFSGLHSSHEALLSAHLRRLRSQGQLRLVSGNYFLSTDAPPPQQRRGPGRPPKQKRGRGRPRKNADLAPSAPIPNLQGPKRGPGRPRKNALVPVASSSAFSLLGAIAASSPSGVKRGRGRPRKNALGPVADISASPLPGATASPPPSGVK

SEQ ID NO: 42326 - DNA, 685 bp, Panicum virgatum
  misc_feature: Ceres CLONE 2011537
  misc_feature: Encodes the peptide sequence at SEQ ID NO. 42327
gcggccctgcgcggtcattctcagcctcggctcggcttcctccccatgaccccatccccacaccgcgacgcgtgcggaaaccctagccgccggtgatgtcggacccccgctacccgtactcccgaggcgctttgctaggcggcgacggcgagccgccgccgccgccgcggtactccgactttgaggtcgacctcatcgcggcccgttacgccgccgccccgccgcctccgccctacccctcctccgccgacgccagcgccttcgactcgcacgtcggcgccttcgactcgctagtcggtgccttcgactcacccgtcggcgccttcgactcgcactttggcactttcgactcgcacgccggtgcggggcgatccgcgggagctctctatcaccaatcttttatgggaagtcatagtactgttggccagaatgaggctttatattcatcaaatactatggctaaacgccctaggcttgaaagcagctttcctatgtatccacaacgaccgggggaaaaggactgtgccttctatatgaggaccagaacctgtaattatggagaggcctgcaaatttgaccatccacaatgggttccagagggtggagttccgaactggaaagagttccgtaacgttgaagattcttatcctgagcgaccagggggaccagattgtccttatttagt

SEQ ID NO: 42327 - protein, 196 aa, Panicum virgatum
  misc_feature: Ceres CLONE 2011537
  misc_feature (138)..(164): Pfam Name: zf-CCCH Pfam Description: Zinc finger C-x8-C-x5-C-x3-H type (and similar)
MSDPRYPYSRGALLGGDGEPPPPPRYSDFEVDLIAARYAAAPPPPPYPSSADASAFDSHVGAFDSLVGAFDSPVGAFDSHFGTFDSHAGAGRSAGALYHQSFMGSHSTVGQNEALYSSNTMAKRPRLESSFPMYPQRPGEKDCAFYMRTRTCNYGEACKFDHPQWVPEGGVPNWKEFRNVEDSYPERPGGPDCPYL

SEQ ID NO: 42328 - DNA, 706 bp, Panicum virgatum
  misc_feature: Ceres CLONE 2011547
  misc_feature: Encodes the peptide sequence at SEQ ID NO. 42329
ataccagtgtttccccatttgccctcaatcccggtccggccgccggccgccgcgccgccattccgccatggcgatggacaccacgactaggaggaggagaaggctggaaggggaggaagaggaggagggcctcgaccgcattagcggcctccccgacgccgtcctcggcgaaatcgtctcccttctacccaccaaggatggcgcccgcacgcaggtcctctcctcccggtggcggcccctatggcgctccgctcccctcaacctcgatccctgcggcctctcggtcggccgggagatctcccgcatcctctcggcgcacctgggccccggacgccgcttcttcatccccaggtacatcttgcgccccgaaggggaacgctcagccgcgaccctcctggatggctggctccggtctcctgccctcgacaacctacaggagctcgatttccactacggagataggtttccatatgctcaagtgagtccgccgccgccgctaccggcatcagtgcaccgcttctcgtcgactcttcgcgtcgccagcttcggcggctgcggcttgccggacggaaacgctaccgccctccactttccacttctcaagcagctgagccttttacatgttacaatctcggagagctctctgcatgccttgctcgccggctgccctgtcttacagagcttgctgctatctttcacagcggct

SEQ ID NO: 42329 - protein, 212 aa, Panicum virgatum
  misc_feature: Ceres CLONE 2011547
  misc_feature (23)..(70): Pfam Name: F-box Pfam Description: F-box domain
MAMDTTTRRRRRLEGEEEEEGLDRISGLPDAVLGEIVSLLPTKDGARTQVLSSRWRPLWRSAPLNLDPCGLSVGREISRILSAHLGPGRRFFIPRYILRPEGERSAATLLDGWLRSPALDNLQELDFHYGDRFPYAQVSPPPPLPASVHRFSSTLRVASFGGCGLPDGNATALHFPLLKQLSLLHVTISESSLHALLAGCPVLQSLLLSFTA

SEQ ID NO: 42330 - DNA, 522 bp, Panicum virgatum
  misc_feature: Ceres CLONE 2011552
  misc_feature: Encodes the peptide sequence at SEQ ID NO. 42331
attccgttccctgaccaaaacccccaaaccccaccccagccaagccgccaagcccaagcccccccatggcggcgccgaccccgaccaccgccgccgccgccgccacccaccaccgcatcctcctcccgtccccgtccccgtccccgcgcggcgccctcgcgcctgccttcctccgcctgccccaccgcgagcaggcccacgcccgcgcccagcgcgcgcgcctccccgcgcccctcgcggccgcggcgcccgcggcctccaccgcatcccccgaggcgccggcctcgggggccgtcccggggaagcccacggtgctcgtcgccgagaagctcggcgccgcggggctcgcgctgctgcgcgagttcgccaacgtcgactgctcctacggcctctcccccgaggagctccgcgccaagatctcgctctgcgacgccctcatcgtcaggtccgggaccaaggtcggccgcgacgtcttcgaggcctccgggggcaggctcctcgtcgtcggccgcgcgggggtcg

SEQ ID NO: 42331 - protein, 152 aa, Panicum virgatum
  misc_feature: Ceres CLONE 2011552
  misc_feature: SWISSPROT Homolog: EC 1.1.1.95 Phosphoglycerate dehydrogenase
MAAPTPTTAAAAATHHRILLPSPSPSPRGALAPAFLRLPHREQAHARAQRARLPAPLAAAAPAASTASPEAPASGAVPGKPTVLVAEKLGAAGLALLREFANVDCSYGLSPEELRAKISLCDALIVRSGTKVGRDVFEASGGRLLVVGRAGV

SEQ ID NO: 42332 - DNA, 623 bp, Panicum virgatum
  misc_feature: Ceres CLONE 2011558
  misc_feature: Encodes the peptide sequence at SEQ ID NO. 42333
attcctcccctcctccaacctcgcactacacttacctccataccgattttcttccactttcttcacttccgtcatcttctaacatttcgttttctctacagctgattcaggagacaattatcgcccgcgcaagaggtctcgttctcctcgtaggggtcgttcaagaagcccgaacactcgacgatcatattcgccgcgtgatcgatcgcgtagtcaaccccggagaagaagccggtctcctatgactggacagggcgcatctgcaggaggaacaggtccaggatacaacggcgccccccatcgatcatacgaagaccgctcggtacaccgtgaccaagccatgaacaacattcgcgagacgtcgcagcaggaccgtcgggtttacgtcggcaacctgtcctacgacgtaaaatggcaccatctcaaggactttatgagacaggctggagaggttctctatgccgacgtgctgcttcttcctaatggaatgtcgaagggatgcggaattgtggagtatgccacgagggagcaagcgcagcaagctgtatcgtcactcagcaaccagaacctcatgggcaggctcatctatgtccgagaggaccgcgaggctgagcccaggttcg

SEQ ID NO: 42333 - protein, 94 aa, Panicum virgatum
  misc_feature: Ceres CLONE 2011558
  misc_feature (14)..(84): Pfam Name: RRM_1 Pfam Description: RNA recognition motif. (a.k.a. RRM, RBD, or RNP domain)
MNNIRETSQQDRRVYVGNLSYDVKWHHLKDFMRQAGEVLYADVLLLPNGMSKGCGIVEYATREQAQQAVSSLSNQNLMGRLIYVREDREAEPRF

SEQ ID NO: 42334 - DNA, 679 bp, Panicum virgatum
  misc_feature: Ceres CLONE 2011559
  misc_feature: Encodes the peptide sequence at SEQ ID NO. 42335
cgtccggaaccccaaggtcatggagcgggcaacggcggaggtgcgacacgcctttgccgcgtacgggtcggtgcgggaggagaagctcgtggaggcggggctccagtacctgcccctcgtcatccaggagacgctccggctgcacacgccgctgccattcctgatcctgcaggagtgccaggacccctgccgagtgctgggctacgacgtgccgcagggcatcacggtgatggtgaacgcctgggcgctgggccgcgacgagcgctactggccgggggaccccgacgcgttccggccggagcggttcgaggccggcggcggaagcgcagcggacttcaagggcgccgacttcgagctcctgccgttcgggtccgggcggaggatgtgccctggcatgggctttgcgctcgccaacatggagctcgcgcttgccagcctcctcttccacttcgactgggaggtgcccggcgccgccgagctcgacatgaccgaggcgttcggcctcaccgcgcaccggaaatccaggctcctgctccgccccatcctccgcgttcctgtgccaggcgtctagccagtaggatggattgcatgctgggttcagacagccaggattcgggaagttgttatagccagaaccttgtacgtgttggttattgcgtgtccagctagttgtttgcat

SEQ ID NO: 42335 - protein, 189 aa, Panicum virgatum
  misc_feature: Ceres CLONE 2011559
  misc_feature: SWISSPROT Homolog: EC 1.14.13.68 4-hydroxyphenylacetaldehyde oxime monooxygenase
VRNPKVMERATAEVRHAFAAYGSVREEKLVEAGLQYLPLVIQETLRLHTPLPFLILQECQDPCRVLGYDVPQGITVMVNAWALGRDERYWPGDPDAFRPERFEAGGGSAADFKGADFELLPFGSGRRMCPGMGFALANMELALASLLFHFDWEVPGAAELDMTEAFGLTAHRKSRLLLRPILRVPVPGV

SEQ ID NO: 42336 - DNA, 666 bp, Panicum virgatum
  misc_feature: Ceres CLONE 2011583
  misc_feature: Encodes the peptide sequence at SEQ ID NO. 42337
accgtgcgatctcgcattcctctctccaatctctcgagcctttcctcctcgtccgtcccgagacactcgaagcccagcggcggccatggacaccaccggcaccggagctggcggcaaggtgaagaagggagccggtgggcgcaagaccggcgggccaaggaagaagtcggtgacgaggtccgtgaaggccgggctccagttccccgtcggccgtatcgggcgctacctcaagaagggccgctacgcgcagcgcgtcggcagtggtgcccccgtctacctcgccgccgtcctcgagtatctcgccgctgaggttctggagctcgccggcaacgcggccagggacaacaagaagacgcgcatcatcccccgccacgtgctcctggcgatccgcaacgacgaggagctcgggaagctgctctccggcgtcaccatcgcccacggcggcgtcctccccaacatcaacccggtcctgctgcccaagaagacggcggagaaggcgtccagcggcggcagcaaggaggccaagtcgccgaagaaggcggccaagtcccccaagaaggcatagagggtggacttaaatccaaatgtgtagcgccgtctcgtgtttcctgtgatgtttaggttgtagatgagggaaagttgtgggcggatatgagccagtggtgt

SEQ ID NO: 42337 - protein, 159 aa, Panicum virgatum
  misc_feature: Ceres CLONE 2011583
  misc_feature (31)..(104): Pfam Name: Histone Pfam Description: Core histone H2A/H2B/H3/H4
MDTTGTGAGGKVKKGAGGRKTGGPRKKSVTRSVKAGLQFPVGRIGRYLKKGRYAQRVGSGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 42338 - DNA, 686 bp, Panicum virgatum
  misc_feature: Ceres CLONE 2011585
  misc_feature: Encodes the peptide sequence at SEQ ID NO. 42339
atccatcgtcgtcgttatcaccgtcacatcagaaatccacctcgcaccggcgcgcaccatccatctatctgccgccgtcctcaccgtcgccacactccggcatccatccaccaccactccgtcaagtcacctaagcgagaatggccgcccgcttcgccgccgccctcgtcgcagtcctcgccctcttcgccgcagccgcaaaggcgcaggccccggccgcgacgcccaagagcgcgccggccccggcaccgcccaagatggccccgctgccgcggccgccgaccaagtccccggcggcctccccgcctgcgccgcccacggcgagcccggtctccgcgccctcggccgccgtcccggccatgagcccgttgggcgccggcgttggcgacgcgctgcccccggctggtgcctccgtgctgaccccggccgccgcgccggccaccgagaagagcaccgccgcatctgccaccgccgccaccagcttcgtcgccgttgccggtgctgtggtcgcagccgtagtgttctaggcggcgtggcctggtctggcagtgggggctgacgcgatcctttcgctgtttctgcgccttcggtgctctgctctgctcggctcggctcggctgttgatacatgtactctgtttcttcgtttttggcgattctttatttattatttatttagctgttatt

SEQ ID NO: 42339 - protein, 128 aa, Panicum virgatum
  misc_feature: Ceres CLONE 2011585
  misc_feature: Functional homolog of the protein sequence given in SEQ ID NO 50440
  misc_feature: Useful for making plants with altered carbohydrate content
MAARFAAALVAVLALFAAAAKAQAPAATPKSAPAPAPPKMAPLPRPPTKSPAASPPAPPTASPVSAPSAAVPAMSPLGAGVGDALPPAGASVLTPAAAPATEKSTAASATAATSFVAVAGAVVAAVVF

SEQ ID NO: 42340 - DNA, 726 bp, Panicum virgatum
  misc_feature: Ceres CLONE 2011590
  misc_feature: Encodes the peptide sequence at SEQ ID NO. 42341
atcccctgccgccgcagacgcttgctgcagcatctcctcccctcgctgctgctgctgcagcggcagccggcggccgggctgctgcagctgttcatcacctcccgcgttttacgccggtatcccaacagattctgagggaaaaagccatttttttcggcttctgtttgcctgccaccggtggcgttctccggcggcgcttcggatcgccgctgcttcgcctccctcttcctctccggcggcggcgaagaggggagggagacggactcatgaagggcctagtagttgtcctggcattgctgctggccgccgcgctcggctcggtccgcggcgaactggagctgcggcggctgcgggaccaggcgccgccggggtcgcgaccgcacagcgtcaccatcaccgagttcggcgccgtcggggacggcaagaccctcaacacggtgcccttccagaacgccgtcttctatgtccgctccttcgccgacaagggcggcgcgcagctgtacgtgcccaagggccgctggctcaccggcagcttcaacctcaccagccacctcaccctctacctggagaaaggcgccgtcatcatcggctcaaaggaatcatcacaatggccaattgtggaacctttgccatcttatggccaagggctagaccttccgggtcctagacatcgaagctaaataaatggatataacttaactgatgttgtcataaccggggaacaat

SEQ ID NO: 42341 - protein, 137 aa, Panicum virgatum
  misc_feature: Ceres CLONE 2011590
  misc_feature: SWISSPROT Homolog: EC 3.2.1.82 Exo-poly-alpha-galacturonosidase
  misc_feature: Functional homolog of the protein sequence given in SEQ ID NO 51645
  misc_feature: Useful for making plants with altered cell wall content and/or composition
  misc_feature: Functional homolog of the protein sequence given in SEQ ID NO 50944
  misc_feature: Useful for making plants with altered carbohydrate content
MKGLVVVLALLLAAALGSVRGELELRRLRDQAPPGSRPHSVTITEFGAVGDGKTLNTVPFQNAVFYVRSFADKGGAQLYVPKGRWLTGSFNLTSHLTLYLEKGAVIIGSKESSQWPIVEPLPSYGQGLDLPGPRHRS

SEQ ID NO: 42342 - DNA, 741 bp, Panicum virgatum
  misc_feature: Ceres CLONE 2011602
  misc_feature: Encodes the peptide sequence at SEQ ID NO. 42343
aaccgttgcgtccccaggaccagcccaccacccggaccccacccgctgacagacgccgccgcaccagcgcccaaatctcccaaaaccctaaagccgcggggccgagagagagggcgcgggggagagagagaggaggcgcgcggcatggcgggcgcgacgtccccgtcggcggccgcgaatctggcgggcaagtccggcgtccgcgtcgtcgtgatcggcgaccccggcaccggcaagtccagcctcgtcgtcgcgctcgccaccgagcaattccccgagaacgtgccccgggtcatgccccccacccgcctccccgccgactacttccccgaccgcgtccccatcaccatcatcgacacatcgtccagcccggagcagaagccgaagttgatcgcggagtgccaggcagccgatgcggtggtgctcacgtacgcctgcgaccggcccgccacgctggaacggctcagttcgttctggctccccgagctccggcgactccagttgaagactccagtgattgtggtggggtgcaaactggacctaagggatgagcagcaggttagccttgagcaggttatggcgcccatcatgcagtcattccgcgagattgagacctgcattgagtgctctgctcttcggcagatccaggtgcctgaggtcttctactatgcccagaaggcagtgcttcacccaactgctcctctctttgatcaagaaggccaatcactgaagcctcgctgt

SEQ ID NO: 42343 - protein, 198 aa, Panicum virgatum
  misc_feature: Ceres CLONE 2011602
  misc_feature (20)..(132): Pfam Name: Miro Pfam Description: Miro-like protein
MAGATSPSAAANLAGKSGVRVVVIGDPGTGKSSLVVALATEQFPENVPRVMPPTRLPADYFPDRVPITIIDTSSSPEQKPKLIAECQAADAVVLTYACDRPATLERLSSFWLPELRRLQLKTPVIVVGCKLDLRDEQQVSLEQVMAPIMQSFREIETCIECSALRQIQVPEVFYYAQKAVLHPTAPLFDQEGQSLKPR

SEQ ID NO: 42344 - DNA, 1327 bp, Panicum virgatum
  misc_feature: Ceres CLONE 2011616
  misc_feature: Encodes the peptide sequence at SEQ ID NO. 42345
aaacccgcttaccctgcatttcctccgcgcattttaatacttcccctcctcccctgcccggacggacgcgcactccaccaccaccaccaccaccgggcccgtctcgagatcccgcatcccaggccccgccgccgatggcgacgctaaaggtccccgccaccgtcccgacagcctccgacgactgcgagcagctccgcaaggcgttccaagggtggggcacgaacgaggcgctcatcatctccatcctgggccaccgcgacgccgcgcagcgccgcgccatccgccgcgcctacgcggagacgtacggcgaggagctcatccgctccatcaccgacgagatctcgggcgacttcgagagggccgtgatcctgtggacgctggacccggcggagcgggacgcggtgctcgccaacgaggcggccaggaagtggcagcccgggaaccgcgtgctcgtcgagatcgcgtgcacgcgcggctccgcgcagctcttcgccgtcaggcaggcgtaccacgagcgcttcaagcgctcgctggaggaggacatcgctgcgcacgtcaaaggagacttccgcaagctattggtgccacttgtaactgcataccgctatgatggaccagaggtcaacacaaggttggcacactcagaagccaaaatacttcatgagaagatccatcacaagtcttacagtgatgatgagatcatcagaatcctcaccactaggagcaaagctcagctgcttgctacattcaattattacaacgatgcatttggccacccaatcaacaaggatctgaaggctgatcccaaggacgagtacctcaagacactgcgggcgatcatccgttgcttcacctgccccgacaggtacttcgagaaggtcgccaggcaggcgatcgcggggctaggcacggacgagagctccctgacccgggtcatcaccacccgcgcagaggtggacctgaagctgatcaaggaggcgtaccagaagaggaacagcgtgccgctggagcgcgccgtcgcgggggacacctccggtgactacgagaacatgctcctcgcgctcctggggcaggagtgatcagccctctcgtgtcgcactgtcgctgctcggttcagtgctgtcgtttgtggtctgatcgcgggtaataaacctagtatgcgctgctgtaagccgttgtggacgtgtggttgtttcttcagtgctggtacagtgtggtaccgtcgctgcagcttgcattacagtggtgatcaaataaatgatgtctgcgatgaatcattgcatttgtttttgtagttatttgtggtcagtaagatagcgggatctcg

SEQ ID NO: 42345 - protein, 314 aa, Panicum virgatum
  misc_feature: Ceres CLONE 2011616
  misc_feature (245)..(310): Pfam Name: Annexin Pfam Description: Annexin
  misc_feature (15)..(80): Pfam Name: Annexin Pfam Description: Annexin
  misc_feature (87)..(152): Pfam Name: Annexin Pfam Description: Annexin
  misc_feature (170)..(235): Pfam Name: Annexin Pfam Description: Annexin
MATLKVPATVPTASDDCEQLRKAFQGWGTNEALIISILGHRDAAQRRAIRRAYAETYGEELIRSITDEISGDFERAVILWTLDPAERDAVLANEAARKWQPGNRVLVEIACTRGSAQLFAVRQAYHERFKRSLEEDIAAHVKGDFRKLLVPLVTAYRYDGPEVNTRLAHSEAKILHEKIHHKSYSDDEIIRILTTRSKAQLLATFNYYNDAFGHPINKDLKADPKDEYLKTLRAIIRCFTCPDRYFEKVARQAIAGLGTDESSLTRVITTRAEVDLKLIKEAYQKRNSVPLERAVAGDTSGDYENMLLALLGQE

SEQ ID NO: 42346 - DNA, 709 bp, Panicum virgatum
  misc_feature: Ceres CLONE 2011632
  misc_feature: Encodes the peptide sequence at SEQ ID NO. 42347
atcagtcgtgtgccagccacacgccccctgtctccctcctcctgcctctcactctgcgtgcccctctccagcaagatcatggggaaccacgcgcggatgctgcgccgcgtagccgccgcactcgtggccgtcgtggttgccggggttgcggtgtccgcgcaggcgccgccgccgccggtgacgagcgcgctgctgcagcaggtagcggcctcgctgcagatgtacgtggacccgctgccgcagatggccaagatccgcggctacggcttccagcagggtagcgtcgtgcccgtcaacctcaccatcggcatgttccaaaagaactggaaattccaccgcgacctgccggagacgccggtgttcgtgtacgggcaatgcgccgagaccgccacgttcccgggcccgacgatcgtcgcccgccacgacgtgccgctggcggtgacgtgggagaaccacctccccgaccgccacatcctgccgtgggaccccaccgtgcccaccgccatccccaagaacggcggcgtgcccaccgtcgtccacctccacggcagcgcccacccgccgcaggccgacggcagccccttcgcctggttcaccgcggggttccgcgagacggggccggcgtggtcgacgcccacgtaccggtaccccaacgtgcagccgcccgggcaactctggtaccacgaccacgcgctcggcctcacccgcg

SEQ ID NO: 42347 - protein, 210 aa, Panicum virgatum
  misc_feature: Ceres CLONE 2011632
  misc_feature: SWISSPROT Homolog: EC 1.3.3.5 Bilirubin oxidase
MGNHARMLRRVAAALVAVVVAGVAVSAQAPPPPVTSALLQQVAASLQMYVDPLPQMAKIRGYGFQQGSVVPVNLTIGMFQKNWKFHRDLPETPVFVYGQCAETATFPGPTIVARHDVPLAVTWENHLPDRHILPWDPTVPTAIPKNGGVPTVVHLHGSAHPPQADGSPFAWFTAGFRETGPAWSTPTYRYPNVQPPGQLWYHDHALGLTR

SEQ ID NO: 42348 - DNA, 707 bp, Panicum virgatum
  misc_feature: Ceres CLONE 2011641
  misc_feature: Encodes the peptide sequence at SEQ ID NO. 42349
tgagcatgctgcaagcgatcatgaaaggcttgtttatgaaggatggatattgtatgatactggccactgtgaggaaggattgcagaaagcagaagcatccatcgcaatacaaaggtcatttgaggcattttttctaaaagcctatgctttggctgattcaagtcttgaaccttcgacctcagcaacagttgtatcgcttctagaagatgcattgcggtgcccctcagatagactccgaaagggtcaggctctgaacaaccttggaagtgtttatgtggattgtgggaagctagacctggcagctgaatgctacattaacgccctgaagataggtcacaccagagcgcatcaaggtcttgcaagggttcatttccttcggaacaacaggatcggtgcatatgatgaaatgaccaaactaatagagaaggccaggaacaatgcatcagcatacgaaaagagatccgagtactgtgaccgggagctgacgaaagctgacttgcagatggtcaccaaacttgaccccctgcgagtctacccttacagataccgcgctgctgtgctaatggacaaccataaggagaaagaggccattgaggagctgacaaaggcaattgccttcaaggcagatctgaacctactccacctgcgcgcagccttccatgagcacattggcgacatttcgagcgccctccgggactgccgtgcgg

SEQ ID NO: 42349 - protein, 235 aa, Panicum virgatum
  misc_feature: Ceres CLONE 2011641
  misc_feature (81)..(114): Pfam Name: TPR_1 Pfam Description: Tetratricopeptide repeat
EHAASDHERLVYEGWILYDTGHCEEGLQKAEASIAIQRSFEAFFLKAYALADSSLEPSTSATVVSLLEDALRCPSDRLRKGQALNNLGSVYVDCGKLDLAAECYINALKIGHTRAHQGLARVHFLRNNRIGAYDEMTKLIEKARNNASAYEKRSEYCDRELTKADLQMVTKLDPLRVYPYRYRAAVLMDNHKEKEAIEELTKAIAFKADLNLLHLRAAFHEHIGDISSALRDCRA

SEQ ID NO: 42350 - DNA, 822 bp, Panicum virgatum
  misc_feature: Ceres CLONE 2011654
  misc_feature: Encodes the peptide sequence at SEQ ID NO. 42351
acccgaacggacggccgcacctgcacgcgccgccggatcgcgctccccaccttgccgccctccgccaccgcgctcccctcccgtagccgccggcgacccggcgtcctcgtcccccccgactcctcctccttcaacgacaactcgccggtcacccaaaggggctggggcaaccatgcccaaagtcaagaatcctcatgtcttcatggacatatcaatcggcggaggcactcccgagaggatcacattcgagctgtttgcaaatgtagtcccgaagaccgtggagaacttccgagcactttgtaccggtgaaaagggccttggagcatccacacagaaagcactctattataagggaacaaacatccatcgcatagttaaagagtttgttgctcagggtggtgatttttcaagaggagatggacgtggtggagagagcatttatggtggaaaatttccagatgaaaacttcaggctaatgcacgatgagcctggtgtgctgtccatggcaaattctggaccagacaccaatgggtcccaattttttataacattcaagcctctacctcatcttgatggcaagcacgtggtctttgggaaggtggtcagtggaatagatttgcttaagaagcttgaagcagttggtggtgaaattggaattcctactcgtcaagtgaaaattgtagactgtggtgaagtctctaacataaattctcaagatcagctacagggagagaaagagaagaagctaagaagagcaaatgctaactccaatgctgaagggagaaccaaatccaaaaaagcatccagtgatgataaacacag

SEQ ID NO: 42351 - protein, 216 aa, Panicum virgatum
  misc_feature: Ceres CLONE 2011654
  misc_feature (8)..(175): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MPKVKNPHVFMDISIGGGTPERITFELFANVVPKTVENFRALCTGEKGLGASTQKALYYKGTNIHRIVKEFVAQGGDFSRGDGRGGESIYGGKFPDENFRLMHDEPGVLSMANSGPDTNGSQFFITFKPLPHLDGKHVVFGKVVSGIDLLKKLEAVGGEIGIPTRQVKIVDCGEVSNINSQDQLQGEKEKKLRRANANSNAEGRTKSKKASSDDKH

SEQ ID NO: 42352 - DNA, 608 bp, Panicum virgatum
  misc_feature: Ceres CLONE 2011660
  misc_feature: Encodes the peptide sequence at SEQ ID NO. 42353
ctgcatttccttcttcccgtgggatcccagccgccgccgccgccgccgccgcgagaagaagagctcggcgactccccggtcgtacgagaagatgccgaagcagatccatgagatcaaggacttccttctcaccgcgaggaggaaggatgcccggtctgtgaagatcaagaggagcaaggatgttgtcaagttcaaggtgcgctgctccaagtacttgtacaccctctgcgtcttcgatgctgagaaggcaaacaagttgaagcaatcccttcccccaggtttgaccgtccaggaggtttgaagggacacaagacaacatcaagatgtgaactattaaagcttccttatcatcagcagagcattctcttcgatgtacctttggaacctaagcttttagacctgtcagtcatggatttgtagatcttggatttttggagaaataccattttaccgtattccaagatgctgcttttcagtttgattctttctgaactgcaagctgcttgagtatttgtttgtcctgcttcctttcggtttaccaatcagcaatttagatggatgtaagggagacatggttgcgtctacctttggctcaatttcctttctgc

SEQ ID NO: 42353 - protein, 69 aa, Panicum virgatum; identical to SEQ ID NO: 12286
  misc_feature: Ceres CLONE 2011660
  misc_feature (2)..(69): Pfam Name: Ribosomal_L38e Pfam Description: Ribosomal L38e protein family

SEQ ID NO: 42354 - DNA, 1345 bp, Panicum virgatum
  misc_feature: Ceres CLONE 2011661
  misc_feature: Encodes the peptide sequence at SEQ ID NO. 42355
ctgattaatgccttgcctcttttttgtagtctcctgctgaagctttctgaaaccactacatcaccatttgtttctatctaacattcggaggcattaagctcttccagtttgcaggggtcttcatcagttcatccaggcactttcttcaccacaggcagcaatggcgctagagaatggtgatgcagccgaattgagctccaaccagggtggtttggcagcgacgatgaagaatcgcaacagacctaagtattacccgtttactcagcagcagcttccagcttgcaagcctatacttgctcctcagacagttattcctctacttttgtttgtgggcataatttttattccgattggacttggttgcattgcagcatcaaatagggttgttgaagtggtctatcaatatgaaacttcatgtgtaccagggtacatgctaggcaacaaagttgcttatatccaagattcttctatagacaagacctgcacaaggattcttaaggttcctaaagatatgaagcaaccaatctacatatattatcaactggacaagttttaccagaaccatcgaaggtatgtgaagagccgtaatgataagcagctgagagatcctagggaggtcaacaacacacaatactgcaagcctgaagctactgaacatggaaggcctgttgtgccctgtggactcgtagcttggagcctgttcaacgacacgtacagcttcgctcgtggcaatgaggtgctgatggtcaacaagcgaggcatttcatggaggagtgaaagggaagacatttttgggaataaagtgtttccgaggaatttccagaatgggactctgattggtggcgggaggcttgatccaagattacctctgagcagacaggaagatctgatcgtctggatgcaaaccgcggcactcccaacattccggaagctgtacggaaggatcgaggtggacctccaggctgacgagctgatcacagtgacactgcagaacaactacaacacgtacagcttcggcgggaagaagacgcttgtgctgtcgactgccggcgtgctgggaggcaagaacggcttcctcggccacgcgtatgtggtcgtcggcctggcctgcctcctcctggcaacgatcctgacggtgctctgcctcgtcttcccactgagagaggagaatcttgcgctgcggtaccctgtgtcccggcttgcacgatgaccatgaatgcctaggtggggactggcgatatcgtgtaaagattgaagccgttttcttcttcaggcttgcatttgctcggttcgagagaacagcggcttgtcctgtgtgtataattgattggtccattgccatgcg

SEQ ID NO: 42355 - protein, 349 aa, Panicum virgatum
  misc_feature: Ceres CLONE 2011661
  misc_feature (68)..(339): Pfam Name: CDC50 Pfam Description: LEM3 (ligand-effect modulator 3) family / CDC50 family
  misc_feature: Functional homolog of the protein sequence given in SEQ ID NO 50291
  misc_feature: Useful for making plants with modulated nitrogen use efficiency
MALENGDAAELSSNQGGLAATMKNRNRPKYYPFTQQQLPACKPILAPQTVIPLLLFVGIIFIPIGLGCIAASNRVVEVVYQYETSCVPGYMLGNKVAYIQDSSIDKTCTRILKVPKDMKQPIYIYYQLDKFYQNHRRYVKSRNDKQLRDPREVNNTQYCKPEATEHGRPVVPCGLVAWSLFNDTYSFARGNEVLMVNKRGISWRSEREDIFGNKVFPRNFQNGTLIGGGRLDPRLPLSRQEDLIVWMQTAALPTFRKLYGRIEVDLQADELITVTLQNNYNTYSFGGKKTLVLSTAGVLGGKNGFLGHAYVVVGLACLLLATILTVLCLVFPLREENLALRYPVSRLAR

SEQ ID NO: 42356 - DNA, 675 bp, Panicum virgatum
  misc_feature: Ceres CLONE 2011672
  misc_feature: Encodes the peptide sequence at SEQ ID NO. 42357
aaaatatctcgccccgtcagcagcttcacgcacagcacagggagaaaaaggccggctagcgatggctgccaaggccgtctccttcctggtgctcgcgctcctgctcctcgccgtcgcggcgttccccgtggtggtcgtggccggcggcggcaacggcaaaggcaaagggaacggcggcggcggcaacctgaagccgtgggagtgctcgcccaagtgcgcgtcgcggtgctccaacacgcagtacaagaaggcctgcctcaccttctgcaacaagtgctgcgccacgtgcctctgcgtgcccccggggttctacggcaacaagggcgcctgcccctgctacaacaactggaagaccaaggagggagggcccaagtgcccctagatcagatcagatcccggccgtcattgttcctgctcctcctccgttggccgctgctgtcaagatccaccggcttacttacttactgatgatcccggcactgttcgtgctctgttctccccctagctgctaggtgtgctagtgatgcactggttgctgaatctggggatgctattccgagcagatctggatgccgtatcatgtgcttagtgcaactgttggtgaggcattagtgcagtttcagtgggaagtcatctactacacagttatttagattgaaattttaagaactgtgc

SEQ ID NO: 42357 - protein, 106 aa, Panicum virgatum
  misc_feature: Ceres CLONE 2011672
  misc_feature (3)..(106): Pfam Name: GASA Pfam Description: Gibberellin regulated protein
  misc_feature: Functional homolog of the protein sequence given in SEQ ID NO 51646
  misc_feature: Useful for making plants with altered alkaloid content
  misc_feature: Useful for making plants with modulated nitrogen use efficiency
MAAKAVSFLVLALLLLAVAAFPVVVVAGGGNGKGKGNGGGGNLKPWECSPKCASRCSNTQYKKACLTFCNKCCATCLCVPPGFYGNKGACPCYNNWKTKEGGPKCP

SEQ ID NO: 42358 - DNA, 1630 bp, Panicum virgatum
  misc_feature: Ceres CLONE 2011680
  misc_feature: Encodes the peptide sequence at SEQ ID NO. 42359
gggtcgcatggcctctgggaagggggagggcgccgccatgtcggacactgaatcggcggcagaggcggtccctgcggcagcgccggcggcagcggcggagcggaagccccggaggctgcgggggcacaagaagggcgccgtcacctgctgcgtcgcgtcctccgcccgcccgggcgtcgtcgcgtccgccggcgaggatggatgtctttgctggtttgatctgcgcaccaaagatgtgcttttgaccattgaggcagcaaataagccaatttcttcagtgtgctttaaacctggaaatgaagactttgtgtatgcctctgctggaaatgaaatattgtcctttgatgttcgtatgggacctcaatcaaaaccattagagacatataactacaatagagatgaaatcaatcagattgctgtcacctctaaaggttatctcgctgctgcagatgacagtggggatgttaagattgtcagtaccattcagaaatgcctgtataaaagattgagggaagcccacacaagtatttgcagcactgtacaattcattccttggagaccttggacagcaatcactggtggccttgactcgaagcttgctgcgtgggatttttccaaagggcgaacactattttctattgattacggatcacctgaattgcaaaatggcaattcttccggtagtgcagggcaatgtttcaaccctgcttttgttcattctctagcagtttctgaagagggcattttgggtgggttgtacaaagtttgtgctgttgcaagaggggatggagctgttgatgtagttgatctcgaatatgaactggcacctgctaaatcaaaaggacctcctcggacagcaacttcaacaatgagttcaaaaagaactgaacctggagatggaagcagtaatcaaggtcaagtgaaaaggatccatcttgatttcacattgggtggccatactgcagctgtgtcttgtgtagcattttcagcatttggtgagaaaggtaagttccttgtttcaggcggcaatgatgcatcagtgaagatatgggattggtccaaaggattttcttctgaaagaaacagtgatgctgaattggtattggatattgatgtgaagaaaaaggtaaattggttgtgtactaccccatccgattcagataatctgattgtgtgcgacacatccaaggtggtcaaagtatacaattttcggtagatagattaatggggcccatcaacctcttggacaattttctgaggtagtgaatgtttcctggccgtctgtctgtctgtcttgagttggtcctgactccggtttctagagacatgatgccaagcctgcagcagatatttctgagtcaatatttcaagattattgtttagcactttgcaatatcagttgcaggacagaatgaagccgctaaactatttattattttcttacaagacagatcttacttcgttgtgaacttgtgatattttttgtacttccacaggcttctagctagtctcggcatgtatatcttcattgtatgatgaaatgaatttatggttttcaagtaaaacctttgggcgctgttatggtacgcatggtttttcaagaagatattgagatgtgtatctttttgtc

SEQ ID NO: 42359 - protein, 392 aa, Panicum virgatum
  misc_feature: Ceres CLONE 2011680
  misc_feature (298)..(339): Pfam Name: WD40 Pfam Description: WD domain, G-beta repeat
MSDTESAAEAVPAAAPAAAAERKPRRLRGHKKGAVTCCVASSARPGVVASAGEDGCLCWFDLRTKDVLLTIEAANKPISSVCFKPGNEDFVYASAGNEILSFDVRMGPQSKPLETYNYNRDEINQIAVTSKGYLAAADDSGDVKIVSTIQKCLYKRLREAHTSICSTVQFIPWRPWTAITGGLDSKLAAWDFSKGRTLFSIDYGSPELQNGNSSGSAGQCFNPAFVHSLAVSEEGILGGLYKVCAVARGDGAVDVVDLEYELAPAKSKGPPRTATSTMSSKRTEPGDGSSNQGQVKRIHLDFTLGGHTAAVSCVAFSAFGEKGKFLVSGGNDASVKIWDWSKGFSSERNSDAELVLDIDVKKKVNWLCTTPSDSDNLIVCDTSKVVKVYNFR

SEQ ID NO: 42360 - DNA, 678 bp, Panicum virgatum
  misc_feature: Ceres CLONE 2011699
  misc_feature: Encodes the peptide sequence at SEQ ID NO. 42361
agcccctgcgccagcacacacacccacccggcagggagagagagcccctcggcggcggagaagatggtgtcgctcaagctgcagaagcgcctcgcctccagcgtgctcaagtgcggcaaggccaaggtctggctcgaccccaatgaagtcagcgagatctccatggccaactcccgccagaatatccgcaagttggttaaggatggtttcatcatcaggaagcctcagaagatccactccaggtcccgtgcaaggagggcgcatgaggccaagcagaagggacgtcattctggatatggtaagcgcaggggtacgagggaggctaggctccctaccaagattctttggatgaggaggatgcgtgttctgaggcgcctgctgcgcaagtaccgtgaagccaagaagatcgacaagcacatgtaccatgacatgtacatgaaggtcaagggtaacagtttcaagaacaagagggtgctcatggagagtatccacaagtccaaggctgagaaggctagagagaagacactctctgatcagtttgaggccaagcgcgccaagagcaaggcaagccgtgagaggaagattgccaggagggaggagaggttggcccagggcccgagggaacctgcagcagcttcagctccagctccggctgcagcggccccaaagaaggcaaag

SEQ ID NO: 42361 - protein, 204 aa, Panicum virgatum
  misc_feature: Ceres CLONE 2011699
  misc_feature (2)..(149): Pfam Name: Ribosomal_L19e Pfam Description: Ribosomal protein L19e
MVSLKLQKRLASSVLKCGKAKVWLDPNEVSEISMANSRQNIRKLVKDGFIIRKPQKIHSRSRARRAHEAKQKGRHSGYGKRRGTREARLPTKILWMRRMRVLRRLLRKYREAKKIDKHMYHDMYMKVKGNSFKNKRVLMESIHKSKAEKAREKTLSDQFEAKRAKSKASRERKIARREERLAQGPREPAAASAPAPAAAAPKKA

SEQ ID NO: 42362 - DNA, 688 bp, Panicum virgatum
  misc_feature: Ceres CLONE 2011702
  misc_feature: Encodes the peptide sequence at SEQ ID NO. 42363
ctcttctcgctcgctcgctcagatccggaagacttggggaaggagctgtgagcgcacgggatcgacctcgcgcagtggcaggtggctgggtgactacgacgggagcgggatatgggcctcctcgacaagctgtgggacgacaccgtcgcgggcccccgcccggacaccggcctcggccgcctccgcaagcagcccgcgcgccccgccgccgtgaagatcaatgatccggccgggggcgcggcggccttcgtcccgccgtcgccggcgtcgggcagcgaggagatgcccgtcaaggtgacgcgcagcatcatgatcaagcggcccgcggggtacccgtcgtcgccgaggagcgcggccagcacgccgccggcctcgccgctagggaccaccccgcccttctcgccgttcgccggcgccggtggccgcttcagaaggaaatcatcgtctgatgcttatgagagggcatccccaccagagacgaccagccgcactcctcccttcgaagtgtgagcacccagcatgctcacactcctttttgctccttgacaagtatctacttcgccaaaggtagaggaggaggagagaagacgtcaagaggggaacgggaataaaccacgggctgtcttacctctactgtgatatattgtagatgccgctatgcgtctggttttgcatccactctgtggct

SEQ ID NO: 42363 - protein, 132 aa, Panicum virgatum
  misc_feature: Ceres CLONE 2011702
  misc_feature (7)..(128): Pfam Name: Auxin_repressed Pfam Description: Dormancy/auxin associated protein
MGLLDKLWDDTVAGPRPDTGLGRLRKQPARPAAVKINDPAGGAAAFVPPSPASGSEEMPVKVTRSIMIKRPAGYPSSPRSAASTPPASPLGTTPPFSPFAGAGGRFRRKSSSDAYERASPPETTSRTPPFEV

SEQ ID NO: 42364 - DNA, 681 bp, Panicum virgatum
  misc_feature: Ceres CLONE 2011703
  misc_feature: Encodes the peptide sequence at SEQ ID NO. 42365
ctggtgactcctggcagcccacggctggcgcgtgcgctcacatctcagtattctaccaccctcctcttctaaccgctcgccccttccttccagatctacctgccctacctcgcagatccacccaccagttcgccggcgcttctgcggaggagctgaagcgcgcggcgatctctcctacgttgccgccatgatcaatttcgtgctcctgatcagccgccagggcaaggtgaggctcaccaagtggtactcgccttacacccagaaggagaggactaagatcattcgtgagctcagtggactcgttctaaccagagggcctaaactctgcaactttgttgagtggagaggttacaaggttgtatacaggaggtacgcgagcctgtatttctgcatgtgcattgatgcggatgacaatgagctcgaagtccttgaaatcatccatcatttcgttgagatactggaccggtattttggcagtgtatgtgagctggatttgatattcaatttccataaggcatactacatactggatgagattctcattgctggtgagcttcaagaatctagcaagaagaatgttgcaagacttattgccgcacaagattccttggtagaggctgcaaaagaagaagccagctctataagcaacatcattgctcaggctacaaaataaaagtatgc

SEQ ID NO: 42365 - protein, 161 aa, Panicum virgatum
  misc_feature: Ceres CLONE 2011703
  misc_feature (1)..(142): Pfam Name: Clat_adaptor_s Pfam Description: Clathrin adaptor complex small chain
MINFVLLISRQGKVRLTKWYSPYTQKERTKIIRELSGLVLTRGPKLCNFVEWRGYKVVYRRYASLYFCMCIDADDNELEVLEIIHHFVEILDRYFGSVCELDLIFNFHKAYYILDEILIAGELQESSKKNVARLIAAQDSLVEAAKEEASSISNIIAQATK

SEQ ID NO: 42366 - DNA, 733 bp, Panicum virgatum
  misc_feature: Ceres CLONE 2011722
  misc_feature: Encodes the peptide sequence at SEQ ID NO. 42367
acttgctgccgcgctcccctcccctcttccgtgcgcgtcccgtccaccgcgccctccccctgttcgccctcccctccccaccgcttacgccacgccgaaatcaccccgccgccgccgcggcgcccgtccatgcgctcctccccccacaattgacccacccgacaggccccccatccgcccctcccccatggatcgcaccatcagcagcagcagcagcgccaccacggcggccagccagaacccgcacctcggcgtcaacaagctcggccgcagcatccgcaaggccacgccgccgccgccgccgccgcagcagcagcccgccgcccgcccgccgcagccccagccgcaggtctacaacatcagcaagaaccagttccgcgacatcgtccagcagctcaccgccggcaccccgtccccgtcgcccccgccgccggcgcagccccggcctcagtaccacccccacccccaccgcccgccgccgccgcagtcgcagcccaagccgccctccatgcgcctccagaggatccgcccgcccccaatcgccacccccgtcgcgcgccccccgcccgtccaccccaaccaccacgccgtgccccccaaccctaaccacagcaaccccgtcttccaccgcccgccgccgccgcagccccagccccagcagcacatgcccgcgcccggccccgcctgggccgactccccggtctccgcgtacatgcgcatccttgagaactcc

SEQ ID NO: 42367 - protein, 181 aa, Panicum virgatum
  misc_feature: Ceres CLONE 2011722
  misc_feature (49)..(80): Pfam Name: VQ Pfam Description: VQ motif
MDRTISSSSSATTAASQNPHLGVNKLGRSIRKATPPPPPPQQQPAARPPQPQPQVYNISKNQFRDIVQQLTAGTPSPSPPPPAQPRPQYHPHPHRPPPPQSQPKPPSMRLQRIRPPPIATPVARPPPVHPNHHAVPPNPNHSNPVFHRPPPPQPQPQQHMPAPGPAWADSPVSAYMRILEN

SEQ ID NO: 42368 - DNA, 683 bp, Panicum virgatum
  misc_feature: Ceres CLONE 2011739
  misc_feature: Encodes the peptide sequence at SEQ ID NO. 42369
ttttcctgccatctccttccgctctccgctctccgcccgccccgcaccaccctcgccgccgccgcatcagccgccgcgatgcacaagacggcgcaggcctggtttaccggcggcaccgccgcctcttccgcggccgccagcgagtcgcagccgtccctcctcgccgactggaactcctacgccgccacccgctccgacgcctcctcctcctcctccccgctccccttcgacatcgaggccgccgtccgctcctcggtgaccaagggcgtgcgggagctaccggggagcttccagagcgcgaccagcagcttcccctcggggagggcgctcatgtacttcggcctcttcctcgccaccggcatcttcttcgtcttcatcgccttcgcgctcttcctccccgtcatggtgctcatgccgcagaagttcgccctcagcttcacgctcggatgcgcgctcatcatcgcctcgctcttcgcgctcaaggggccagccaaccagctcgcccacatgacctccaaggagaggctaccattctcagtgggttttattggatgcatggttagtacgatttatgtttcaatgatgcttcacagctatttcctctctgtgatcttctcagtccttcaggttctggcccttgcgtattataccatatcctacttccccggaggatctagtggatt

SEQ ID NO: 42369 - protein, 201 aa, Panicum virgatum
  misc_feature: Ceres CLONE 2011739
  misc_feature (78)..(201): Pfam Name: SFT2 Pfam Description: SFT2-like protein
MHKTAQAWFTGGTAASSAAASESQPSLLADWNSYAATRSDASSSSSPLPFDIEAAVRSSVTKGVRELPGSFQSATSSFPSGRALMYFGLFLATGIFFVFIAFALFLPVMVLMPQKFALSFTLGCALIIASLFALKGPANQLAHMTSKERLPFSVGFIGCMVSTIYVSMMLHSYFLSVIFSVLQVLALAYYTISYFPGGSSG

SEQ ID NO: 42370 - DNA, 667 bp, Panicum virgatum
  misc_feature: Ceres CLONE 2011740
  misc_feature: Encodes the peptide sequence at SEQ ID NO. 42371
gcgtcagttcttgctcatcaccccccccccccccctcccccaagccatcagcgactaattggaaggcccactcagagcagagagagagagagagagagagagagagagagagagagagagaggagccttacttcttcctcctccccggccgccggcggcgagagatcgacgagcgagcgagatggtgctgtcccacggcgtcggcggcggctccgatgagtcggtgcactcgacgttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggagcccgagtgcgacaagctcatccaggcctccctcaacaagaactacgtcgacatggacgagtaccccgtcaccaccgagctccagaatcggtgcgtgaacatgatcgcccatctgttcaacgcccctctcggcgattctgaaactgccgtcggggtcggcaccgtcggctcgtccgaggccatcatgctcgccgggctggcgttcaagaggcgttggcagaacaagatgagggccgccggcaagccctgcgacaagcctaacatcgtcaccggcgcc

SEQ ID NO: 42371 - protein, 161 aa, Panicum virgatum
  misc_feature: Ceres CLONE 2011740
  misc_feature (34)..(160): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Functional homolog of the protein sequence given in SEQ ID NO 50492
  misc_feature: Useful for making plants with modulated nitrogen use efficiency
MVLSHGVGGGSDESVHSTFASRYVRASLPRFRMPEQSIPKEAAYQIINDELMLDGNPRLNLASFVTTWMEPECDKLIQASLNKNYVDMDEYPVTTELQNRCVNMIAHLFNAPLGDSETAVGVGTVGSSEAIMLAGLAFKRRWQNKMRAAGKPCDKPNIVTG

SEQ ID NO: 42372 - DNA, 696 bp, Panicum virgatum
  misc_feature: Ceres CLONE 2011744
  misc_feature: Encodes the peptide sequence at SEQ ID NO. 42373
agagagagagagaagcgagagatttgcatcccgaggaagaatagtaagggaccaaagccgaaatcaaatccctggtgcccccttccttcccccacacgccgccgccgccgccgtgaggactccggcgaatggcgtcccgaatcgcctcgggcctcctccgccgccgcgccggcgccacactaggcctcctaaggagttatacacatgtcagaaactacagcagtcaactttcagctctgattccagctacttcccagtgctcaaagttgactagaaggcgttattacatgccaaatgcctctccgtaccaagtttggagtagatcgttttcttcagatgatggagacaaggttgaggctgttgtgccattcatgggtgaatctgtaactgatggaactcttgctaacttcttgaagaaacccggtgacagagtcgaggctgatgaggtcatagcacagattgaaactgataaggttactatagatgttgcaagtcctgaagctggtgttattgaaaagttcattgctagtaaaggtgacacagttactccaggcaccaaagttgcagtcatctcaaagtctgctcaacctgctgaaacacatgttgctccatctgaggaagcaactccaaaagattcctctccaccaaaagttgaagagaaaccaaaagtagaacctccaaagacgcaagcaccta

SEQ ID NO: 42373 - protein, 189 aa, Panicum virgatum
  misc_feature: Ceres CLONE 2011744
  misc_feature (75)..(148): Pfam Name: Biotin_lipoyl Pfam Description: Biotin-requiring enzyme
  misc_feature: SWISSPROT Homolog: EC 2.3.1.61 Dihydrolipoyllysine-residue succinyltransferase
MASRIASGLLRRRAGATLGLLRSYTHVRNYSSQLSALIPATSQCSKLTRRRYYMPNASPYQVWSRSFSSDDGDKVEAVVPFMGESVTDGTLANFLKKPGDRVEADEVIAQIETDKVTIDVASPEAGVIEKFIASKGDTVTPGTKVAVISKSAQPAETHVAPSEEATPKDSSPPKVEEKPKVEPPKTQAP

SEQ ID NO: 42374 - DNA, 1604 bp, Panicum virgatum
  misc_feature: Ceres CLONE 2011766
  misc_feature: Encodes the peptide sequence at SEQ ID NO. 42375
aacaaacgctaaaaaagtaacagtttctgtactttattgaagcgccccctcacgatggcccgagtcgccgcgatcgccacgatcgcgctgcttgccctttgtggccttgcgtccgcgaactctcagatcttcgccgagcgccaccgccacggtcgcgtgtaccgccgcgccgtggaggcggaggcggctcaccacgcgcgcctcggcttcacgccgaacatgacgaagaactggttcacgcagctcatcgaccacagcaaccctggcctcggcaccttccaggacaaattctactacgacacgacgtactggaacggcaccggcccgtgcatgttctacctcaacggcgagggcccgctgtccgcggcggtcggcggctacatggccgagatcgccaaatccatgaacgcgtgcacgctcaccatcgagcaccgctactacggcgagtctctgccgggcccgctgacggacaaggcgctcttcacgaaggtcctcacggtggatcaggcgatgcaggacgtcgctgcgctgatggactacttcgagacgacggtgatgcagaagaagatcacgtggttcctcgtcggcggctcgtacagcggcggcatgaccgtttggctcaacgagaagtacccgggcaagttcaaggcgtcgtgggccgcgtccggcgtcgtctacgccactttctcgtacacgaactacgacgggcacgtgaagaaggtgacgtcgcgcgagtgcggcaacgcgctcaagttcatcatggacgtcgcggccgcatggatggacgatgacgcgctgcgcccgcagctgctctcgatgttcaacatcccgtcgtaccacaccaagacggacgtcatgtgggccttcgccgacgcgtccgcgtcgagcgtccagtacggcatgaagaccgacatgtgcaacgcgatcctgcccgtgagcttcgagcacccgaagcaggcgctccagcagtacgcggcgatggtcgcggaccagtggggcagcgacttcatggcgtcgtgctactacagctcgaagtgcctcgcggacagcagcatgagctcgcaatgggggcctgccggctactcgtgggtctacgagtgctgtaacgagatggcgtggtggcagacgggctacccggactcgatccgcaacgagaacatcaccatcgcgtacttcatggaccagtgccgcggcgccttctacaacacgacgatgcccgacacgtgggccttcaaccagcgccaccacggctaccacccggagacgctcggctacatcgtcgcgacgcagggcagcgatgacccgtggagcacgacgggcctcgccgtcagccagggcccgacgttcccggtgaacacggcgcagtgcaccaactgcggccactgcgggtccatgatgagcccgacggacgaggacccggcgccgctgatagcgcagcgccagctcgtgctcacgtcgctgcagcagtggatggctcgtgcgtaacaccgcgcatcaggcagcaagagcagcctcgcggtagcacggcgcaatgtcgaatgaagccagtgatgacggcatgagattccgcgagtgtttgccctccgacttcaaattctcaagcg

SEQ ID NO: 42375 - protein, 476 aa, Panicum virgatum
  misc_feature: Ceres CLONE 2011766
  misc_feature (63)..(465): Pfam Name: Peptidase_S28 Pfam Description: Serine carboxypeptidase S28
  misc_feature: SWISSPROT Homolog: EC 3.4.14.2 Dipeptidyl-peptidase II
MARVAAIATIALLALCGLASANSQIFAERHRHGRVYRRAVEAEAAHHARLGFTPNMTKNWFTQLIDHSNPGLGTFQDKFYYDTTYWNGTGPCMFYLNGEGPLSAAVGGYMAEIAKSMNACTLTIEHRYYGESLPGPLTDKALFTKVLTVDQAMQDVAALMDYFETTVMQKKITWFLVGGSYSGGMTVWLNEKYPGKFKASWAASGVVYATFSYTNYDGHVKKVTSRECGNALKFIMDVAAAWMDDDALRPQLLSMFNIPSYHTKTDVMWAFADASASSVQYGMKTDMCNAILPVSFEHPKQALQQYAAMVADQWGSDFMASCYYSSKCLADSSMSSQWGPAGYSWVYECCNEMAWWQTGYPDSIRNENITIAYFMDQCRGAFYNTTMPDTWAFNQRHHGYHPETLGYIVATQGSDDPWSTTGLAVSQGPTFPVNTAQCTNCGHCGSMMSPTDEDPAPLIAQRQLVLTSLQQWMARA

SEQ ID NO: 42376 - DNA, 720 bp, Panicum virgatum
  misc_feature: Ceres CLONE 2011769
  misc_feature: Encodes the peptide sequence at SEQ ID NO. 42377
agccaagtggtggccgcactcacgcctgacgcgggaagccggccggaaccatccaacgcgcagcggccgccgcgtcgtcgtcgccgccgccgccgccgtgccgcctcgcctacagaaacaaacacgagctgcctaatattccacgccctcggaaccgcgcgacacgggcggcgaatcagatcacccccttcctccgcgcacctaccatccgggatcgcgaggtgggtttggaaccccgcggttgcgggtcgagtcaggttgtcttggtcccgtcctcgcgccggctccccttgccggccgaatccctcccgctccgtccccagggagcattttgtttcagtggtgtgcaagctttgttgattggagttcgcaatgggaggctgtgcggggaaggcacgccgtgaagaggaagataagcttgatttcaaaggtggaaatgtgcatatcataacaaccaaagagggttgggatcagaagattgcagaagcaaacagagatgggaaaaccgttgtggcaaatttcagcgcttcctggtgtggaccatgccgtgtcattgctcctgtctatgctgagatgtcaaagacttatcctcaactcatgttcttgacaatagatgttgatgacttgatggatttcagctcctcatgggatatccgtgcgaccccgacgttcttcttccctcagaacgggcagcagatcgacaagctggtcggcgctaac

SEQ ID NO: 42377 - protein, 115 aa, Panicum virgatum
  misc_feature: Ceres CLONE 2011769
  misc_feature (22)..(115): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGGCAGKARREEEDKLDFKGGNVHIITTKEGWDQKIAEANRDGKTVVANFSASWCGPCRVIAPVYAEMSKTYPQLMFLTIDVDDLMDFSSSWDIRATPTFFFPQNGQQIDKLVGA

SEQ ID NO: 42378 - DNA, 762 bp, Panicum virgatum
  misc_feature: Ceres CLONE 2011773
  misc_feature: Encodes the peptide sequence at SEQ ID NO. 42379
aacgcgtctatctcctccctctgtttcttgaaccgttcccttctctcggactctctcctgtctcctcccttactctcccttccctggcggcgacgaccgagcggcggcgtcatttgtcctgtcttggcccaaccctttgccagcgacgagcgcatcctccagtttcaacaatgaagatgatcgctgcctacctgctcgctgtcctgggtggaaacacttcccccactgctgatgacgttaagaacattctggaatcagttggggctgaagctgatgaagagaaactggacttcctgctcacagaactcaaaggcaaggacataacagaagtgattgcagctggaagggaaaagttcgcctccgtgccttcaggtggtggtgcaattgctgtgggagctccggctgctgcagctggtggtgctgcacctgctgaagaggcaaagaaggaagagaaggttgaagagaaggaggaatcagatgacgatatgggtttcagcttgttcgattaagcactgctgccctgcatgtagtttcttcgcacgtatggtctgatacaccggtcggtatcgtatggtctgatacaccggtcggtatccgcaaaataaccatgccgagaactagtatcagtgtgctattttgcttgtgataatggcatgtctagtactttggtgtcatgatatgcgagtatgcagtcctctgtgctatttcgtgtgtacatgtctagtaccattggcatcctgtgatggtagcatgtctttcagg

SEQ ID NO: 42379 - protein, 112 aa, Panicum virgatum; identical to SEQ ID NO: 12915
  misc_feature: Ceres CLONE 2011773
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 42380 - DNA, 729 bp, Panicum virgatum
  misc_feature: Ceres CLONE 2011783
  misc_feature: Encodes the peptide sequence at SEQ ID NO. 42381
acgtcacccctccaccgaaacgggagccccgcggcggcgcccccaaattccaaccctcccctgaaccctacctcctcctccctccccactccaatccaccccacgccatggccctttcccgccgcctcctcccgctcttcctccgcggtggtgcccccgccgtccgcgccctctccacggctgccgcgcccgcggcggcggcggcctcggaggaggaggaatccatcaccgtgaagggcgtccgcatctcgggccgcccgctgtacatggacatgcaggcgacgacccccgtggacccgcgggtgctcgacgccatgctccccttctacctctcccgctacgggaacccgcactcccgcacgcacctctacggctgggaatccgacgccgccgtcgaggccgcgcgcgcccgcgtcgcctccctcgtcggcgccgacccgcgcgagatcttcttcacctcgggcgccaccgagtgcaacaacatcgccgtcaagggcgtcatgcgcttctaccgcgaccgccgccgccacgtcatcaccacgcagaccgagcacaagtgcgtgctcgactcctgccgctacctgcagcaggaggggttcgaggtcacctacctccccgtgcgcagcgacgggctcgtcgacctcgcgcagctcgaggatgccatccgccccgacaccggcctcgtctcagtcatggccgtcaacaacgagatcggcgtcgtgcagccgc

SEQ ID NO: 42381 - protein, 207 aa, Panicum virgatum
  misc_feature: Ceres CLONE 2011783
  misc_feature (52)..(207): Pfam Name: Aminotran_5 Pfam Description: Aminotransferase class-V
  misc_feature: SWISSPROT Homolog: EC 2.8.1.7 Cysteine desulfurase
MALSRRLLPLFLRGGAPAVRALSTAAAPAAAAASEEEESITVKGVRISGRPLYMDMQATTPVDPRVLDAMLPFYLSRYGNPHSRTHLYGWESDAAVEAARARVASLVGADPREIFFTSGATECNNIAVKGVMRFYRDRRRHVITTQTEHKCVLDSCRYLQQEGFEVTYLPVRSDGLVDLAQLEDAIRPDTGLVSVMAVNNEIGVVQP

SEQ ID NO: 42382 - DNA, 734 bp, Panicum virgatum
  misc_feature: Ceres CLONE 2011790
  misc_feature: Encodes the peptide sequence at SEQ ID NO. 42383
actaagtctctccctccccaatccctccctccctcccgatcccctcttggatctcgccgcgcgctcgaaggcaagcgccgtcgcgatgcctgcggcggccgtccaaggcgtcggcggcgcggccgacgccgaggagctgttccgtaccaagcgcataccggagatccgcgcggcggagggcgccacccgccgcgagatctccgccaaggaggaggagctccggcagctcgtcggccgcagctaccgcgacctgctcgattccgcggactccatcctcctcatcaagcagtcctccgactccatctccgacaacctctcccgcatctccggctccctctcgtcgctctcaccgccgcccgagccctccccggccgcgagcgccgcctcgccgtccccgtccgctggcgggcgcgcgaggctctacgcgcttgccgcgcgcgccaagtacctggtcgacacgcccgagcacatctggggccggctcgacgagggcctcctcctggaggcggcggggcggtacctgcgggctcaggtcgtgcacgggcggctctcccgcgacgccgcggccgccgcgcggttcccgctcctcacgcaccaggcccagctcgtggaggcgttccggccgcagatcgcccagcgcgcgcgcgagcgcctcgccgaccgccgcctccccgtagcggcccacgctgacactctcgcggccgtggctgcgatcgacgcgccgtcgctcgccc

SEQ ID NO: 42383 - protein, 216 aa, Panicum virgatum
  misc_feature: Ceres CLONE 2011790
  misc_feature (8)..(90): Pfam Name: Vps51 Pfam Description: Vps51/Vps67
MPAAAVQGVGGAADAEELFRTKRIPEIRAAEGATRREISAKEEELRQLVGRSYRDLLDSADSILLIKQSSDSISDNLSRISGSLSSLSPPPEPSPAASAASPSPSAGGRARLYALAARAKYLVDTPEHIWGRLDEGLLLEAAGRYLRAQVVHGRLSRDAAAAARFPLLTHQAQLVEAFRPQIAQRARERLADRRLPVAAHADTLAAVAAIDAPSLA

SEQ ID NO: 42384 - DNA, 1213 bp, Panicum virgatum
  misc_feature: Ceres CLONE 2011807
  misc_feature: Encodes the peptide sequence at SEQ ID NO. 42385
gattgaaccggaccaacccgacccagtctcaagtctcaacccacctgcccctcttccacctcgccgccggcgatcgccgcagatgtcatggctcgcccgctccctcgccacatccctcaacatccccgacgattccagcgccgacgacgaccccgacgccgacgccgacgccgcggcctaccccaccccttccccctccgcgcgcatcccgccgccgcctccgccgctacctcctcacccgccgcattcggcggcggcggatggcgtcaaggaggacctcacggagctgtccaaaaccctaacccgccaattctggggcgtcgccaacttcctcgcgccaccgcccggagagacctcgccgtcgccgtcgccctgccctcagtcggcggggggtcaacccagcgatgtggggacgccgcctgagattgccgggatccggaacgacttcgcggagattggcgggaggttcaggaacgggatctcccggatctcgagtcacaaggccgtgactgggttatctaagatggcctccaatttcttcgctcctgaagatgacgaggacagcgagtgggaggaagagcggagacgaccgattaggtatgaggtgggagaggaggccgtaaggcatgatgtggagggcgacgagtggcatcagtgggaggagagggtaagacttgaggtggaggatgaccggttagggcatgagttgaagatggagagagtaaaacacgaagaggatggtgaattggaggcgcagagagtgagacatgaggagggtggtgcattcggggagcagagaggaaggcatgaggaggatggtgaattggaggagcagcgagcaaggcacgaggaggatgaggtggaggaggactgggatgtgattgggatcactgaggaggtgcttgcattcgccacaaacattgccagtcacccagaaacttggcttgacttcccgctgctgcctgatgatgagtctgatggaccattctcatattttgacatgtctaatgctcaacaagagcacgccttcactattgagcattttgctcccagattagcagctttgcggattgaactttgcccgattcatatgagcgaagaatgtttttggaaaatttactttgttcttctacatcctaggctgaacaagcatgatgccgaacttctttctacaccgcagattgtggaagctagagcaatgcttatgcaacac

SEQ ID NO: 42385 - protein, 376 aa, Panicum virgatum
  misc_feature: Ceres CLONE 2011807
  misc_feature (294)..(360): Pfam Name: BSD Pfam Description: BSD domain
MSWLARSLATSLNIPDDSSADDDPDADADAAAYPTPSPSARIPPPPPPLPPHPPHSAAADGVKEDLTELSKTLTRQFWGVANFLAPPPGETSPSPSPCPQSAGGQPSDVGTPPEIAGIRNDFAEIGGRFRNGISRISSHKAVTGLSKMASNFFAPEDDEDSEWEEERRRPIRYEVGEEAVRHDVEGDEWHQWEERVRLEVEDDRLGHELKMERVKHEEDGELEAQRVRHEEGGAFGEQRGRHEEDGELEEQRARHEEDEVEEDWDVIGITEEVLAFATNIASHPETWLDFPLLPDDESDGPFSYFDMSNAQQEHAFTIEHFAPRLAALRIELCPIHMSEECFWKIYFVLLHPRLNKHDAELLSTPQIVEARAMLMQ

SEQ ID NO: 42386 - DNA, 749 bp, Panicum virgatum
  misc_feature: Ceres CLONE 2011816
  misc_feature: Encodes the peptide sequence at SEQ ID NO. 42387
cgattccaaggtttgaacctgttttcaaaatataaaatatggctgcggttgatacaacagccaaggagatggaggcattgcatgttggacagaatgatgaaatgaatgagaatctgattaaaggggacaaagcttcaagcagcaatagtgcaactcttgcagctcagtcctcaccaccagaggatgatgatgatgaggcacaggctgatggtccatctcaagatggagcaccagctgtaaagaagaaaaagaagaaaaacaaatccaaaaagaagaaggacccccttcagcagacagatcctccatcaatacctgttgatgagcttttcccttcaggtgaatttcctgagggtgaaatccaacaatacaaggatgataatttatggagaacaactagtgaggaaaagagggagcttgaacgactgcaaaagccaatgtacaactctgttcgccgagcagcagaagttcatagacaggtccggaaatatatgaggagcatcataaagcctggaatgttgatggttgatctatgtgaaacattggaaaatatggtccgaaaacttatcaaggagaatggactgcaagctggcattgcctttccaactggatgctccttgaattgggttgcagcccactggactccaaatgcgggtgacaaaactgtactacaatatgatgatgtgatgaagcttgactttggaacacatatagatggggactttgttgaattgtgcatttactgttgcgtt

SEQ ID NO: 42387 - protein, 236 aa, Panicum virgatum
  misc_feature: Ceres CLONE 2011816
  misc_feature: SWISSPROT Homolog: EC 3.4.11.18 Methionyl aminopeptidase
MAAVDTTAKEMEALHVGQNDEMNENLIKGDKASSSNSATLAAQSSPPEDDDDEAQADGPSQDGAPAVKKKKKKNKSKKKKDPLQQTDPPSIPVDELFPSGEFPEGEIQQYKDDNLWRTTSEEKRELERLQKPMYNSVRRAAEVHRQVRKYMRSIIKPGMLMVDLCETLENMVRKLIKENGLQAGIAFPTGCSLNWVAAHWTPNAGDKTVLQYDDVMKLDFGTHIDGDFVELCIYCC

SEQ ID NO: 42388 - DNA, 741 bp, Panicum virgatum
  misc_feature: Ceres CLONE 2011826
  misc_feature: Encodes the peptide sequence at SEQ ID NO. 42389
agtcggctaatccccgtctccaccgagtcctcccatagtcccatccatccccctcctgaaaccggattggggcgaaccgtaccgcatcagaagaggtctcgtctagcagccgagttagcacgccggcgcggacggccatggaggacgaggaggacgaggagcacgaggtgtacggccaggagatccccgtcgacggcgaggacgtcgacatgtccggggccggcgacgacgccgccaagctgcaggagctcgacgagatgaagcgccgcctcaaggagatggaagaggaggcagccgcgctccgcgagatgcaggccaaggtcgccaaggagatgcaaggtgtagatcctaatgcaaccacatctgaaaacaaagaggagatggatgctcggtcagtattcgttggaaatgttgactatgcatgcactccagaagaagtacagcagcacttcaattcttgcggaactgtcaacagagtgacaatactgactgacaagtttgggcagcctaaaggttttgcttatgtggaatttgttgaagttgaagctgttcaggaagctattaagctgaacgagtcagagttgcatggccgccaactcaaggtggcaccaaagaggactaatgttcctgggatgaagcagccccgcggccgaggtttcaatccctaccatggccacccctacatgaggccatatggttatagtccttatggctatgggagattccccagattccgccgcc

SEQ ID NO: 42389 - protein, 201 aa, Panicum virgatum
  misc_feature: Ceres CLONE 2011826
  misc_feature (87)..(156): Pfam Name: RRM_1 Pfam Description: RNA recognition motif. (a.k.a. RRM, RBD, or RNP domain)
MEDEEDEEHEVYGQEIPVDGEDVDMSGAGDDAAKLQELDEMKRRLKEMEEEAAALREMQAKVAKEMQGVDPNATTSENKEEMDARSVFVGNVDYACTPEEVQQHFNSCGTVNRVTILTDKFGQPKGFAYVEFVEVEAVQEAIKLNESELHGRQLKVAPKRTNVPGMKQPRGRGFNPYHGHPYMRPYGYSPYGYGRFPRFRR

SEQ ID NO: 42390 - DNA, 677 bp, Panicum virgatum
  misc_feature: Ceres CLONE 2011842
  misc_feature: Encodes the peptide sequence at SEQ ID NO. 42391
gggtttccacaaccacaagctcttcttctacaacattgtcacgcgattgattagctagactagtagtaatccgctcgctgtacccctcttgttggcttgcgatcccccagctagtctctctactactactttttctgtccgagcgagcgagcgagctagctcacctacgacgacgacaatggagtgcgagaccgggctcgtccgctccctgcacggcgacggtctgtgcgcgccggcgccggcgccgcctgccgccgacccgctcaattggggcaaggccgcggaggacctgtccgggagccacctgggcgaggtgcagcggatggtggcggagttccgcgagccgctggtgcggatccagggcgcgagcctgagcatcgcgcaggtggccgccgtggccgccggcgccggcgaggcccgcgtcgagctcgacgagtccgcgcgcggccgcgtcaaggccagcagcgactgggtcatgagcagcatgatgaacggcaccgacagctacggcgtcaccaccggcttcggcgccacctcgcaccgccgcaccaaggagggcggcgcgctccagcgggagctcatcagattcctcaatgccggcgccttcggcaccggcgccgacggccacgtgctgccggcggaggccacccgcgcggcgatgctcgtgcgcatcaaca

SEQ ID NO: 42391 - protein, 166 aa, Panicum virgatum
  misc_feature: Ceres CLONE 2011842
  misc_feature: SWISSPROT Homolog: EC 4.3.1.5 Phenylalanine ammonia-lyase
  misc_feature: Functional homolog of the protein sequence given in SEQ ID NO 50787
  misc_feature: Useful for making plants with altered cell wall content and/or composition
  misc_feature: Useful for making plants with altered lignin content
MECETGLVRSLHGDGLCAPAPAPPAADPLNWGKAAEDLSGSHLGEVQRMVAEFREPLVRIQGASLSIAQVAAVAAGAGEARVELDESARGRVKASSDWVMSSMMNGTDSYGVTTGFGATSHRRTKEGGALQRELIRFLNAGAFGTGADGHVLPAEATRAAMLVRIN

SEQ ID NO: 42392 - DNA, 633 bp, Panicum virgatum
  misc_feature: Ceres CLONE 2011843
  misc_feature: Encodes the peptide sequence at SEQ ID NO. 42393
acgagatctcctccacgccgcatcctctctctctcggtcccggcgttcctctcctcagctcctcccgccggtgatagggccagtggcgccgcgccacctttggccagttcttcgttgggcgctgcgccgaggacgagcatccgacagggcatttcacaggggctcgtggtgtttctctgcagctgacaggaaattgacctttatctatctattccacattcttttgcgattatggcactagcagctatctacagccttttcatcattaacaaatccggtggccttatatactacaaggactatggttcagcagggaggatggacaccaacgacagtctaagattggcaagtctctggcattcaatgcatgctatctcccagcaactctcccctacccctggctgtaatggcattgacctcctgcaagcccataatttcgatcttcattgcttccaatccctgacaggtacaaaattttttgttgtatgcgagactggcgcaccaaatatggaaatgctgctgaaagtgatctatgagttgtacactgactttgttttgaagaacccgttctatgagatggagatgccgattcggtgtgagctctttgatctcaacctggcacaggtgatccag

SEQ ID NO: 42393 - protein, 133 aa, Panicum virgatum
  misc_feature: Ceres CLONE 2011843
  misc_feature (6)..(133): Pfam Name: Sybindin Pfam Description: Sybindin-like family
MALAAIYSLFIINKSGGLIYYKDYGSAGRMDTNDSLRLASLWHSMHAISQQLSPTPGCNGIDLLQAHNFDLHCFQSLTGTKFFVVCETGAPNMEMLLKVIYELYTDFVLKNPFYEMEMPIRCELFDLNLAQVI

SEQ ID NO: 42394 - DNA, 1055 bp, Panicum virgatum
  misc_feature: Ceres CLONE 2011855
  misc_feature: Encodes the peptide sequence at SEQ ID NO. 42395
agaaacgccggcttcacatcgccgatcgattcccgcgcccccaccccacgtcgccgaaaagcttgtctcgctcatccgcacaattaagccaccgctcgctggtttgttagttgttcttgcacaactctctgtctgtctctgctgccgtccttcctggtcaaatttatccgtcccctccgtcctcggctggcgccttttcgaaattccggcgggctgccgtcctccgcttgcgttcttgcccagttgcccgtccaggtcccgggcggtggtattaatcccgggatccagtcgtccctcgcttgggaaatcaagaaaggggaggaggcggcggcggcagaagaggctcaagaacagagatattgttgctgcgaacatcagagcactaggaaatccttttgagaagattggcatctggcaaccttcagaaaaccaagctcagatttttctcagtcctgacaacgaactcgtctgctcactgagcgcgcattacatatttacatgctggttgcggcgtcgctcatggcgacggagacgacggaccatctcgccagaggacagcagccggcgaggcggcagcagggagggaggcccgccgtcggcgtcgccgcggcagccaagcaggggcagcgacagaacgtgccgacgccggcggcgggcgggcttagcgcggaggcgttgctggtgctggcgtgcgtggccgtgtcgctcatcgtgctgccgctggtcctgccgccgctgccgcccccgccgccgctgctgctgctggtgcccgtgtgcctgctcctgctcctcgccgcgctggccaccttcgtgccgtcggatgtcaggaccatggcatcctcctacttgtagttgtatacttgtattgtaagaaaaaaaaactgcaattctttttgttccggcctttttttttggtctttctgtgtatggcgtaaaatgagttaggtaaatggaaattttattttcttttttctgaaatgggaaatgaggtcgagcaagaatgccacacttgtgggggcctttctgcgttctatctgatatacattggcagaacc

SEQ ID NO: 42395 - protein, 117 aa, Panicum virgatum
  misc_feature: Ceres CLONE 2011855
  misc_feature: Functional homolog of the protein sequence given in SEQ ID NO 50534
  misc_feature: Useful for making plants with modulated biomass
  misc_feature: The sequence is a functional homolog of SEQ ID NO 2 in US patent 7151206
MLVAASLMATETTDHLARGQQPARRQQGGRPAVGVAAAAKQGQRQNVPTPAAGGLSAEALLVLACVAVSLIVLPLVLPPLPPPPPLLLLVPVCLLLLLAALATFVPSDVRTMASSYL

SEQ ID NO: 42396 - DNA, 666 bp, Panicum virgatum
  misc_feature: Ceres CLONE 2011869
  misc_feature: Encodes the peptide sequence at SEQ ID NO. 42397
cactgaagaaatcacagcttctcttgaagagatgataaagaaaagaattgcagagggtcattttgatgatgttgagaagccttctctcattctatctaaagctcccaaggagcgtaaggaactggatgaaagtaagagcaaaaagggtcttgctgaactgtatgaggatgattatgcacaaaaagcaggcattgcacctgcccctctatctatttcagatgaactaaagaaagaggcaaatactttatttaagaggatatgcttgaagttggatgcgctatcacatttccacttcgctccaaagccggtcattgaagatatgtctgtacaagctaatgtgccagccttagcaatggaagagattgcacccgtagctgtttctgatgctacgatgctagctcctgaagaaatatttgaaggaaaaggcgatattaaggaagagggggaacttacacaggctgagcgtaaaagaagaagagccaacaagaaaaggagatatgcaggatcacacaaggagaggccagctaagttgcagaaagattagacccaatgtttgtgaagcaaggactgcctgcacgccactgttgtgtcctaaatgtccgatattgacttggaaaggggtccaagagcggtaactacagatttccaatgctgattgtacacctg

SEQ ID NO: 42397 - protein, 180 aa, Panicum virgatum
  misc_feature: Ceres CLONE 2011869
  misc_feature: Functional homolog of the protein sequence given in SEQ ID NO 51647
  misc_feature: Useful for making plants with modulated heat sensitivity
  misc_feature: Functional homolog of the protein sequence given in SEQ ID NO 50935
  misc_feature: Useful for making plants with altered alkaloid content
TEEITASLEEMIKKRIAEGHFDDVEKPSLILSKAPKERKELDESKSKKGLAELYEDDYAQKAGIAPAPLSISDELKKEANTLFKRICLKLDALSHFHFAPKPVIEDMSVQANVPALAMEEIAPVAVSDATMLAPEEIFEGKGDIKEEGELTQAERKRRRANKKRRYAGSHKERPAKLQKD

SEQ ID NO: 42398 - DNA, 649 bp, Panicum virgatum
  misc_feature: Ceres CLONE 2011881
  misc_feature: Encodes the peptide sequence at SEQ ID NO. 42399
aactcccgccgccgccgcaccccctcttcgtcgctctcctcgccttgctcgcgtcgccgccacctcctccgccatggccccgaagaaggacaaggccccgccgccgtcgtccaagccggccaagtccggaggcgggaagcagaagaagaagaagtggagcaaggggaagcagaaggagaaggtcaacaacgcggtgctcttcgaccaggccacctacgacaagctgctctccgaggttcccaagtacaagcagatcaccccgtccgtcctctccgagcgcctcaggatcaatggatccttggcgcggagggccatcaaggacctgatggcaagggggcttataaggatggtcactgttcattccagccagcagatatacaccagggcaaccaacacatgagcgtcttttcaggcgttatctagtctagaggacttatgtttctgttatatcaagtttatttcaatcatggctcagtcgatgttaccattgatgtggagaatgttgaatgcgtttgagattatggtacaattttaagctcatgctgctatcctaatttttaaattgatgtgggatctttgctcttctcattgcaaatgttgttaaactgctgtgttatcattaattcatgatattatttaactgctgctc

SEQ ID NO: 42399 - protein, 108 aa, Panicum virgatum
  misc_feature: Ceres CLONE 2011881
  misc_feature (1)..(106): Pfam Name: Ribosomal_S25 Pfam Description: S25 ribosomal protein
MAPKKDKAPPPSSKPAKSGGGKQKKKKWSKGKQKEKVNNAVLFDQATYDKLLSEVPKYKQITPSVLSERLRINGSLARRAIKDLMARGLIRMVTVHSSQQIYTRATNT

SEQ ID NO: 42400 - DNA, 591 bp, Panicum virgatum
  misc_feature: Ceres CLONE 2011885
  misc_feature: Encodes the peptide sequence at SEQ ID NO. 42401
ctcctcctccgcggacgcgctcttcatcaccaacaccggcaagaagaagcgctaccaccgccacaccgcgcaccagatccagcagatggaagcgctgttcaaggagtgcccgcacccggacgacaagcagcggctgaagctgagccaggagctggggctcaagccccgacaggtcaagttctggttccagaaccggcgcacgcagatgaaggcgcagcaggaccgcgccgacaacgtcctcctccgcgccgagaacgagagcctcaaggccgacaactaccgcctgcaggccgccatccgcaacgtcgtctgccccacctgcggccacgccgccgtcctcgccgagatgtccttcgaggagcagcagctccgcgtcgagaacgccaggctcaaggacgagctcgaccgcctggcgtgcatggcgacacggtacggcggcgggcgccagccgggcatgtcgtcgtccgcgctgggctgcatatcggcgccggcgccgcatctgctcatgccgccgctcaacctcgacatgagcgtctattcgcgccatttcacggaccaatctccggtcatggggtgcggcgacctcatcca

SEQ ID NO: 42401 - protein, 196 aa, Panicum virgatum
  misc_feature: Ceres CLONE 2011885
  misc_feature (15)..(71): Pfam Name: Homeobox Pfam Description: Homeobox domain
  misc_feature: The sequence is a functional homolog of SEQ ID NO 244 in the 10/666,642 US patent application
  misc_feature: The sequence is a functional homolog of SEQ ID NO 540 in the 11/435,388 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
SSSADALFITNTGKKKRYHRHTAHQIQQMEALFKECPHPDDKQRLKLSQELGLKPRQVKFWFQNRRTQMKAQQDRADNVLLRAENESLKADNYRLQAAIRNVVCPTCGHAAVLAEMSFEEQQLRVENARLKDELDRLACMATRYGGGRQPGMSSSALGCISAPAPHLLMPPLNLDMSVYSRHFTDQSPVMGCGDLI

SEQ ID NO: 42402 - DNA, 582 bp, Panicum virgatum
  misc_feature: Ceres CLONE 2011891
  misc_feature: Encodes the peptide sequence at SEQ ID NO. 42403
gagaagcgtatctatattccacttccagactttgaaagtagaaaggcacttatcaacattaaccttagaacagttcagatagctgcggatgttaacatagatgaagttgctcggaaaacagaaggttacagtggagatgaccttacaaatgtttgccgtgacgcttcaatgaacggtatgaggcgaaagatagccggcaagactcgcgatgagatcaagaacatggcaaaggatgagatagcgaaggatccagtggccatgtgtgactttgtggaggctctggacaaggtccagaagagtgtctcacctgctgacatagaaaaacatgagaagtggatggcggagtttggatctgcatgagacctatgctcccgttcaaagttctgcaaatcttcaatcttcttcacccttttgtgtgctgtgccggtttttccaatcaattgcagtgacatcaatgacacctgttgactgttatgtgcgttggtggtgtcgtagcatagaccagagtcaggtttgtccacagaaccatcctgttgattttcagtggcggtaggaattaaattctcgattatttcagttctt

SEQ ID NO: 42403 - protein, 119 aa, Panicum virgatum
  misc_feature: Ceres CLONE 2011891
  misc_feature (67)..(117): Pfam Name: Vps4_C Pfam Description: Vps4 C terminal oligomerisation domain
  misc_feature: SWISSPROT Homolog: EC 3.6.4.3 Microtubule-severing ATPase
EKRIYIPLPDFESRKALININLRTVQIAADVNIDEVARKTEGYSGDDLTNVCRDASMNGMRRKIAGKTRDEIKNMAKDEIAKDPVAMCDFVEALDKVQKSVSPADIEKHEKWMAEFGSA

SEQ ID NO: 42404 - DNA, 697 bp, Panicum virgatum
  misc_feature: Ceres CLONE 2011892
  misc_feature: Encodes the peptide sequence at SEQ ID NO. 42405
cagcctgcagttaagttaacagtagccgagtgagctgtgagcaccgccaccgccgcccacctcatgtcctcatcctcatcaatggcggcgaggagactcctggcggcggcgttcctggcgctggcggtgccggcggtgctgtgccaggcgcccggcccggcggcgcccaagggcccgccgaacgtgacggcgatcctggagaagggcgggcagtacgcgaccttcatccggctgatgaaggcgacgcagcaggacacacagctcaacagccagctcaacaactccttcggcagcggctacaccgtgttcgcgcccaccgacaacgccttcaacagcctcaagcccggcacgctcaacaagctgtcgcagcaggagcaggtgtcgctggtgcagtaccacatcctcccgcagttctactcgctcgactccttcgagaccgccagcaaccccgtccgcacccaggcgtccggctccgacgggccctacacgctcaacatcaccgccgacagcaacagccaggtgaacgtctccacggggctcgtcgccaccagggtgggcacagcgctgcgcgacacgcagccgctcgccgtctactccgtcgacaaggtgctcctgcccaacgacctgttcggcgtgaagcccccgtcgtccgcgccgcccgcgcccaccaagaagccggccaaggggggcctccgtg

SEQ ID NO: 42405 - protein, 205 aa, Panicum virgatum
  misc_feature: Ceres CLONE 2011892
  misc_feature (44)..(179): Pfam Name: Fasciclin Pfam Description: Fasciclin domain
  misc_feature: Functional homolog of the protein sequence given in SEQ ID NO 51625
  misc_feature: Useful for making plants with altered carbohydrate content
  misc_feature: Functional homolog of the protein sequence given in SEQ ID NO 51626
  misc_feature: Useful for making plants with altered cell wall content and/or composition
MAARRLLAAAFLALAVPAVLCQAPGPAAPKGPPNVTAILEKGGQYATFIRLMKATQQDTQLNSQLNNSFGSGYTVFAPTDNAFNSLKPGTLNKLSQQEQVSLVQYHILPQFYSLDSFETASNPVRTQASGSDGPYTLNITADSNSQVNVSTGLVATRVGTALRDTQPLAVYSVDKVLLPNDLFGVKPPSSAPPAPTKKPAKGGLR

SEQ ID NO: 42406 - DNA, 713 bp, Panicum virgatum
  misc_feature: Ceres CLONE 2011904
  misc_feature: Encodes the peptide sequence at SEQ ID NO. 42407
  misc_feature (610)..(610): n is a, c, t, g, unknown, or other
agaacacgagtcgtcttccactccgccctcactcctcattcctcaacggctcaggcagccagatccagatcccgcggcgaggggaagaagaggctcccattgtcgggttggtcaggacttcaggagttacttggatagtttaagaaagatggtgaagatatgctgcctcggtgctggatatgttggcggcccaaccatggctgtcattgcgctgaaatgccctgctattgaagtttgtgtcgtcgacatttctgttccacgcattgcagcatggaacagcgatcagctccctatttatgaaccgggccttgatgaagtggtcaagcagtgccgtggcaggaaccttttcttcagcaatgacattgagaagcatgttgctgaggctgatatcatctttgtctctgtgaacacaccaaccaagacccgtggtcttggggctggcaaagctgcagatttaacctactgggagagtgcagcccgcatgatcgcagatgtggccaagtctgacaagattgtggttgagaagtccactgtccctgtcaagactgctgaagccattgagaagatcttgacacacaatagcaagggaatcaacttccagatcctctcnaatcctgaattccttgcagagggcacagcaattgaggaccttttgaagcctgaccgtgtgctcatcggtggccgggagactccagaaggccagaaggctgtta

SEQ ID NO: 42407 - protein, 188 aa, Panicum virgatum
  misc_feature: Ceres CLONE 2011904
  misc_feature (2)..(186): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 51302
  misc_feature: Useful for making plants with altered carbohydrate content
  misc_feature: Functional homolog of the protein sequence given in SEQ ID NO 50761
  misc_feature: Useful for making plants with altered cell wall content and/or composition
MVKICCLGAGYVGGPTMAVIALKCPAIEVCVVDISVPRIAAWNSDQLPIYEPGLDEVVKQCRGRNLFFSNDIEKHVAEADIIFVSVNTPTKTRGLGAGKAADLTYWESAARMIADVAKSDKIVVEKSTVPVKTAEAIEKILTHNSKGINFQILSNPEFLAEGTAIEDLLKPDRVLIGGRETPEGQKAV

SEQ ID NO: 42408 - DNA, 665 bp, Panicum virgatum
  misc_feature: Ceres CLONE 2011910
  misc_feature: Encodes the peptide sequence at SEQ ID NO. 42409
gtctatctgctctggtaactgactacagccttcacaggctgatgactccaactggcatggccgagcaggtcctaaacgctggtgcactaggctattccccacctgagttttcaagcaccagcaagccatgcccgtctcttaaaagtgatgtgtacgctattggtgtcattctgctcgagctgctgacagggaagattgctggtgagatcatctgtgtgaacgacggcgtggtcgatctgacggactgggtgaggatgttagcactggaggagcgtgtctcggagtgctacgaccagcacattgtgcaagctgggagctcagacggcggcccaaaggtgcttgatgacatgctgcacattgcgatccggtgtatccggtctgcatctgagaggccggagatccggacggtgttcgaggacctttcgtccttgtcatcgtgatcggagttcttggtagtgtacatctcgtacttacatcagcttgtggaaacttagagagggtatactaacgattgctaggattttgtggtggtgtgtgtagtctccttgatcattcgttggttgggttgctcttcctgggaatagtatattcgtctttaggtagtccacaatttttagcagtagatgattgtgagaataagtttgtgcattgtgatttcagacatc

SEQ ID NO: 42409 - protein, 145 aa, Panicum virgatum
  misc_feature: Ceres CLONE 2011910
  misc_feature: SWISSPROT Homolog: EC 2.7.11.1 Non-specific serine/threonine protein kinase
LSALVTDYSLHRLMTPTGMAEQVLNAGALGYSPPEFSSTSKPCPSLKSDVYAIGVILLELLTGKIAGEIICVNDGVVDLTDWVRMLALEERVSECYDQHIVQAGSSDGGPKVLDDMLHIAIRCIRSASERPEIRTVFEDLSSLSS

SEQ ID NO: 42410 - DNA, 766 bp, Panicum virgatum
  misc_feature: Ceres CLONE 2011918
  misc_feature: Encodes the peptide sequence at SEQ ID NO. 42411
gctgctgacgtgcaatccccgagctccgccaccccaccccacccgctcccccaaaaccccattcctccggcgagcgatccccgagctccggcgagatgcagatcttcttgaagacgctgaccgggaagacgacgacgctggaggtcaagagcagccacaccgtcgccaacatcaaggccatgatccaggacaaggaaggcatccctccggaccgtcagcggctcatcttcgccgggaagcagctggaggacgagcgcacactcgccgactacagcgtccagaaggagtcgacgctgcacctggtgctccgcctcagcggcggcggcaagggcggcagctaccacaggaacgtcgagcccaacctcctccagctcgcgctcaagtaccgtcgtcagcgcaacatgatctgccgcgagtgctacgcccgcaatcccatcagggcctacaactgccgcaagaagaagtgcggccacttcaacgagctgaggttaaagaagaagctggcttacaaggactaaaaaggaatgcagcaacatcagaaagtgatcaatccatgtgtcgttcatcagttgaatcctagtgtgtcttattactaatgtttgcatactgtctgaatagaagtttatcctagtctaattttcatgctggagtacttatctgagcaatggcatgtagcctaagatcaaactgctagtttaagatcgctgtctattgttggaccttcgttgttgatattcaatgcaagtaaacgtactacgtgaatctc

SEQ ID NO: 42411 - protein, 140 aa, Panicum virgatum
  misc_feature: Ceres CLONE 2011918
  misc_feature (6)..(74): Pfam Name: ubiquitin Pfam Description: Ubiquitin family
  misc_feature (85)..(137): Pfam Name: Ribosomal_L40e Pfam Description: Ribosomal L40e family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFLKTLTGKTTTLEVKSSHTVANIKAMIQDKEGIPPDRQRLIFAGKQLEDERTLADYSVQKESTLHLVLRLSGGGKGGSYHRNVEPNLLQLALKYRRQRNMICRECYARNPIRAYNCRKKKCGHFNELRLKKKLAYKD

SEQ ID NO: 42412 - DNA, 655 bp, Panicum virgatum
  misc_feature: Ceres CLONE 2011921
  misc_feature: Encodes the peptide sequence at SEQ ID NO. 42413
gacctctcctatctcaccccccccccccccccccacccctagtctctcctttctctccctagccccgcacaaatctctcctccccctttctcgctctcgccgcattgcccgccgacgacccaccgccggatagagaggaggaggagcggcgcggctgcgggagaagcgggtggcggcggagcgggcggcatgtgcgacctggtggcccgcacgggccggcatcagcagcggtacgaggatggccgtcggctagtggccgggtgcataccatttaggtatagagttaataatgatgaacataagaaacttgtggaagttctcatgataaattcccaaagtggacctggtcttttgtttccaaagggaggatgggagaacgatgaaactgttgaagaggcagcagctcgagaagctatagaagaggctggagttcgaggtgatatagtgcatcttctggggttttatgactttaaaagcaagacacatcaagatgcgtgctgtcctgagggtatgtgcagagctgccgtgtttgcactgcatgtaaaggaagagctgacctcatggcctgagcagagcacccggcagagaacgtggctcaccgttcctgaagctgcatcacagtgccggtaccagtggatgcaagaggccctgctca

SEQ ID NO: 42413 - protein, 155 aa, Panicum virgatum
  misc_feature: Ceres CLONE 2011921
  misc_feature (19)..(155): Pfam Name: NUDIX Pfam Description: NUDIX domain
  misc_feature: SWISSPROT Homolog: EC 3.6.1.52 Diphosphoinositol-polyphosphate diphosphatase
MCDLVARTGRHQQRYEDGRRLVAGCIPFRYRVNNDEHKKLVEVLMINSQSGPGLLFPKGGWENDETVEEAAAREAIEEAGVRGDIVHLLGFYDFKSKTHQDACCPEGMCRAAVFALHVKEELTSWPEQSTRQRTWLTVPEAASQCRYQWMQEALL

SEQ ID NO: 42414 - DNA, 620 bp, Panicum virgatum
  misc_feature: Ceres CLONE 2011923
  misc_feature: Encodes the peptide sequence at SEQ ID NO. 42415
acgactctccactgtgactccgtgagccttgtgctccttcctgctctgcacactccgcaccagctcggcaatcatgcctcgtccggcccccctcctcctcctccacctcctggcggccgccgcgctcctggccctggcgggcgcgtcgccggcgaacagcgaagccgcggccagcgacttcatccgcaagtcatgccgcgacacgcagtacccgtcgctgtgcgtgcagagcctggcgtcgtacggcgggtccccgccgccgcggagcccgcgggagctggcgcgcgcggcgctgacggtgagcgcggaccgcgcgcgcgcggcgtcggcgtacgtggggcggctgtgcggcggcggcggcgcggcgaagaagggcgggcgcaagggcacggcggcgggcgccgtgcgcgactgcctggagaacctggcggacagcgtggggcacctccgcgacgcggagcaggagatgggcggcgccgggatgtgggggcgcgcggggtcggcggcgttcaagtggcacctgagcaacgtgcagacctggtgcagcgcggcgctcaccgacgagaaacactgcctggacgggctccccgggcgcggcgtgaacgccggcacgcgcgccg

SEQ ID NO: 42415 - protein, 182 aa, Panicum virgatum
  misc_feature: Ceres CLONE 2011923
  misc_feature (31)..(182): Pfam Name: PMEI Pfam Description: Plant invertase/pectin methylesterase inhibitor
  misc_feature: SWISSPROT Homolog: EC 3.1.1.11 Pectinesterase
MPRPAPLLLLHLLAAAALLALAGASPANSEAAASDFIRKSCRDTQYPSLCVQSLASYGGSPPPRSPRELARAALTVSADRARAASAYVGRLCGGGGAAKKGGRKGTAAGAVRDCLENLADSVGHLRDAEQEMGGAGMWGRAGSAAFKWHLSNVQTWCSAALTDEKHCLDGLPGRGVNAGTRA

SEQ ID NO: 42416 - DNA, 665 bp, Panicum virgatum
  misc_feature: Ceres CLONE 2011936
  misc_feature: Encodes the peptide sequence at SEQ ID NO. 42417
gttttcctctcagcgcggagtgttcgtgcgaaggcgaccctccctcctccctcggcgcactcctaccgccgccgccatggtgaagtactcgcgggagccgggcaacccgaccaagtcggccaaggccatgggcagagatctcagggtccacttcaagaacacgagggagacagcttttgcacttcgcaagctgtctttgaccaaggctaagcggtaccttgaggatgttattgctcacaagcaggcaattcccttccggagatactgtgggggtgttggtcgcactgctcaagcaaagtctcgccactcaaatggccagggtcgctggcctatgaaatcagccaggttcatattggatttgctgaagaatgccgagagcaacgctgaggtgaaaggcttggatgtcgacaacctctatgtttctcacatccaggtgaaccaagcccagaagcagaggcgccgcacataccgtgctcatggacgcatcaatccttacatgtcctcaccttgccacattgagctcatcctgtcagagaaggaagagcctgttaagaaagagcctgacaacattgtcgcagcaaggaagcagtgaaggacgccaccatgttgaacaaggatatcatgttgaagagttatagctgtagctcttttatgtgcttttcccg

SEQ ID NO: 42417 - protein, 171 aa, Panicum virgatum
  misc_feature: Ceres CLONE 2011936
  misc_feature (17)..(153): Pfam Name: Ribosomal_L22 Pfam Description: Ribosomal protein L22p/L17e
MVKYSREPGNPTKSAKAMGRDLRVHFKNTRETAFALRKLSLTKAKRYLEDVIAHKQAIPFRRYCGGVGRTAQAKSRHSNGQGRWPMKSARFILDLLKNAESNAEVKGLDVDNLYVSHIQVNQAQKQRRRTYRAHGRINPYMSSPCHIELILSEKEEPVKKEPDNIVAARKQ

SEQ ID NO: 42418 - DNA, 656 bp, Panicum virgatum
  misc_feature: Ceres CLONE 2011947
  misc_feature: Encodes the peptide sequence at SEQ ID NO. 42419
aggtcaaatgaccgtgtcccacgctcccagcgaatcaccgccgccgccgccatctctcgcctccccttcttcctcccagcaaatcaccgctgccaccttcccctccgccgaggcctgctgccagtttccgcgtcgccgctctgagagtccgaggccgcctcccgcctatcggaggagaggggaggagacggggtctctctgccggcgttagatttatcgaaggagtaacatggcaatggcaactctcaaagatgcagcagcgagaaaaccaattctagcaacaatccgtcttatagttcctgcaggtgctgcacgtcctgcgccacctgttggtccggctctgggtttctataggcttaatttgatggcattttgcaaagatttcaatgccaggacacagaagtacaaggcagacactccaatgcaagttactttgactgcctacaaggacagcacctttgagtttgttgtcaagtcgccttctgtttcatggtttctgaagaaagccgcaggcattgagactgccagcggtcgcccaggccacaacatggtgtcatctctcacacttcgccatgtgtatgagattgcaaaactgaagcaggctgatccattctgcaagcacatgtcgattgaggccttatgcaaatccatcattg

SEQ ID NO: 42419 - protein, 142 aa, Panicum virgatum
  misc_feature: Ceres CLONE 2011947
  misc_feature (18)..(77): Pfam Name: Ribosomal_L11_N Pfam Description: Ribosomal protein L11, N-terminal domain
  misc_feature (82)..(142): Pfam Name: Ribosomal_L11 Pfam Description: Ribosomal protein L11, RNA binding domain
MAMATLKDAAARKPILATIRLIVPAGAARPAPPVGPALGFYRLNLMAFCKDFNARTQKYKADTPMQVTLTAYKDSTFEFVVKSPSVSWFLKKAAGIETASGRPGHNMVSSLTLRHVYEIAKLKQADPFCKHMSIEALCKSII

SEQ ID NO: 42420 - DNA, 518 bp, Panicum virgatum
  misc_feature: Ceres CLONE 2011970
  misc_feature: Encodes the peptide sequence at SEQ ID NO. 42421
acagtacgcactccggctgacgcgccccgcactcacaaagctcaagcctttcgctcgctcgctcgctcgcggctacatctacaatggcgcgattccagctcgcggccctggccatggccatgctcttcgccgcggcggcggcgcaggccccggccgccaccccgacgccggcgcccagggcgtcccccccgccggcgactcctccgccgaccccggcgccggtgtctccgcccgcgcaggcccccgccgttcctcccccggccccggcgcccgcgactccggcccccgccaccgaggccgccgccacggcgccggctgaggcccccacccccgcggcgagctccccgccggcgcccgcccccatgggaccctccccgtcgcccaccagcgacgtgcacccggcccccagcgccgccgccggcgtctcccccggcgacaagtgggccgccgcctacgccgtggccaccatggccgccgccttctactgaggagtacccccgcaccgcctgcgcggagct

SEQ ID NO: 42421 - protein, 134 aa, Panicum virgatum
  misc_feature: Ceres CLONE 2011970
  misc_feature: Functional homolog of the protein sequence given in SEQ ID NO 50464
  misc_feature: Useful for making plants with altered carbohydrate content
  misc_feature: Functional homolog of the protein sequence given in SEQ ID NO 50194
  misc_feature: Useful for making plants with altered cell wall content and/or composition
MARFQLAALAMAMLFAAAAAQAPAATPTPAPRASPPPATPPPTPAPVSPPAQAPAVPPPAPAPATPAPATEAAATAPAEAPTPAASSPPAPAPMGPSPSPTSDVHPAPSAAAGVSPGDKWAAAYAVATMAAAFY

SEQ ID NO: 42422 - DNA, 724 bp, Panicum virgatum
  misc_feature: Ceres CLONE 2011975
  misc_feature: Encodes the peptide sequence at SEQ ID NO. 42423
ataggcataggctggtgatcagatcacagctccacgtctccagtctactcagccccctgcatgcatcccgagcagagactgctcctccttaatttgaaggaacaagcaagaaaaggagagaaagatgaccagcgtttggaagaccaaggttctgcccggcctcaacaagatttttgacaaggatggcaagaaggcggcggcggccgagttcctaaagtccttcaacaaggaggagattggcaaggagattgaggacaagaagacagagctggagcccaaggttgtggaggcttatgaagcatctcctcctgaagttaaggctctgttcaaggacaagaaaccagtcaagatcagcaagaagaactcggctgcagctaccaagttgctcgacgagctggctaagattgagttccctggagccaagctggtgagcgacgcggtggccaagtccggcaccacgcccctctccccggtgatcaccttcatcttggacaaggttgcgccgttcatccccaaggaggagcccaaggccgagccggaggccacctcccgggaagtcgccgtcgaggagaagaaggaggaggccgagcccccggccgctgcggcgacggaggaggctgcgccggcaccggcggaggcgtcggaggcggtagaggagaagaaggctgaggaggagaagccgacagaagccgcagccgagggcgcggccgcgccaccagctgaa

SEQ ID NO: 42423 - protein, 199 aa, Panicum virgatum
  misc_feature: Ceres CLONE 2011975
  misc_feature (2)..(199): Pfam Name: DREPP Pfam Description: DREPP plasma membrane polypeptide
MTSVWKTKVLPGLNKIFDKDGKKAAAAEFLKSFNKEEIGKEIEDKKTELEPKVVEAYEASPPEVKALFKDKKPVKISKKNSAAATKLLDELAKIEFPGAKLVSDAVAKSGTTPLSPVITFILDKVAPFIPKEEPKAEPEATSREVAVEEKKEEAEPPAAAATEEAAPAPAEASEAVEEKKAEEEKPTEAAAEGAAAPPA

SEQ ID NO: 42424 - DNA, 1356 bp, Panicum virgatum
  misc_feature: Ceres CLONE 2011976
  misc_feature: Encodes the peptide sequence at SEQ ID NO. 42425
cccttttccccttctctcgactcgcctctctaagttcccttgcagcggcacgctgttccgctgaagctggttgacctcctctgccggctgccgccctcacctacccactaccctgctgcatctttgaacatccaggccctttgcttccagacacctgcacctgtagttccctgtgccttggagattccgatccgctgcgagaaccttctcgtcggagaggctgtagcaaagtgtctgtgcagccaaaactctgccggaattcttggccagaaacctttgctgatcagggcaagactctgccggaatttttttactagaaacctcgtatagatgttcaggctgtcactctgccgaaatttttcaccagaaaccttgctggttagggcgttactctgccgaaatttccagctgcaaaaccctcttgtccaggccgagactctgccaaaattttcagctggggttttcttgattgatcagggggggactctgtccgaattcctactcgagtaccttgttttgtcagggggaaactctgctggatttttctttcgcgacaagctcttccttgagctgctcttctgacttatgtccatgcttgtgccacgaaccttttgatgctgctgctgttctgctcccatcccccgtgtttatgataacatccaccgtcctcgtccagtccttctccgtcgtcttcctctactggttctatgtcttctcataattaaccgaccgcacgtagtaattatttcttggagattcacgttctgatttctgccaagaactgctagtaaaatcgagcaagaaagtgattattattaaccaggtaatttaatcggtgagactaagaaaggagaacatgatggcatctccccccagcatggtgtccgctgtgaccgcgtcgccgtcgaccgggtccgagcccgaggcgccctgctgcgacccgcagctggccgcggtgaccgcggagaggaagcgcaagcgcaaggagtccaaccggctctccgcgcagcggtcgcgcgcgcgcaagcagcagcagctggacgacctgaccaagcaggtggccgcgctgcgcgcccggaacggcgccatggccgcggccgcctacgacgtccagcgccgatgcgccgccgtgcaggccgagaacgcgctgctgcaggccatgaacctcgagctcggcgagcgcctccagtccctggccgagctcatccagagcatggaggacgccgccatgtaccagcagtaccaccagccgcagctgctcgacgccaacatgtacaactactactactagtgccatgccatccgggggcgtcgtcttcaggtcattgccagggaggttagctggtatctagctct

SEQ ID NO: 42425 - protein, 137 aa, Panicum virgatum
  misc_feature: Ceres CLONE 2011976
  misc_feature (28)..(90): Pfam Name: bZIP_1 Pfam Description: bZIP transcription factor
MVSAVTASPSTGSEPEAPCCDPQLAAVTAERKRKRKESNRLSAQRSRARKQQQLDDLTKQVAALRARNGAMAAAAYDVQRRCAAVQAENALLQAMNLELGERLQSLAELIQSMEDAAMYQQYHQPQLLDANMYNYYY

SEQ ID NO: 42426 - DNA, 684 bp, Panicum virgatum
  misc_feature: Ceres CLONE 2011978
  misc_feature: Encodes the peptide sequence at SEQ ID NO. 42427
tgcttccgcactctgaagcttgctacacccacctttggtgatctgaaccatctcatctctgcaaccatgagtggtgttacttgctgcctgcggttcccaggccagctgaactctgacctccggaagcttgcagtcaacttgatacccttccctcgcctccatttcttcatggttggctttgcaccgctgacctcaaggggatcccagcagtaccgcgccctcaccgtccctgagctgacccagcaaatgtgggactccaagaacatgatgtgcgctgctgacccacggcatgggcgctacctgacagcctctgccatgttccgtggtaagatgagcaccaaggaggtggacgagcagatgttgaacgtgcagaacaagaactcgtcctactttgtggagtggatccccaacaacgtgaagtccagcgtgtgtgacatcccccccacgggcctgaagatggcgtcgactttcatcggcaactccacctccatccaggagatgttccggcgcgtgagcgagcagttcacagccatgttccggcgcaaagccttcttgcactggtacaccggggagggcatggacgagatggagttcaccgaggccgagagcaacatgaacgacctggtggccgagtaccagcagtaccaggacgctacggcagacgaggaggaagactacgaggac

SEQ ID NO: 42427 - protein, 227 aa, Panicum virgatum
  misc_feature: Ceres CLONE 2011978
  misc_feature (36)..(173): Pfam Name: Tubulin_C Pfam Description: Tubulin/FtsZ family, C-terminal domain
  misc_feature: Functional homolog of the protein sequence given in SEQ ID NO 50258
  misc_feature: Useful for making plants with modulated flowering time
CFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPTGLKMASTFIGNSTSIQEMFRRVSEQFTAMFRRKAFLHWYTGEGMDEMEFTEAESNMNDLVAEYQQYQDATADEEEDYE

SEQ ID NO: 42428 - DNA, 720 bp, Panicum virgatum
  misc_feature: Ceres CLONE 2011984
  misc_feature: Encodes the peptide sequence at SEQ ID NO. 42429
ccaccacacgccgaggcttgctcttcttcttcttcttcttgttgttgatagaaaaatagaattcaggggcagccggggcccgagatcggcgaggccggccgtgcttgctgctcgcgccattgacacatcgtccatctgctagcgcagaggtagcgaggtaggtagcaatggagacccgggacagcgccccctccaccacgccgctcccctactcctactcgccgctgccggccgccgacgccgcctccgccgaggtctccggcgcccgcgcccgccggaggccgctctgcgccgccgcgctcgtgctgtcccccgcggccggcgtgtcggagaagacgtccggcgcgtcgggggtgctgcttggcgagggcggcggcaacgccttcccctggagcaacgcgatgctgcaatggcagcgcacgggattccacttccagccgcacaagaactggatgaacgatcccaacggccctgtgtactacaagggttggtaccacctcttctaccagtacaaccccgacggcgccatctggggcaacaagatcgcgtggggccacgccgtgtcccgcgacctcgtccactggcgccacctcccgctcgccatggtgcccgaccagtggtacgacgccaacggcgtctggacgggctccgccaccaccctccccgacggccgcctcgccatgctctacaccggctccaccaacgagtcggtgcaagtcc

SEQ ID NO: 42429 - protein, 184 aa, Panicum virgatum
  misc_feature: Ceres CLONE 2011984
  misc_feature (88)..(184): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature: Functional homolog of the protein sequence given in SEQ ID NO 51130
  misc_feature: Useful for making plants with altered carbohydrate content
METRDSAPSTTPLPYSYSPLPAADAASAEVSGARARRRPLCAAALVLSPAAGVSEKTSGASGVLLGEGGGNAFPWSNAMLQWQRTGFHFQPHKNWMNDPNGPVYYKGWYHLFYQYNPDGAIWGNKIAWGHAVSRDLVHWRHLPLAMVPDQWYDANGVWTGSATTLPDGRLAMLYTGSTNESVQV

SEQ ID NO: 42430 - DNA, 666 bp, Panicum virgatum
  misc_feature: Ceres CLONE 2011987
  misc_feature: Encodes the peptide sequence at SEQ ID NO. 42431
accgcccaccacagccgccacccagcctcatctctccccttccttctgaccactacccccaatcccccccactgcaaccaaccaaccaaatccgccgccatggcttccgatggcaccggcgtcgtggccctctacggcggcggcggcaacaacaacaacaacaaggtcaaggtcgtcgacgcctcctccaagtccccagccgccgccgccaccttctccgtcaaggtgggcctggcgcagatgctgcgcggcggcgtcatcatggacgtggtcacgccggagcaggcgcgccttgccgaggaggccggggcctgcgccgtcatggcgcttgagcgcgtccccgccgacatccgcgcgcagggcggcgtggcccgcatgtccgacccgggcctcatccgcgacatcaagcgcgccgtcaccatcccggtcatggccaaggcgcgcatcggccacttcgtcgaggcccagatcctggaggccgtcggcgtcgactacgtggacgagagcgaggtgctcacccccgccgacgacgcgcaccacatcaacaagcacaacttccgcgtccccttcgtgtgcggctgccgcgacctcggcgaggcgctgcgccgcatccgcgagggcgccgccatgatccgcaccaagggcgaggccggcaccggcaacgtc

SEQ ID NO: 42431 - protein, 188 aa, Panicum virgatum
  misc_feature: Ceres CLONE 2011987
  misc_feature (37)..(188): Pfam Name: SOR_SNZ Pfam Description: SOR/SNZ family
MASDGTGVVALYGGGGNNNNNKVKVVDASSKSPAAAATFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRIREGAAMIRTKGEAGTGN

SEQ ID NO: 42432 - DNA, 706 bp, Panicum virgatum
  misc_feature: Ceres CLONE 2011988
  misc_feature: Encodes the peptide sequence at SEQ ID NO. 42433
cgcgtcggccggcacagcgggtcggatctgctactgctgctcccacgccgttccgttcccggtctctccacctcgcatcgccgccaggagcagagcaaaggtccaagaagatggctgaacttgacactttccttttcacatctgagtcagtcaatgagggacaccctgataagctctgtgaccagatatctgatgcggtgcttgatgcatgcctcgctgaagaccctgacagtaaggttgcttgtgagacctgcactaagaccaacatggtcatggtctttggtgagatcaccaccaaagccaatgttgactatgagaagattgtcagggatacttgccgtggtattggttttgtgtccaatgatgtagggcttgatgctgatcactgcaaggtacttgtcaacattgagcagcagtcacctgacattgcacagggtgtccatggccacttcaccaagcgccctgaggagattggtgctggtgaccaggggcacatgtttggatatgctactgacgagacccctgaaatgatgcccctcagccatgttcttgccaccaagcttggtgctcgcctcactgaggtccgcaagaatgggacctgcccatggctgaggcctgatgggaagacccaggtgactgttgagtaccacaacgacaatggtgccatggtccctattcgtgtccacactgtgctcatctccaccca

SEQ ID NO: 42433 - protein, 198 aa, Panicum virgatum
  misc_feature: Ceres CLONE 2011988
  misc_feature (5)..(104): Pfam Name: S-AdoMet_synt_N Pfam Description: S-adenosylmethionine synthetase, N-terminal domain
  misc_feature (119)..(198): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAELDTFLFTSESVNEGHPDKLCDQISDAVLDACLAEDPDSKVACETCTKTNMVMVFGEITTKANVDYEKIVRDTCRGIGFVSNDVGLDADHCKVLVNIEQQSPDIAQGVHGHFTKRPEEIGAGDQGHMFGYATDETPEMMPLSHVLATKLGARLTEVRKNGTCPWLRPDGKTQVTVEYHNDNGAMVPIRVHTVLIST

SEQ ID NO: 42434 - DNA, 655 bp, Panicum virgatum
  misc_feature: Ceres CLONE 2012000
  misc_feature: Encodes the peptide sequence at SEQ ID NO. 42435
actttggccggtatgatgtcaagagagttgtgcgaaccatctacattctcttttctaggagcgagatcccaatagcaaaacaagatcaagagattatggaccttgcagacttgtcaacacctcttcctgagtggttcactgaggatgatctcgctgtatatgcttcactctatgagaaatctggtttccgatatccactggagatgccatataggtctctccataaggcgaatgcaattgaagatccaaaattccaagtcccagtgtttgttgtcatgggggagaaggattatgtctacaaattccctgggatcgagtctgttttgaaagacggcataatggagaaattcgtaccggacctgaagatcacctacatccctgaaggaagccattttgttcaggagcagttcccagacaaggtgaatgatctcctggttgggttcttgaaagaccatcccgtgtctacatagatgctctattagtgccgatgttcaacctcataactagcagacacgatgggcaaaactgcgatgtcaactatgcctgtaaaggaataattgtgacgactgaagctttctgtacgcatacgctgtgctgtatctagtttttgtacagctaatttaccatgaataaatgatataatattttcaccatt

SEQ ID NO: 42435 - protein, 155 aa, Panicum virgatum
  misc_feature: Ceres CLONE 2012000
  misc_feature: SWISSPROT Homolog: EC 3.3.2.10 Soluble epoxide hydrolase
FGRYDVKRVVRTIYILFSRSEIPIAKQDQEIMDLADLSTPLPEWFTEDDLAVYASLYEKSGFRYPLEMPYRSLHKANAIEDPKFQVPVFVVMGEKDYVYKFPGIESVLKDGIMEKFVPDLKITYIPEGSHFVQEQFPDKVNDLLVGFLKDHPVST

SEQ ID NO: 42436 - DNA, 694 bp, Panicum virgatum
  misc_feature: Ceres CLONE 2012008
  misc_feature: Encodes the peptide sequence at SEQ ID NO. 42437
agcctctggcgacaaggcgttccactactcacttgagcattaatacagggaatcagaaaccaagaatatagaaactattacccacgaaacctgtaacagcggccggatatatatatatatatatatatatatatatatatttatatatatatggagcataatatcctggagcttatacttgacgggaaggaggagccgacatgtgtgccgttgcatattctagttgatattacagcaaaattttctaacaggcgagtaattggtcatggtggttttggagtggtttacaagggatatcttcgaaatggtattgtggctgtcaaaaaatcctcgagcatgcctgcaacccaagaggaggaatttgatcgggaggttaaaaacatgttgagagttaagcacgaaaatataatacggtttctaggctattgttccaatacacacatgatctttatagaacatgaagggaagctaactggagcccgtgtattagacaccatgctctgttttgagtttgcaagtaatggcaacctaagaaagcatattaacggtgatgattcaggccttgaatggcctacacggtataaaataattaaaggagtttgtgaaggtttgtattatcttcacagcagccaaatagttcatagggatcttaagcctgaaaatatattgttagatgaacactacaaaccaaaaa

SEQ ID NO: 42437 - protein, 181 aa, Panicum virgatum
  misc_feature: Ceres CLONE 2012008
  misc_feature (31)..(181): Pfam Name: Pkinase_Tyr Pfam Description: Protein tyrosine kinase
  misc_feature: SWISSPROT Homolog: EC 2.7.11.1 Non-specific serine/threonine protein kinase
MEHNILELILDGKEEPTCVPLHILVDITAKFSNRRVIGHGGFGVVYKGYLRNGIVAVKKSSSMPATQEEEFDREVKNMLRVKHENIIRFLGYCSNTHMIFIEHEGKLTGARVLDTMLCFEFASNGNLRKHINGDDSGLEWPTRYKIIKGVCEGLYYLHSSQIVHRDLKPENILLDEHYKPK

SEQ ID NO: 42438 - DNA, 717 bp, Panicum virgatum
  misc_feature: Ceres CLONE 2012034
  misc_feature: Encodes the peptide sequence at SEQ ID NO. 42439
acctcctcctcaacgcccgcgccgtcgccgaagccgtctgccccgatcccgtcgagagaaagatcacttgtgcaactttcttaaggggagatggcggtttcattcgcagtcaactccgacgcagggcttaagaagctcgacgagtacctcctcacccgcagctacatcactggttaccaagcttccaaggatgacctggctgtctattcttcattctctgctgctccttcttccaagtatatcaatgtagcgaggtggttcaatcacattgatgcccttgtgaggctgagtggaatcactgaagagggtcaaggtgtcaaggttgagtcttcagctgttacggcctcaactcctgatgttgctgaagcaaagccagcagctgacgatgatgatgatgatgatgttgacctttttggtgaggagactgaagaggagaaggctgctgctgaagcgcgtgctgcggctgtcaaggcttctggcaagaagaaagagtctggcaagtcttcagttttgcttgatgtgaagccttgggatgatgagaccgatatggccaagctagaggaggcagtaaggaatgtgaagatggacggcttgttctggggtgcatccaaacttgtaccagtgggatatggcatcaagaaagtgcaaatcatgatgactattgttgatgaccttgtatctgttgacactctcattgaggaccatctgtgcgaggaa

SEQ ID NO: 42439 - protein, 208 aa, Panicum virgatum
  misc_feature: Ceres CLONE 2012034
  misc_feature (137)..(206): Pfam Name: EF1_GNE Pfam Description: EF-1 guanine nucleotide exchange domain
  misc_feature: SWISSPROT Homolog: EC 6.1.1.16 Cysteine--tRNA ligase
MAVSFAVNSDAGLKKLDEYLLTRSYITGYQASKDDLAVYSSFSAAPSSKYINVARWFNHIDALVRLSGITEEGQGVKVESSAVTASTPDVAEAKPAADDDDDDDVDLFGEETEEEKAAAEARAAAVKASGKKKESGKSSVLLDVKPWDDETDMAKLEEAVRNVKMDGLFWGASKLVPVGYGIKKVQIMMTIVDDLVSVDTLIEDHLCE

SEQ ID NO: 42440 - DNA, 736 bp, Panicum virgatum
  misc_feature: Ceres CLONE 2012038
  misc_feature: Encodes the peptide sequence at SEQ ID NO. 42441
gattctcagccagtcgggcgggctactcggctgccattccgttccatccattggctatttggctcccttcgctcagtccagtttctcccccactcctcatcactctgcgtgctctgcctgctccaatcagcgccgggtccagccaatgacggccggcgcggctctggccgccgtgctggcgctgtcgtgcttggcggtgtccgcggccggcgcggctgcgacggcggaggcggaggcggaccgcatcgcgagcctgccggggcagccgccggtcaacttctccatgtactccgggtacgtcaccgtggacgcggccgcggggcgggcgctcttctactggctcatcgaggcggccggcgcgcccgcggagtccacaccgctcgtgctctggctcaacggcgggcccgggtgctcctccgtcggctacggcgcgtccgaggagctcggcgccttccggatcaacgccgacggcaggtcgctctccaggaaccgctacccctggaacaaagtggcgaacatgctgttcctggactcgccggccggcgtcggctactcctactccaacaccaccgccgatctgtacaccgccggtgacaacaagacagctcatgattcgtacaatttcttggtgaaattggtggagcggttttcgcagtacaagcatcgtgatttctacatcacgggagagagctacgcaggtcactacgtgcctcagctatctcagctagtataccgg

SEQ ID NO: 42441 - protein, 196 aa, Panicum virgatum
  misc_feature: Ceres CLONE 2012038
  misc_feature (38)..(196): Pfam Name: Peptidase_S10 Pfam Description: Serine carboxypeptidase
  misc_feature: SWISSPROT Homolog: EC 3.4.16.6 Carboxypeptidase D
MTAGAALAAVLALSCLAVSAAGAAATAEAEADRIASLPGQPPVNFSMYSGYVTVDAAAGRALFYWLIEAAGAPAESTPLVLWLNGGPGCSSVGYGASEELGAFRINADGRSLSRNRYPWNKVANMLFLDSPAGVGYSYSNTTADLYTAGDNKTAHDSYNFLVKLVERFSQYKHRDFYITGESYAGHYVPQLSQLVY

SEQ ID NO: 42442 - DNA, 1357 bp, Panicum virgatum
  misc_feature: Ceres CLONE 2012040
  misc_feature: Encodes the peptide sequence at SEQ ID NO. 42443
aaatcgaaaccgcaattccagcctccacatcgcgagcacaaacagcagaagaggtgtacccagggtgcgagacgagagatggtggggacggccggcggcggcgcggaggaggcggtgcggcggtgggtggaggccggcggcgggcgcctcgtgctggacggcgggctggccacggagctcgaggccaacggcgccgacctcaacgacccgctatggagcgccaagtgcctcctcgcctccccgcacctcatccgcaaggcaagtcccaaaagacccttctttaatcttcctttgaaatgaaaccgatccgcctaccgttgcttaggagttaggattcgtccgttaggccgttctaccttttggtgattcgttcgatctccgtcttctgttcttggagaagaaactgaaccacgcggcgatgcggccgtgctgcaaaaattttatcttttttttcccctttgtcgattgggaacaaaattaacaagtgaaactggtccagtcagagctccatactacgattttacaaggaaatggggaagcattctttttttttgttccaagggtattggaactcggaaggaactatcgctgcataaaaagaataatatggggaatgtccccacagctccactagagtaggtgggctagtttccccatcatgaacagggcagtagcatggtactcctatgctgccgtatgggcatgtggtggggattggaataaagttcatgcttcctgccgaatttgctcatgcatcaaggggtagtttatgctacctaactaaagtttggtgagcattcgggaacaaattttgctagttgattttgagttttcccaggtccagccctgggcacagactgtatggccgcgtcgcagtcatgtctttgctggctggtccagcttatcctcaacttaagactgccaccatgacatttagaaatcaggacccatgtttgacatcaattatgtgagctgcctggaaatgaacatcctggtagcgatgtttacttgatttatttcatatgatagttctggactggtatgtgtaaactcttgggttagcattgaattgtatgagtactattattaggtacaatcaaactaaaaacgaaactaaacagaaatttcttgtggtggtcagttgtttaaatcccttagttttgtctgcagtttcctaagaaacatcttttttttttggaatttgtgattaaataatgatctcataggtaagcattcattttcagattgccactgcatattaatgtcccctttttatatttggtgaaacaggtccacatggactacctagaagctggtgctaacatcatcatcacagcatcatatcaagccaccattc

SEQ ID NO: 42443 - protein, 73 aa, Panicum virgatum
  misc_feature: Ceres CLONE 2012040
  misc_feature: SWISSPROT Homolog: EC 2.1.1.10 Homocysteine S-methyltransferase
MVGTAGGGAEEAVRRWVEAGGGRLVLDGGLATELEANGADLNDPLWSAKCLLASPHLIRKASPKRPFFNLPLK

SEQ ID NO: 42444 - DNA, 571 bp, Panicum virgatum
  misc_feature: Ceres CLONE 2012042
  misc_feature: Encodes the peptide sequence at SEQ ID NO. 42445
atccactgctactcgagccaacaagacagcttattatccaagtctactcctagatccgtgccccagccgaaaacacacgcagccagggcaagatgaagcttgttggaggccagaggaggcagagggggttcggcaaggccctcaaggagcagagggccaggctctacatcatccagcgctgcgtcgtcatgctcctgcgctggaacgactgatccgatccgatccaccgccggacgccggatcgatcggtagatcgtctttgccctgacgctccatcgggtgccaaagttttgggggttctgggtctgtctccttggtggtgccagaatggtcgccggctgctgtacatagagggccaggcagggacaatatagagtagtacaaattagaggtggtagcagtaggattcactctggtacggtgttcatcgattggggtctctgactttccctgaaaactagtatgccaatgtacaatcgcatcagtgtggaatgccaaatcaatgaacagagaacaagcaatgggtcaatcccaatgcgcatgccgtcatcgattactcgctcttcgattt

SEQ ID NO: 42445 - protein, 39 aa, Panicum virgatum
  misc_feature: Ceres CLONE 2012042
  misc_feature (18)..(36): Pfam Name: DVL Pfam Description: DVL family
  misc_feature: Functional homolog of the protein sequence given in SEQ ID NO 50388
  misc_feature: Useful for making plants with modulated biomass
MKLVGGQRRQRGFGKALKEQRARLYIIQRCVVMLLRWND

SEQ ID NO: 42446 - DNA, 674 bp, Panicum virgatum
  misc_feature: Ceres CLONE 2012055
  misc_feature: Encodes the peptide sequence at SEQ ID NO. 42447
cagttgtgccttcctgtatgacatcttctgggtgttcgtctccaagaggtggtttcatgagagtgtgatgattgtggttgcacgtggtgataagactgacgaggatggcgtgcccatgttgctaaaaattccacgaatgtttgatccttggggtgggtacagcatcattggctttggtgatatccttcttcctgggctggtagttgctttcgcactaagatacgattttgttgcaaagaagggccttcagtctggttactttttgtggtcaatggtggcctatggttccggacttctgatcacatatgttgcactgaacctgatggatgggcatggccaacctgcccttctgtacattgtgcccttcacactcggaacgttgatcgcgctcgggtggaagagaggagagctgcagaacctgtggatgaggggacagcctgagagagtgtgcacgcatatgcatatcccgctgctgcctgcgagcccaaaataacgagtgcgtggccggggtaggcacttgaaccagaatgcacgctgcgtcgacatcctgctaataggttaataactagtagtgattaaatatattgcccagcaatattgacgcgtgtatttgatcgagacactttactgatgtacgtatatgtatatgtatccttatgaatttttagttcatc

SEQ ID NO: 42447 - protein, 163 aa, Panicum virgatum
  misc_feature: Ceres CLONE 2012055
  misc_feature (1)..(145): Pfam Name: Peptidase_A22B Pfam Description: Signal peptide peptidase
SCAFLYDIFWVFVSKRWFHESVMIVVARGDKTDEDGVPMLLKIPRMFDPWGGYSIIGFGDILLPGLVVAFALRYDFVAKKGLQSGYFLWSMVAYGSGLLITYVALNLMDGHGQPALLYIVPFTLGTLIALGWKRGELQNLWMRGQPERVCTHMHIPLLPASPK

SEQ ID NO: 42448 - DNA, 668 bp, Panicum virgatum
  misc_feature: Ceres CLONE 2012059
  misc_feature: Encodes the peptide sequence at SEQ ID NO. 42449
aacaaccagctaaaagaaaaactcgctcatctctctgcactttcctttcctacgagcgatcatcaggcgatggcagcgccggggcagccgctgacggtggacttcgaggcgctgagctacatcagcagcctggtggaagccttccaggctttcgactccgacggcgacggcctcatcactgcccccgagctccgcggcctgctggcgtccctgggcctcgacaagtccgaggccgaggccaacgacatgctggcgcgcgccgacctcgaccgcgacggcaagctcagcgtggaggagctccttgacgtgatgaacgccggggagctcggcctgggcgcgctcggcgagctgctgcagtcggcgctgcccacgctcgaggccgcgggggccgcgctggtcggcgcggacgagctcgcaaggacgctcggcgccatgggcgccgccagcgccgaggattgcgccgcgatcgttgagtgcttggacggcgatggcgacggcgccatcagcatcgaggagttcaggctcatggccgacttgctctagacatatcgaccctgctggaatggaccgtgctgtcaacatgttgtgatcgacaataatacttaagaaagagatgttgtcaacatgtactcctacatccctaaaagaagctcactacagtacaaatc

SEQ ID NO: 42449 - protein, 157 aa, Panicum virgatum
  misc_feature: Ceres CLONE 2012059
  misc_feature (20)..(48): Pfam Name: efhand Pfam Description: EF hand
  misc_feature (56)..(84): Pfam Name: efhand Pfam Description: EF hand
  misc_feature: SWISSPROT Homolog: EC 2.7.11.1 Non-specific serine/threonine protein kinase
MAAPGQPLTVDFEALSYISSLVEAFQAFDSDGDGLITAPELRGLLASLGLDKSEAEANDMLARADLDRDGKLSVEELLDVMNAGELGLGALGELLQSALPTLEAAGAALVGADELARTLGAMGAASAEDCAAIVECLDGDGDGAISIEEFRLMADLL

SEQ ID NO: 42450 - DNA, 667 bp, Panicum virgatum
  misc_feature: Ceres CLONE 2012060
  misc_feature: Encodes the peptide sequence at SEQ ID NO. 42451
tgtgccgtggagttcggtcggtcgactgatcccaaggagaaatcagaaatgggcaaggcgtgggcgctcatcacccacctccacaccgtcgccgggccgagcatcaccctgctgtacccactgtacgcgtcggtgtgcgcgatggagagcccgaccaaggtggacgacgagcagtggctctcgtactggatcatctactccttcgtcaccctgctcgagatggtcgccgagcccgtcctctactggatacccatctggtacccggtgaagctgctgttcgtggcgtggctggtgctgccgcagttcaagggcgcctccttcatctacgagaagctcgtcagggaccagctcaggaagtaccgcgccaggcacctccgcatgggcgccgccgccgccgccgacgacgatcagaaggtgcacatagccaaggctgaacacgaccatgaccatgtgcagtgaagccgacgggatccggctgagaccagcaacgacttctctgtagattgaaggtgttcatgtgtgtcctagatatccctgcctctctggaggaccaggacactccttcggcttcatcatcatcatgtatctgaactctggaatgtgtatgtaaccccgtcgttgcaagaactgcttctgcagtgagaacgacaaaagagatgttttctgc

SEQ ID NO: 42451 - protein, 136 aa, Panicum virgatum
  misc_feature: Ceres CLONE 2012060
  misc_feature (4)..(101): Pfam Name: TB2_DP1_HVA22 Pfam Description: TB2/DP1, HVA22 family
MGKAWALITHLHTVAGPSITLLYPLYASVCAMESPTKVDDEQWLSYWIIYSFVTLLEMVAEPVLYWIPIWYPVKLLFVAWLVLPQFKGASFIYEKLVRDQLRKYRARHLRMGAAAAADDDQKVHIAKAEHDHDHVQ

SEQ ID NO: 42452 - DNA, 1854 bp, Panicum virgatum
  misc_feature: Ceres CLONE 2012083
  misc_feature: Encodes the peptide sequence at SEQ ID NO. 42453
agccctggttcttccttccctccacagcctttaaacagttcctttctttatacggcacccaccttcattctttaggcgtgcctatcctttagcagtcaaccttcttttgacagcttctctcgcttccttcacttcgctcctcgacttgagactttttcttaccgccgtatcctctttcacctcaaaagcgtgctgtgcacgtcttggctcaaacacgcagctcctcatacctgttccgtctgacacaggttttttaccagccatcgcagcttgcgtgtgaattgctttatacagtccactccttcccaccaggacggccacacgctcattcatatctattaccggatcaggatccagtatataatccaacatgaggacttccttcgccatcactggtcttttgacccttgtctctacagtcctcgctgccggtgacggcctcattggcaacaaggtctccaaattcggtaaccactccaccgaggtcaaggattacgttatcgtcttccagcgcaatgagaccgctcagttccttggagtgaagcattatctcgagcagcttgagctccaggacaaaactactgagggtgaagatgttatcacaatggagaccaacaacacggatatcaaggttcttgggatgaggatctgcgacatgcatgctgattacctcagagacaacttccctgagatttgcgttgtcgaagagaaagtacaggcccagtcgtttgttgagacaaagtcaaatgctccttggggtctgcagcgcatctcgagcgatgccggcgcatctggaaaccctcaaggccaggacttcacctactccttcaacaacactcagctcggtgctggcgtcgacatctatgtccttgataccggagttcgcacaactcacgccgtctttaccggccgtggctcccagggtttcactgccactggttctactgtcgacggtgatgggcacggtactcactgtgctggcactgctggtggcgcgaaattcggcgtagcccagggtgccaacatcatcgcagtgaaggttcttggtgacgatggctccggctcctcctctgacactatcgccggcatggattttgtcctcaagaaccacgcggcgcgcaagtcgcagcccggctttgtcggctccctcatgagcatgtcctggggtttgcagggaactgccaactctgtcgatgaggtgatccaagccgccagcgaggctggtattcacgtctccgtggccgctggtaatgatggtgttgacgcttgcacttctacccctgcccacctcggtggtgccaactctaacgtcgtcacggtcggctctatcaacatcaacaacaaggtttcgactttctccaacattggcaagtgtgtcgacatctacgcccctggtgagcagattctcagctcctggagcaccggcgacaatatcatcaacttcctctccggtacatccatggcttgcccccacaataccggtgtcatggccgttctcatggccgaagatcccgccggtctcggccagaaccctgctgccctcaagaagaagcttctcgcaacagcccgcactgataagatctccggtagccttggtggcagtgccaacttactcctcagcaacggcgtcaatggcagccctgccgctcgccttgtcaagaactacgttgtgcctgagcgcagcggcagtcctgctgctcgcgctgctcagaacgtcaaaaacggcgacatggagaggtgggtcgttgtctcgaacgactcccctgtccggttctaaagagtagccctttgtagcgcctgacgtgatacccatttgtcattaagtaaaagacaaaagtctcctcgagcatttcc

SEQ ID NO: 42453 - protein, 468 aa, Panicum virgatum
  misc_feature: Ceres CLONE 2012083
  misc_feature (142)..(418): Pfam Name: Peptidase_S8 Pfam Description: Subtilase family
  misc_feature: SWISSPROT Homolog: EC 3.4.21.48 Cerevisin
MRTSFAITGLLTLVSTVLAAGDGLIGNKVSKFGNHSTEVKDYVIVFQRNETAQFLGVKHYLEQLELQDKTTEGEDVITMETNNTDIKVLGMRICDMHADYLRDNFPEICVVEEKVQAQSFVETKSNAPWGLQRISSDAGASGNPQGQDFTYSFNNTQLGAGVDIYVLDTGVRTTHAVFTGRGSQGFTATGSTVDGDGHGTHCAGTAGGAKFGVAQGANIIAVKVLGDDGSGSSSDTIAGMDFVLKNHAARKSQPGFVGSLMSMSWGLQGTANSVDEVIQAASEAGIHVSVAAGNDGVDACTSTPAHLGGANSNVVTVGSININNKVSTFSNIGKCVDIYAPGEQILSSWSTGDNIINFLSGTSMACPHNTGVMAVLMAEDPAGLGQNPAALKKKLLATARTDKISGSLGGSANLLLSNGVNGSPAARLVKNYVVPERSGSPAARAAQNVKNGDMERWVVVSNDSPVRF

SEQ ID NO: 42454 - DNA, 422 bp, Panicum virgatum
  misc_feature: Ceres CLONE 2012137
  misc_feature: Encodes the peptide sequence at SEQ ID NO. 42455
cactcgccaccaactctctcaggagcgctagggtttcctgcggcggcggcggaggaaggcggctatggggcactccaacgtgtggaactcgcaccccaagaactacgggcccggatctcgcgtctgccgggtctgcgccaaccctcacggactgatcaggaagtacgggctgatgtgctgcaggcagtgcttccgcagcaacgccaaggacatcggcttcatcaagtaccgctgaagtcagctgtgggcaataagagtaccatcttccagtatgacatggaccatgtgatagaagcagggcgataatttaaattccagtgatttagatgttttgttcagaactctgcaagtgaattctgttgcctgtgttttttatggataacttggccatgtccataatgttcgaatcatgagttgcctgc

SEQ ID NO: 42455 - protein, 56 aa, Panicum virgatum; identical to SEQ ID NO: 9888
  misc_feature: Ceres CLONE 2012137
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency

SEQ ID NO: 42456 - DNA, 1456 bp, Panicum virgatum
  misc_feature: Ceres CLONE 2012159
  misc_feature: Encodes the peptide sequence at SEQ ID NO. 42457
acagtgcacgctgcagcagcctccagctctcccaaggcggcggcggcggcagcagcagcagagagagctcagctcggtggtcatgcaggcatcgtcgaccacggcggccatggcgtcgctgcgcgcgctcccgctcccggtgctggtgcccctcgtcgtctcggcgctcgccttcctggtgaccgtcctccggctcgtcctgcggcggcagcggccggtgtacctgctcaactacagctgccacctcccggacgtggaccggcaggtgaacctcgaggtgtgcgagtacttcgggctcaagtgccgccgctactccgacgacatcgccgacttcatgcggctcatctacagcaagtccggcctggggcaggagaccttcgcgccgcccttcatcttctcgggccggttcgacaagacgctggcgttcgcggtgcaggaggccgaggagggcctcttcgccgtggtcgggcagctcctggccaaggccgacgtgacgcccgccgacatcagcgtcctcgtcgtggcgtgctccatgttctccccgatgccgtcgctggcgtccatgatcgcgcaccggttcaagatgcggcccgacgtgaaggcgtacagcgtcgccgggatgggctgcagcgccggcaccgtgggcatcgacacggcggcgcggtcgctgcggtgccagcggcgccccgggtacgcgctggtggtggtgaccgagaacaccagcctcaactggtacttcggcgagaacaagcacatgctggtgaccaactgcatcttccgcgtgggcaccgcggcggcgctggtgacggacgtgccggcgcgccgcgccgacgccaagtacgagctggtgcgcacgctgcggacgcaccacggcgccgacgacgcggccttccacgcggcgacgcagatggaggacgagcggggcaacctgggcgtggcgctcaccaaggacctggtccgcgtcgcgggcgccgcgctccggcggcacatcacggcgctggggccccgggtgctgccggtggcggagatgctccggtacgcgtggcgcgtggcgcgcgcccgcgcggcggggaaccgcaaggcggcggcggcggaggtgcccgacttccagcgcgcgttcgagcacatgtgcatccactcgggcgggaaggcggtgatcgacgcggtggcgcggctgatggggttcgggccggcggtggtggagccggcgagggccacgctgcmccggttcgggaacmcgtcgmgcagcctcgtgttctmcgmgctggcctmcttcgrggccaagcgccgggtccgcgccggcgtccgcctctggttgctggccttcgggccgggcttctcggcctgctgctccgtgtggcgcgcgctccgcgtctgcgggcccgccgccgccctcccctggtccggttgcgtcctccgcttcccgttgccgctgccgccgccgtcccggccgccc

SEQ ID NO: 42457 - protein, 448 aa, Panicum virgatum
  misc_feature: Ceres CLONE 2012159
  misc_feature (29)..(318): Pfam Name: FAE1_CUT1_RppA Pfam Description: FAE1/Type III polyketide synthase-like protein
  misc_feature (333)..(419): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature (372)..(372): Xaa is any aa, unknown, or other
  misc_feature (377)..(377): Xaa is any aa, unknown, or other
  misc_feature (379)..(379): Xaa is any aa, unknown, or other
  misc_feature (384)..(384): Xaa is any aa, unknown, or other
  misc_feature (385)..(385): Xaa is any aa, unknown, or other
  misc_feature (388)..(388): Xaa is any aa, unknown, or other
  misc_feature (390)..(390): Xaa is any aa, unknown, or other
MASLRALPLPVLVPLVVSALAFLVTVLRLVLRRQRPVYLLNYSCHLPDVDRQVNLEVCEYFGLKCRRYSDDIADFMRLIYSKSGLGQETFAPPFIFSGRFDKTLAFAVQEAEEGLFAVVGQLLAKADVTPADISVLVVACSMFSPMPSLASMIAHRFKMRPDVKAYSVAGMGCSAGTVGIDTAARSLRCQRRPGYALVVVTENTSLNWYFGENKHMLVTNCIFRVGTAAALVTDVPARRADAKYELVRTLRTHHGADDAAFHAATQMEDERGNLGVALTKDLVRVAGAALRRHITALGPRVLPVAEMLRYAWRVARARAAGNRKAAAAEVPDFQRAFEHMCIHSGGKAVIDAVARLMGFGPAVVEPARATLXRFGNXSXSLVFXXLAXFXAKRRVRAGVRLWLLAFGPGFSACCSVWRALRVCGPAAALPWSGCVLRFPLPLPPPSRP

SEQ ID NO: 42458 - DNA, 682 bp, Panicum virgatum
  misc_feature: Ceres CLONE 2012175
  misc_feature: Encodes the peptide sequence at SEQ ID NO. 42459
ttacagaatgcctccggggttcaggttccacccgagggacgacgagctcgtgctcgactacctcctcaacaagctctccggccgtgcccacggcggcgctgccatcgtcgatgttgacctcaacaagtgcgaaccatgggatcttcgagaagccgcgtgcgtaggcgggaaggagtggtacttcttcaacctgcgcgaccgcaagtacgcgacggggcagcgcaccaaccgcgccaccgtgtcgggctactggaaggccaccggcaaggaccgcgccgtcgtcgccggcggggaggacgccgcggtggtggggatgcgcaagacgctggtgttctaccgcgggcgagcccccaaggggagcaagacggagtgggtcatgcacgagttccgcctcgagccaccgccgccgccgcagccgccgtcgcaagaacgccagctcccagctgcggcgaagcaccagcgtctcaaggtaacttcagctcctagctcaggttgttgttactcctgtactttgttttcacctgaaaaagctccggcacaaatctttgaattcaagtcgattgatgccatggtatggtatgactagtagtacgatttttactgtttgaggatttttacagtcctttgaaggtatggaaaaatcgtctcccgaattgtgattgggtagctcttctctttgttt

SEQ ID NO: 42459 - protein, 194 aa, Panicum virgatum
  misc_feature: Ceres CLONE 2012175
  misc_feature (3)..(132): Pfam Name: NAM Pfam Description: No apical meristem (NAM) protein
  misc_feature: Functional homolog of the protein sequence given in SEQ ID NO 51050
  misc_feature: Useful for making plants with altered lignin content
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Functional homolog of the protein sequence given in SEQ ID NO 51291
  misc_feature: Useful for making plants with altered cell wall content and/or composition
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Functional homolog of the protein sequence given in SEQ ID NO 50908
  misc_feature: Useful for making plants with modulated biomass
  misc_feature: Functional homolog of the protein sequence given in SEQ ID NO 50845
  misc_feature: Useful for making plants with altered alkaloid content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
YRMPPGFRFHPRDDELVLDYLLNKLSGRAHGGAAIVDVDLNKCEPWDLREAACVGGKEWYFFNLRDRKYATGQRTNRATVSGYWKATGKDRAVVAGGEDAAVVGMRKTLVFYRGRAPKGSKTEWVMHEFRLEPPPPPQPPSQERQLPAAAKHQRLKVTSAPSSGCCYSCTLFSPEKAPAQIFEFKSIDAMVWYD

SEQ ID NO: 42460 - DNA, 675 bp, Panicum virgatum
  misc_feature: Ceres CLONE 2012176
  misc_feature: Encodes the peptide sequence at SEQ ID NO. 42461
gggtgtgagcgggctgcggcgagctgccactgcggcggtcggctggcggcggccgcgcgagcggagtggagcgagatgaacgctcggtgggcggtgcttctcgcgctgctggtggcgagcgccggcgccggcggcgcgcgcgccgcggggctcggcgggctgagccgcgcgtcgttccccaaggggttcgtgttcgggacggcgacggcggcgtaccaggtcgagggcgcggcgtccaccaacggccgggggccctccatctgggacgcattcgcgcacaccccaggaaatgttgtgggaaatcaaaatggagatgtcgcggtggatcaataccatcgctacaaggaagatgttgatctcatgaaaagtttgaattttgatgcagaccaccagccacactgaccagagcttggagtgtgagtgagggagagtgccagtgagagagggagcgagaggatgggtggcaaggcagctctgctgctggccctggtggccgtgagcctggccgtcgagatccacgccgacgccggctacggcggcgggtacgggccgacgccggccaccccgaccccgaagccagagaagccacccaaggggcggcaagccgccccaggagcacaagcctcccacctacaccccaagcccgaagccgacgccgcccacgtacactcccac

SEQ ID NO: 42461 - protein, 108 aa, Panicum virgatum
  misc_feature: Ceres CLONE 2012176
  misc_feature: SWISSPROT Homolog: EC 3.2.1.21 Beta-glucosidase
  misc_feature: Functional homolog of the protein sequence given in SEQ ID NO 51134
  misc_feature: Useful for making plants with altered cell wall content and/or composition
  misc_feature: Functional homolog of the protein sequence given in SEQ ID NO 50586
  misc_feature: Useful for making plants with altered carbohydrate content
  misc_feature: Functional homolog of the protein sequence given in SEQ ID NO 50360
  misc_feature: Useful for making plants with modulated biomass
  misc_feature: Useful for making plants with modulated flowering time
MNARWAVLLALLVASAGAGGARAAGLGGLSRASFPKGFVFGTATAAYQVEGAASTNGRGPSIWDAFAHTPGNVVGNQNGDVAVDQYHRYKEDVDLMKSLNFDADHQPH

SEQ ID NO: 42462 - DNA, 687 bp, Panicum virgatum
  misc_feature: Ceres CLONE 2012177
  misc_feature: Encodes the peptide sequence at SEQ ID NO. 42463
ctctcccttcctagtcctctcctccttgcatgctgacaagacaaccggccagtgttggcctcccctaaacatacacagacacacactctccacttacccaatcacacaagcaacaccaagcgagtcagcacaccaaggcggtaatggccacaatcctgctgctcctgctgctcctcgcattgccgccgccgtcggccgtggcgctcaattccgagggcctggcgctgctggcgttcaaggcggcggccaccgacgacccctactcggcgctctcgcggtggtccgagtccgacccggacccgtgccgctggccgggggtcacctgcgccaacgcctcctcggcctcgcccgcccagccgccgcacgtcatcggcgtcgctgtggcgggcaagaacatctccggctacatcccgtcggagctcggctcgttgctcttcctccgccggctcaacctccacggcaaccgcctggcgggcgccatccctgccgcgctctccaacgcgtcctcgctccactcgctctacctctacggcaaccgcctcaccggcggcctccccgtcgcgctctgcgacctcccccgcctgcagaacctcgacgtctccgggaacgcgctctccggagagctgccgctcgacctccgcaactgccgcagcctgcagcggctggtgctcgcccggaacgcctttc

SEQ ID NO: 42463 - protein, 181 aa, Panicum virgatum
  misc_feature: Ceres CLONE 2012177
  misc_feature (21)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MATILLLLLLLALPPPSAVALNSEGLALLAFKAAATDDPYSALSRWSESDPDPCRWPGVTCANASSASPAQPPHVIGVAVAGKNISGYIPSELGSLLFLRRLNLHGNRLAGAIPAALSNASSLHSLYLYGNRLTGGLPVALCDLPRLQNLDVSGNALSGELPLDLRNCRSLQRLVLARNAF

SEQ ID NO: 42464 - DNA, 684 bp, Panicum virgatum
  misc_feature: Ceres CLONE 2012190
  misc_feature: Encodes the peptide sequence at SEQ ID NO. 42465
gcactagtgtgatctgactcttcttggccttggcaagctcccagctcccagcttcagcttggtgctggtgcctgttctgaagcagagcaagatgggcaggggagctcaaccatctgcgccgctcctgctcttctccctggggctggtgctcctctacttcaccgcaggcagcaccgtccgtcttgcggaggcacagaagacgtggtgcatcgcgaagccgtcggcgtcgaacgagatcctggcgcagaacctggactacgcgtgctcccaggtgagctgcgccgtgatccagaagggcgggccgtgctactacccggacagcctcgtctcccgcgccgccgtcgccatgaacctctactacgcctacagcggccgccacgcctggaactgctacttcaacaactccgccctcgtcgtccagtccgaccccagttacggatcctgcacgtactactgatggtgagtgccgccggttgtggagggacgccgtgcgagctgaactactgagagtgtgtccctgttgctctttgttgaggaacggcagcagacgcagattgctaccttgtcttgtgttgtgtccagtaagctgtgatgcaaatgcagttgacctctgaatattttcgaacagctagctcattgatatcttaactcgaggttgccgcctcaaaaatgagtcggtcgacc

SEQ ID NO: 42465 - protein, 121 aa, Panicum virgatum; identical to SEQ ID NO: 16446
  misc_feature: Ceres CLONE 2012190
  misc_feature (37)..(120): Pfam Name: X8 Pfam Description: X8 domain
  misc_feature: SWISSPROT Homolog: EC 3.2.1.39 Glucan endo-1,3-beta-D-glucosidase

SEQ ID NO: 42466 - DNA, 643 bp, Panicum virgatum
  misc_feature: Ceres CLONE 2012208
  misc_feature: Encodes the peptide sequence at SEQ ID NO. 42467
acgccgacgccgatcgatcgagctagctcccacttgcagtcctccgtcccgcccgccgcgcgcgcttcagcttgggttggagatccgtgagccatggctgctgagactgttgtcctcaaggtgactatgtcatgcgagggttgcgccggggcggtcaggagagtgctctcaaagatggaaggagttgagacctttgacatagacctcaaggagcagaaggtgacagtcaaaggcaatgtcaagcctgaagatgtcttccagacggtttccaagtcggggaagaagacctcctactgggagggcgaagccacagccccgtctgctccggctccagtagcagaagcagctctcagcaccgaggcagaagcgcctgccgcggaggctgcaccagagatcaccccagccaaagctgctgcaccagagatcaccccagtcaagcctgacgcttgatcatcacatgagatgctgtgacccctaaaccttactctagaactagctgggaaaaccgagtcttgtgcgatttgcatcatgttgttgccactctagcaagtgattgcgaattatagaataaatgataaaacccagtatgtccgtacgtttgtgtgatttcaagatgaacacatcccttgcgagattcttgttc

SEQ ID NO: 42467 - protein, 118 aa, Panicum virgatum
  misc_feature: Ceres CLONE 2012208
  misc_feature (6)..(67): Pfam Name: HMA Pfam Description: Heavy-metal-associated domain
  misc_feature: SWISSPROT Homolog: EC 3.6.3.4 Copper-exporting ATPase
MAAETVVLKVTMSCEGCAGAVRRVLSKMEGVETFDIDLKEQKVTVKGNVKPEDVFQTVSKSGKKTSYWEGEATAPSAPAPVAEAALSTEAEAPAAEAAPEITPAKAAAPEITPVKPDA

SEQ ID NO: 42468 - DNA, 1044 bp, Panicum virgatum
  misc_feature: Ceres CLONE 2012221
  misc_feature: Encodes the peptide sequence at SEQ ID NO. 42469
caccgcctcggcgccccccatgtgccccgctcctttaattgggccgcacccggcgcccaacccgccaggccccagctgagccagctccctcccagcatctcatcgcgtgttcactgttcacactcccgtccccgtccccgtcccagctcagctcgagctagagaccagaaacaagaaccacccacgcatcacatcgccctgctcgcttcgcccgcccggtgctccggcaattgcttgctgctgtttgattcggccgaggggaggtcgggaggaggaggcagagggggagtagggacgatggcggggcggatgcgggtggcggcggcggcgctgctgctggcgctggcggcgtgcgcggcgctgccgtcgaggacggcggcgaacaagatcagcatcaactggaagcccaacaccaactactccgactgggtggcgcagcacagccccttctacaaggacgactggctcgtgttctactacacggcggggcaggcggacgtggtgcaggtggacgaggccgggtacaacaagtgcgacgccagcaacgccatctacaactacagcaagggccgcaccttcgcgttccagctcaacgagaccaagacctactacttcatctgcagctacggctactgcttcggcgggatgcgcctcgccatcaagaccgagaagttgccgccgccgtccctgccgccgtccgccagccacaggtccgccgccgccgccgccgccttcgccaggtcccacgccgcggtcatcttctacgccgtcgccctgctcgccgttctcctcagggtggtctagctagggaaaaaatctagctagccagcctttcgtccgggttctttcgttaaatttggagctcttgttttttttttcttctttttttagtgtgcttggatgggctctgaagaggagtcgtagttgtggagtgtattgggttgggttgattagtggcgtcgatttgcggaagcgatcattgatctgagagattgatttattgttccaagtgtgaagaactcgagctgaagtagctttgcatcc

SEQ ID NO: 42469 - protein, 168 aa, Panicum virgatum
  misc_feature: Ceres CLONE 2012221
  misc_feature (35)..(117): Pfam Name: Cu_bind_like Pfam Description: Plastocyanin-like domain
MAGRMRVAAAALLLALAACAALPSRTAANKISINWKPNTNYSDWVAQHSPFYKDDWLVFYYTAGQADVVQVDEAGYNKCDASNAIYNYSKGRTFAFQLNETKTYYFICSYGYCFGGMRLAIKTEKLPPPSLPPSASHRSAAAAAAFARSHAAVIFYAVALLAVLLRVV

SEQ ID NO: 42470 - DNA, 1087 bp, Panicum virgatum
  misc_feature: Ceres CLONE 2012229
  misc_feature: Encodes the peptide sequence at SEQ ID NO. 42471
  misc_feature (470)..(470): n is a, c, t, g, unknown, or other
aaaagataacaaaaatcagaggaattcctaacaggaaaccagataagcaaagctgcaacagctacgagcctgctccgtgccagtcctctccatcccggctccaatttctcatatggatttctctctcctcctagcgctcatggccgtcgccttgcccgtgctcctccacctcctagcgagagccaagaagtcacggccaggcgcggccaagctgcccccgggctccctgggcctgccggtgatcggccagagcctcgacctcctcggcgcaatgcgcgccaacaccgccgaccgatggatccaggaccgggtcgaccggtacggcccggtgtcgaagctgtcgctgttcggcgcgccgacggtgctcctcacgggacccgccgccaacaagttcgtcttcttcagcggctcgctggcgatgcagcagccccggtccatgcagaggatcctgggggagaagaacatcctgngcctcatgggcgctgatcacaagcgcatccgcggcgcgctgaccgagttcctcaagccggacatgctgcggctgtacgtgggcaggatcgacggcgaggtgcggcgccacctcgacgagagctgggccggccgggccaccgttgcggtgatgccgctgatgaagaggctcacgttcgacatcatctcctcgctgctcttcggcctcgagcgaggcgccgtccgagacgccctcgccattgacttcatgcacctcgtcgacggcacgtgggctgttcccgtggacctgccgttcacggcgttccgccggagcctgaaggctagcgccagggctcgccgggtgatcgccgggatcgcccgggagacgaaggccaagctggagcggggcgaggccacccgcagcagcgacctcatcgcgtgcctgctcactttgaccgacgacagcggcaggcagcagctgagcgaggaggagatcgtggacacctccatggtaaccctcatggctggccatgatacctcgtccatcctcatgactttcatggtccgccacctcgccaacaaccctgacgccctcgccgccatggtccaagagcacgacgagatcgcaaagaacaagcag

SEQ ID NO: 42471 - protein, 315 aa, Panicum virgatum
  misc_feature: Ceres CLONE 2012229
  misc_feature (26)..(315): Pfam Name: p450 Pfam Description: Cytochrome P450
  misc_feature: SWISSPROT Homolog: EC 1.14.13.76 Taxane 10-beta-hydroxylase
  misc_feature (111)..(111): Xaa is any aa, unknown, or other
MAVALPVLLHLLARAKKSRPGAAKLPPGSLGLPVIGQSLDLLGAMRANTADRWIQDRVDRYGPVSKLSLFGAPTVLLTGPAANKFVFFSGSLAMQQPRSMQRILGEKNILXLMGADHKRIRGALTEFLKPDMLRLYVGRIDGEVRRHLDESWAGRATVAVMPLMKRLTFDIISSLLFGLERGAVRDALAIDFMHLVDGTWAVPVDLPFTAFRRSLKASARARRVIAGIARETKAKLERGEATRSSDLIACLLTLTDDSGRQQLSEEEIVDTSMVTLMAGHDTSSILMTFMVRHLANNPDALAAMVQEHDEIAKNK

SEQ ID NO: 42472 - DNA, 667 bp, Panicum virgatum
  misc_feature: Ceres CLONE 2012236
  misc_feature: Encodes the peptide sequence at SEQ ID NO. 42473
aaacgcccatcagccatcccctcctgctgcaatcttcctctgaattgtgggtctgtggcaatggcggcgctcgctccatcgaagatccttggcacccagctcaacttcacgggctcctcccggtacgccaccactgcaccgaccgctggggcgcagaagatcgtctccctattcaaaaagaagcctgccccgaagcccaagcccgctgcggtatcatcctcatccccggacatcagcgatgagctcgccaagtggtacggccctgacaggaggatcttcctgccggatggcctcttggaccgctcagaggtcccggagtacctcaccggagaggtccctggagactatggctacgatccttttggcctgggcaagaagccagaggacttcgccaagtaccaggcctacgagctgatccatgccaggtgggccatgctcggcgccgccggtgccgtcatcccggaggcgtgcaacaagtttggcgccaactgcggccctgaggccgtctggttcaagaccggcgccctgctgctggacggcaacaccctcagctacttcggcaacagcatccccatcaacctggtggtggccgtgatcgccgagtactaccggatcatcaacggcctggacctggaggacaagctgcaccccggcggcccgttcgacc

SEQ ID NO: 42473 - protein, 202 aa, Panicum virgatum
  misc_feature: Ceres CLONE 2012236
  misc_feature (83)..(202): Pfam Name: Chloroa_b-bind Pfam Description: Chlorophyll A-B binding protein
MAALAPSKILGTQLNFTGSSRYATTAPTAGAQKIVSLFKKKPAPKPKPAAVSSSSPDISDELAKWYGPDRRIFLPDGLLDRSEVPEYLTGEVPGDYGYDPFGLGKKPEDFAKYQAYELIHARWAMLGAAGAVIPEACNKFGANCGPEAVWFKTGALLLDGNTLSYFGNSIPINLVVAVIAEYYRIINGLDLEDKLHPGGPFD

SEQ ID NO: 42474 - DNA, 753 bp, Panicum virgatum
  misc_feature: Ceres CLONE 2012246
  misc_feature: Encodes the peptide sequence at SEQ ID NO. 42475
caggaatgtttagccaaggcgcatggttcacaatgtgggttctgcacccctggttttgtgatgtcgatgtatgcactgctgagatctagcaaagagcctcctactgaagaacagatcgaagactgccttgcaggaaatttgtgtcggtgtactggctaccgaccaattatagatgccttccgtgtttttgccaaaacagataatttggtgtacaccaattcatcttcacaaaacacagatggccaagctatctgcccttcaactgggaagccatgttcttgccaaaatgaggcagatgccaatgtcaattcttcactaccatcatctgtggaaagatattcaccttgttcatacaatgaaattgatggaaattcatatgatgacaaagaactcatcttccccccagaacttcagttgagaaaagttatgccacttaaattaaaggggtataatgagattaggtggtttagacctcttaaactaaatcaagtactacatttgaaatcatgctatccagatgcaaagcttatcattggtaactcagaagtgggagttgaaacaaagtttaagaatgcccaatataaggtcatgatctcagtcactcatgttccggagcttaatactctcaaagttaaagaagatggcatacacattggttctgctgtaagacttgcacagcttcaaaatttccttaagaaggttattgcagaacgtgatttgcctgaaacttcatcatgtcaagcaatagtacgt

SEQ ID NO: 42475 - protein, 250 aa, Panicum virgatum
  misc_feature: Ceres CLONE 2012246
  misc_feature (1)..(62): Pfam Name: Fer2_2 Pfam Description: [2Fe-2S] binding domain
  misc_feature (151)..(248): Pfam Name: FAD_binding_5 Pfam Description: FAD binding domain in molybdopterin dehydrogenase
  misc_feature: SWISSPROT Homolog: EC 1.17.1.4 Xanthine dehydrogenase
QECLAKAHGSQCGFCTPGFVMSMYALLRSSKEPPTEEQIEDCLAGNLCRCTGYRPIIDAFRVFAKTDNLVYTNSSSQNTDGQAICPSTGKPCSCQNEADANVNSSLPSSVERYSPCSYNEIDGNSYDDKELIFPPELQLRKVMPLKLKGYNEIRWFRPLKLNQVLHLKSCYPDAKLIIGNSEVGVETKFKNAQYKVMISVTHVPELNTLKVKEDGIHIGSAVRLAQLQNFLKKVIAERDLPETSSCQAIV

SEQ ID NO: 42476 - DNA, 1713 bp, Panicum virgatum
  misc_feature: Ceres CLONE 2012258
  misc_feature: Encodes the peptide sequence at SEQ ID NO. 42477
atccatccgccaaaccacaacatcaacatcaacatcaacaacaacgctcaacagcgaacaacgccatcgtcttcgatttctccgggcaactaccgatatcgcactctgcgcttaaaacaatcacaaactctcgacgacagcgaccgcctccatcatgggttccgacccccagtacgtgaagtggccattgctgcctctgtcgcagcacgttttcaccctcacaaacggttatgccactaaaatcgcgcaacaagctgctgtaaaggctctccaagatgctatcgcacaggataagatggctcctttctaccgatatcttgcccacccactcgacggcgtcctcaacactcttggcgagggcggctcttctgctcccgggcgacctctcagcagaaagtccagtcttgttggaatgattgctactaagcctgccgctaccatcgtcagtctgccctgggacgagggcctctataaccagttgaaggaagataatgatcgggagctgcaagagttccagaaagaggaggatgatgccgttgagcaagctggtgataccgaggtcatggctgctcaggggaagcgagctgagttctgggctcgtgtgggagataaggacaaggccattgccgcctacgagagcctctccgaaaagacgggaatcctcggtaccaagatcgacgtcgtcctcgccgtaatacgcatgggtctcttctatggcgacaagcctcttgtcaagaagcacgtcgaacgtgcgaagacacttgtcgaatcaggcggtgactgggaccgccgcaaccgtctcaaggcctacgagggtctgcacctactcacacttcgctcctacaacctcgctgcgcctttactgctcgactctctctctacgttcaccagttacgaactctgcacctattccaacctcgttgtttactccgttctggctggttcagtgtctctcaagcgagtcgatttcaagtcaaaggttgtagacgcacctgaaatcaaggctatcctgggtgacggcgaggacaagcttcttgctctcagtggtgctctcagtgctggccctggtgccgatgacactaccggtgcgaaggctcctaagacggctaccgctgctgtcaacctgaccacgttgggcaccagtacggagcaacctgaagccgagatggccattgactttagccctctagcgctgctcgttagcagtctgtacagcggaaactataagaccttcttcaagtctctcgccgaggtcgaggagcagttcctaaaccaggaccgctatcttcatgagcacaagaactggtttattcgggagatgcgacttcgcgcctatcagcagcttcctcaaagctacagagttgttggcctggagagcatggccaatgacttcggagtcactgttgacttcctcgatcgtgacctcgcccgcttcatcgctgctgggcgtatcccctgcaccatcgatcgcgtgacaggcaagggtgtgatcgagacaaaccgccccgatgacaagaacaagcagtatcaggatgttgtgcgacagggtgatcagctcatcacaaaactacaaaagtacggccaggctgtgcgactgaggggtagtgagagggcataaatggggcgatttatagatgaggaagctggtgcttgactttgtcatgccgtagtgggggaataaagcgaaaagacagagaataagcccatgccttc

SEQ ID NO: 42477 - protein, 487 aa, Panicum virgatum
  misc_feature: Ceres CLONE 2012258
  misc_feature (343)..(450): Pfam Name: PCI Pfam Description: PCI domain
MGSDPQYVKWPLLPLSQHVFTLTNGYATKIAQQAAVKALQDAIAQDKMAPFYRYLAHPLDGVLNTLGEGGSSAPGRPLSRKSSLVGMIATKPAATIVSLPWDEGLYNQLKEDNDRELQEFQKEEDDAVEQAGDTEVMAAQGKRAEFWARVGDKDKAIAAYESLSEKTGILGTKIDVVLAVIRMGLFYGDKPLVKKHVERAKTLVESGGDWDRRNRLKAYEGLHLLTLRSYNLAAPLLLDSLSTFTSYELCTYSNLVVYSVLAGSVSLKRVDFKSKVVDAPEIKAILGDGEDKLLALSGALSAGPGADDTTGAKAPKTATAAVNLTTLGTSTEQPEAEMAIDFSPLALLVSSLYSGNYKTFFKSLAEVEEQFLNQDRYLHEHKNWFIREMRLRAYQQLPQSYRVVGLESMANDFGVTVDFLDRDLARFIAAGRIPCTIDRVTGKGVIETNRPDDKNKQYQDVVRQGDQLITKLQKYGQAVRLRGSERA

SEQ ID NO: 42478 - DNA, 675 bp, Panicum virgatum
  misc_feature: Ceres CLONE 2012280
  misc_feature: Encodes the peptide sequence at SEQ ID NO. 42479
gagctgcagcctgcagtcggccggttctcgccacctctcgcacctccactgagcgcaccagccgcccccatcctcctctccctcccccggcgcaggctgagcacgcggatctctcgggcagcggaggcaaggcgcggcggcggcggcggccctcgaagcggcgcccccgggtagctgcactccctcccccttctccgtctctctcgctctgcggcgtgcctggacaagccccgggcggcgcgggaagtttcttgatttgggctgatctgggcaggggtaatctgtctgtctgcaggtggggcctcgcaggcggcggggagggaggcggaggcggagatgagccgggggcggtcgccggagccattggatttcttcatctggactgtgcaggatgtgggtttatggttggaggaaataaatctcggaagctatcgccagtcatttgaagaaaatggtgtgaatggagagtatctagaaagcctgtcgatgttcaccacagagcagattcttcgattcataagacggtgtcatatgaaatggggagattttattacgctctgtaaagagttgaggcgcatcaaagtcacctgcctgaaaggagagcaggaagtccgcaggccgtggtgggcgccatcatgcctgtcagctgtgttcgtgcgggtggccaagcgcaac

SEQ ID NO: 42479 - protein, 112 aa, Panicum virgatum
  misc_feature: Ceres CLONE 2012280
  misc_feature: SWISSPROT Homolog: EC 2.7.10.2 Non-specific protein-tyrosine kinase
MSRGRSPEPLDFFIWTVQDVGLWLEEINLGSYRQSFEENGVNGEYLESLSMFTTEQILRFIRRCHMKWGDFITLCKELRRIKVTCLKGEQEVRRPWWAPSCLSAVFVRVAKR

SEQ ID NO: 42480 - DNA, 622 bp, Panicum virgatum
  misc_feature: Ceres CLONE 2012300
  misc_feature: Encodes the peptide sequence at SEQ ID NO. 42481
ccccgctcagatggtaaacttccatgcctagttgaagatattatgagtgaacatgttgtccaagttgcctgtggttcctaccatgttgcagtgttaacaaataagagtgaagtttatacatgggggaaaggggccaatggaagattgggccatggagatatcgaggacaggaaaatacctacactcgttgaggcattgagagacagggctgttaggcacatagcttgtggttcaaacttcactgcagctatatgccagcataagtgggtctcaggatctgagcagtcacaatgcgcctcatgtcggcaaccgtttggattcacccgaaagaggcacaattgccataactgtgggcttgtccattgtaatgcctgcacctcacgtaaagctctgagagcagcactggctcctaatcctgcgaaaccttaccgtgtttgcgattcctgtttcacgaaactgaacagtgcggcatattccagtacaattaatcaaaataagaggaaagaggctgtgcctcgccactctggtgaaagcaaccctgatactaaatcggcaaaagcaattgtacccagcaatttggatatgattagaagtttggatagcaaggcagcaaaacaaggga

SEQ ID NO: 42481 - protein, 207 aa, Panicum virgatum
  misc_feature: Ceres CLONE 2012300
  misc_feature (87)..(155): Pfam Name: FYVE Pfam Description: FYVE zinc finger
  misc_feature (37)..(84): Pfam Name: RCC1 Pfam Description: Regulator of chromosome condensation (RCC1)
  misc_feature (19)..(114): SWISSPROT Homolog: EC 2.7.11.1 Non-specific serine/threonine protein kinase
  misc_feature (88)..(166): SWISSPROT Homolog: EC 3.1.3.48 Protein-tyrosine-phosphatase
PRSDGKLPCLVEDIMSEHVVQVACGSYHVAVLTNKSEVYTWGKGANGRLGHGDIEDRKIPTLVEALRDRAVRHIACGSNFTAAICQHKWVSGSEQSQCASCRQPFGFTRKRHNCHNCGLVHCNACTSRKALRAALAPNPAKPYRVCDSCFTKLNSAAYSSTINQNKRKEAVPRHSGESNPDTKSAKAIVPSNLDMIRSLDSKAAKQG

SEQ ID NO: 42482 - DNA, 708 bp, Panicum virgatum
  misc_feature: Ceres CLONE 2012342
  misc_feature: Encodes the peptide sequence at SEQ ID NO. 42483
actccaattccccaattcccaaatcctcccgcgacctcgcgccctccactccagcaaatccctagcctcccccaccctcctctccagtccccgatggcccgcacgaagcagacggcgaggaagtccaccggcggcaaggcgccccgcaagcagctggcgaccaaggcggcgcgcaagtccgccccggcgaccggcggggtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagctcgcgcgccgcatccgtggcgagagggcctagagggtgtgggctcgtcctcagcgtattgcatgcctgatctggggaaatgtagagatgtgttccgtagtcgcttgacctctgttatgtcgtgggagatggtgtgtttgtttccttgttcgtggtgtggctgtagtgttctggtgtgatgtagtttctgatgttaccatctcattatcatcagcaatgggaaaggttagttacgtc

SEQ ID NO: 42483 - protein, 136 aa, Panicum virgatum; identical to SEQ ID NO: 10238
  misc_feature: Ceres CLONE 2012342
  misc_feature (58)..(132): Pfam Name: Histone Pfam Description: Core histone H2A/H2B/H3/H4

SEQ ID NO: 42484 - DNA, 534 bp, Panicum virgatum
  misc_feature: Ceres CLONE 2012344
  misc_feature: Encodes the peptide sequence at SEQ ID NO. 42485
  misc_feature (133)..(133): n is a, c, t, g, unknown, or other
  misc_feature (143)..(143): n is a, c, t, g, unknown, or other
aggagaagaaacttacaaggattcccctagtaacggcgagcgaaccgggagcagcccagcttgagaactctattcgagtcctaccagtagcggccgagagagaggagggggtggtggtggtggtggaggagcngactgagccnccgcttgctgcgcgatctcggcgaccgcggccctgggtgctcgctgctccccgctctccgtgtgctggtggcctcccctcttctcgtcgccgatgcttgagaatggcgccgccgacgatgacggcagcggcgtgccggtgttcgccgagtacagcctcgacgagctccgggcggccaccgacggcttcgcgccggaccgcatcgtgtcggagcacggcgagaaggcgcccaacatcgtctaccggggcacgctcttcagctccggccgcaccgtcgccatccagcgcttcggccgctccgcctggcctgactcccgccagttcctggaggaggcgagggctgctgggcagctgcgcagtggccggctggccaacctaattggttgctgctg

SEQ ID NO: 42485 - protein, 99 aa, Panicum virgatum
  misc_feature: Ceres CLONE 2012344
  misc_feature: SWISSPROT Homolog: EC 2.7.11.1 Non-specific serine/threonine protein kinase
MLENGAADDDGSGVPVFAEYSLDELRAATDGFAPDRIVSEHGEKAPNIVYRGTLFSSGRTVAIQRFGRSAWPDSRQFLEEARAAGQLRSGRLANLIGCC

SEQ ID NO: 42486 - DNA, 696 bp, Panicum virgatum
  misc_feature: Ceres CLONE 2012346
  misc_feature: Encodes the peptide sequence at SEQ ID NO. 42487
aactgttgctcatgaattcatcatcgatttaagagggtttaaggcgaccgctggtattgagccagaggacgtagcaaagcgcttgatggactatggattccatgcaccaactatgtcatggcctgttccgggcacacttatgattgaacccactgaaagtgagagcaaggctgagctagacaggttctgtgatgctcttatctccatcagggaagagattgcagagatagaaaatggcaaagcagatacgctcaacaatgtcctgaagggtgctcctcatccaccccaactcttgatgagtgacacatggactaagccgtattcaagggagtacgctgcattccctgcggcatggctccggggtaccaagttctggccaacaactggtcgtgtggacaacgtgtacggggaccgcaacctcatctgcacgctgcagcaggcgtcccaggtggcggaggaagcagcagccgctactgcgtaatcttgttggtatcccggtcgcagcgtgtgaaacagcctcaagaaactgtaatgcttgcttcctgtaggcgggaagcatcctctcctcttcgtcctttctgcaatgtaaatattacatactagcgcatagcaggtcctgctccccccccagctgccatcttgtaattctgtacttcattgcctctccattgccattttaaatcaaatttagctttt

SEQ ID NO: 42487 - protein, 159 aa, Panicum virgatum
  misc_feature: Ceres CLONE 2012346
  misc_feature: SWISSPROT Homolog: EC 1.4.4.2 Glycine dehydrogenase (decarboxylating)
TVAHEFIIDLRGFKATAGIEPEDVAKRLMDYGFHAPTMSWPVPGTLMIEPTESESKAELDRFCDALISIREEIAEIENGKADTLNNVLKGAPHPPQLLMSDTWTKPYSREYAAFPAAWLRGTKFWPTTGRVDNVYGDRNLICTLQQASQVAEEAAAATA

SEQ ID NO: 42488 - DNA, 589 bp, Panicum virgatum
  misc_feature: Ceres CLONE 2012347
  misc_feature: Encodes the peptide sequence at SEQ ID NO. 42489
agcactagcatcctctctctctctctctctctctctctctctctccatggccctcatgctccgtccttgggcctttcttctcttccttgcactgggctcctacgatgaatttggtctgcagagcagaaggaatggagtcgcataggccacgcagagggtcttcctgtatccgcagtctccgaaggtgtcctctattgtcagcaccaagtacaggactgcctaccacttccagcctcccaagaactggatcaacgatccaaatggaccaatgtactacaatggtatctatcaccaattctaccagtacaatccaaacggttcactctggggtaacatagtttggggccactcggtctcaacagatctcatcaactggatccggtttgagccagcgatagaacgaacaactccgagtgacataaatggttgttggactggttcagccacaatcctcaagggcggtcggcctgctatcatatacactggtgctgacacagagaagcgtcaagtccaaaacattgtgtttccaaagaacttgtctgatccatacctgagggaatggatcaaaccagacaacaacccattgatc

SEQ ID NO: 42489 - protein, 106 aa, Panicum virgatum
  misc_feature: Ceres CLONE 2012347
  misc_feature (1)..(106): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature: Functional homolog of the protein sequence given in SEQ ID NO 51320
  misc_feature: Useful for making plants with altered carbohydrate content
  misc_feature: Functional homolog of the protein sequence given in SEQ ID NO 51321
  misc_feature: Useful for making plants with modulated biomass
MYYNGIYHQFYQYNPNGSLWGNIVWGHSVSTDLINWIRFEPAIERTTPSDINGCWTGSATILKGGRPAIIYTGADTEKRQVQNIVFPKNLSDPYLREWIKPDNNPL

SEQ ID NO: 42490 - DNA, 1692 bp, Panicum virgatum
  misc_feature: Ceres CLONE 2012354
  misc_feature: Encodes the peptide sequence at SEQ ID NO. 42491
aactaacgctaaaaaagtaacagtttctgtactttattggctacccgaacccaatgccttcgagctcacaagtgccgagcacggcgagtctgtcgcagtccgaggcccccgcgaaggcgcaggcgccgcatgcaccagcgccaaagcccgcagggccgaactctcccgcgatgctctcggagacggaggcccagacgacaaagaaagcgaatccgaagccgaaggtcgccgccagctcgctgtcggcgggctacgtcaatcccaagggcgtgatcgcgctgcagaagaagcaagcgacgaagccgccggccgtcatttcgccggagctcgaagctgccgtcaaggagtacggcgtgccaccgtcggagcccgcacggatccagcgggcgcacggccgcatcaaggcggcgtacttcgcgcagccgacgccgcttgtgaaagcccacgtctcggagccggggtacgaggacaagatctactacaagtgcgagcacgcccactggacgggctccttcaaggagcgcggcgcgttgaacctgctgctgcagctgacgcaggagcagatgaaggtcggcgtcatcgccgcgtccgccggcaaccacgcgctcgccctcgcttaccacggccaccgcctgggcatccccgtgaccgtggtgatgccgaccatcgccccgctgacgaagattgagcgctgccagggcttcggcgcgaaggtcatcacggagggcagcaacatcgccgagtgtcgcctgatcgcggacaagctccgggagaagaccggccaggtgtacgtgaacggcttcgaccacccgcgcattgtcaacggcgcgggcagctgcggcgtcgagatcatggagcagctgcccgacgtggaggcgatcgtcgtgcccacgggcggcgccggcctcatcgccggcgtggcgatggccgtgaagcagcgcaatccgcacgtgcgcgtcatcggcgtcgagtccgaggcgtgtccgagcttcacggcggcgatgcaggccggcaagcccgtcacggtcgaggtgaagccgaccctcgcggacggtctccacgtgccgaccgtcggggcgcacagcttctacgtgagccgcgacctcatcgacgaggtcatcgtggtcccggagcggttcatcgcactggcggtgctctccgtgctggagaacgacaagatgatgatcgagggcgccggcgcgtgcggcgtcgcggcgctgttgtcgggccagctcgagcaccttcgcgggctgaagacgtgcatcatccttgccggcggcaacatcgacatcacggccatcggccgcgtgatcgagcgcggcctgcacatgtcgaaccgcctgatccgcttcagcacatccatccccgaccagccgggcggcatcgcgaccttcaccacgcgcctcgcggccacgtcggcgtccgtgaaggacatcatgcaggagcggccctttatcatgagcgacaagatcacgcgcatccgcgtgaccattgagacgaagagcagctcgcacgcgaagcacgtgctgcaggtgctccggggccacggctacgtgctggacatcgatcacggcgactacgtcgagaaggagtcgaagctttgagcttgtttgtcgggcaacgacgatccgcggcgcgccggccccgcgatgctaactcatacccatgcgtattgtaccgcgtaaccgtttc

SEQ ID NO: 42491 - protein, 477 aa, Panicum virgatum
  misc_feature: Ceres CLONE 2012354
  misc_feature (79)..(369): Pfam Name: PALP Pfam Description: Pyridoxal-phosphate dependent enzyme
  misc_feature: SWISSPROT Homolog: EC 4.3.1.19 Threonine ammonia-lyase
MLSETEAQTTKKANPKPKVAASSLSAGYVNPKGVIALQKKQATKPPAVISPELEAAVKEYGVPPSEPARIQRAHGRIKAAYFAQPTPLVKAHVSEPGYEDKIYYKCEHAHWTGSFKERGALNLLLQLTQEQMKVGVIAASAGNHALALAYHGHRLGIPVTVVMPTIAPLTKIERCQGFGAKVITEGSNIAECRLIADKLREKTGQVYVNGFDHPRIVNGAGSCGVEIMEQLPDVEAIVVPTGGAGLIAGVAMAVKQRNPHVRVIGVESEACPSFTAAMQAGKPVTVEVKPTLADGLHVPTVGAHSFYVSRDLIDEVIVVPERFIALAVLSVLENDKMMIEGAGACGVAALLSGQLEHLRGLKTCIILAGGNIDITAIGRVIERGLHMSNRLIRFSTSIPDQPGGIATFTTRLAATSASVKDIMQERPFIMSDKITRIRVTIETKSSSHAKHVLQVLRGHGYVLDIDHGDYVEKESKL

SEQ ID NO: 42492 - DNA, 1168 bp, Panicum virgatum
  misc_feature: Ceres CLONE 2012377
  misc_feature: Encodes the peptide sequence at SEQ ID NO. 42493
aaaataacctaaaaatttgaaatatgttcttcaggtctctcacaagaactgctatcagatccttcgccaagaagagcactggtactcaaacttctgaagctgctcccacatctaccggtgtcaagactggtaagatctcccaagtcatcggtgccgtcgtcgatgtccaattcgaagaaaatcttcctcccattcttaacgctcttgaagtccaaggagtccaaagcagacttgtcctcgaagttgctcaacatttgggtgattccagagtcagaactattgccttggattctactgatggtctcgtcagaggtcaagaagtcgaagatactggcaaccccattatggttcccgtcggacctgaaactttgggaagaattttgaacgttattggtgaacccatcgatgaaagaggccccgtcggatccaagaagttctatcccatccatagagatgcccccgctttcgaagatcaaggttctggtgctgatgtcttgatcactggtatcaaggtcgtcgatcttttggccccctacgctagaggtggtaagattggtcttttcggtggtgctggtgtcggtaagactgtgctcattcaagaactcatcaacaacgtcgccaaggctcacggtggttactccgtcttcgccggtgtcggtgaaagaaccagagaaggtaacgatctttaccacgaaatgattgcctccggtgtcatcagagtcgatggtcaaggctccagatgcgctttggtctatggtcaaatgaacgaacccccaggtgccagagctagagtcggtcttaccggtctcaccctcgccgaatacttcagagacgaagaaggaaaggatgtgttgttgttcgttgataacatcttcagattcactcaagcttgctccgaagtgtctgcccttttgggtcgtatcccctctgccgtcggttatcaacccactttggctaccgatttgggtgccctccaagaaagaattaccaccaccaagaagggttccattacctccgtccaagccgtctacgtccctgccgatgatcttaccgatcccgctcccgccaccactttcgctcacttggatgccactaccgtcttgtccagagccttgactgaactcggtatctaccctgccgtcgatcccttggattccacctccagaat

SEQ ID NO: 42493 - protein, 381 aa, Panicum virgatum
  misc_feature: Ceres CLONE 2012377
  misc_feature (160)..(380): Pfam Name: ATP-synt_ab Pfam Description: ATP synthase alpha/beta family, nucleotide-binding domain
  misc_feature (38)..(104): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MFFRSLTRTAIRSFAKKSTGTQTSEAAPTSTGVKTGKISQVIGAVVDVQFEENLPPILNALEVQGVQSRLVLEVAQHLGDSRVRTIALDSTDGLVRGQEVEDTGNPIMVPVGPETLGRILNVIGEPIDERGPVGSKKFYPIHRDAPAFEDQGSGADVLITGIKVVDLLAPYARGGKIGLFGGAGVGKTVLIQELINNVAKAHGGYSVFAGVGERTREGNDLYHEMIASGVIRVDGQGSRCALVYGQMNEPPGARARVGLTGLTLAEYFRDEEGKDVLLFVDNIFRFTQACSEVSALLGRIPSAVGYQPTLATDLGALQERITTTKKGSITSVQAVYVPADDLTDPAPATTFAHLDATTVLSRALTELGIYPAVDPLDSTSR

SEQ ID NO: 42494 - DNA, 647 bp, Panicum virgatum
  misc_feature: Ceres CLONE 2012387
  misc_feature: Encodes the peptide sequence at SEQ ID NO. 42495
aagagcattgatactagtgtcagtagtgatctctcgcttatctaagctactttagtttcgtcattgctattggtttcatgtgtagtgatgttgaagcaatcaattgcagacaagagggtagctgatatgaagcttgctaaagattttggtgccacaatggaggagttcaggaagcttcaaaatcttgcaattcagagggagatggcatataagccagttgttccgcagaatgctcagtcaaactatacgacagatgacagaagcgctgaatctggtaatatgcctgagcagcgtgcactacttgttgaatcaaaaaggcaagaggtgttgcaattggataatgagattgctttcaatgaagctctcatcgaggaaagagaacaagccattcaagagatccaacaacagatcggtgaagtacatgaagtgttcaaggatcttgctacactcgtacatgcccaaggagttataattgaggaaatcgacatgaacattgaaaattctgccgaggcaatcaaagaggcaaagagagaagtcgcgaaagcagacaaaactcagaaatcaaattcctccctgctttgcttgcttatggtcatcttcggggtcgtgctgcttgttgtgataatagttctggcatcttgagacag

SEQ ID NO: 42495 - protein, 184 aa, Panicum virgatum
  misc_feature: Ceres CLONE 2012387
  misc_feature (96)..(158): Pfam Name: SNARE Pfam Description: SNARE domain
MLKQSIADKRVADMKLAKDFGATMEEFRKLQNLAIQREMAYKPVVPQNAQSNYTTDDRSAESGNMPEQRALLVESKRQEVLQLDNEIAFNEALIEEREQAIQEIQQQIGEVHEVFKDLATLVHAQGVIIEEIDMNIENSAEAIKEAKREVAKADKTQKSNSSLLCLLMVIFGVVLLVVIIVLAS

SEQ ID NO: 42496 - DNA, 671 bp, Panicum virgatum
  misc_feature: Ceres CLONE 2012408
  misc_feature: Encodes the peptide sequence at SEQ ID NO. 42497
actacaagctgctgccgctcaacctgggcctcttcttctccgacaaccagctgcgggtcaactccacgctcaacgcgtccgtcaacagcttcgcggccaacgagacgctgtggaaggaaaagttcgtcgccgccatgatcaagatgggcagcatcgaggtgctcacggggagccagggccagatcaggctcaactgtagcgtcgtcaacaacggctcgtcgtcgtccgtggcggcgccgaggatcgagacgacgacggcggtgccctactctggatccaccgcgtccctcgacaagatcgccaccagctgatcggcattataatatattgtgctgatgatgatatgtatgtttgtgcgcaccccctcctgctgtccatggtctttattaggttaattaatgttgtgttgtgttagtacctactactagtacgttatacggctatacacgagagtatacgcaagtgtgccgtgcgtacacaaaatttctagtcggttcggctggctgtggttgctggctggtgctgatttgctatgtggctggtgatgatttggtgtgagagaatgccagcagaacggagtgaattgtcaccatatgtatcccatcatgcaggaatgccgtgtatcatcactgaataaaaactggacgtcttacacaggcgggcttttaatt

SEQ ID NO: 42497 - protein, 102 aa, Panicum virgatum
  misc_feature: Ceres CLONE 2012408
  misc_feature: SWISSPROT Homolog: EC 1.11.1.7 Peroxidase
  misc_feature: Functional homolog of the protein sequence given in SEQ ID NO 51648
  misc_feature: Useful for making plants with altered cell wall content and/or composition
YKLLPLNLGLFFSDNQLRVNSTLNASVNSFAANETLWKEKFVAAMIKMGSIEVLTGSQGQIRLNCSVVNNGSSSSVAAPRIETTTAVPYSGSTASLDKIATS

SEQ ID NO: 42498 - DNA, 682 bp, Panicum virgatum
  misc_feature: Ceres CLONE 2012414
  misc_feature: Encodes the peptide sequence at SEQ ID NO. 42499
atctataataaattacgccccaccacctctccctcccccacccacccttcgcctgccaacccatttctcccgagccccgacgcgcgctgcctgcaccctcgccgccgccgccgcctctccagctcggaccccatggcttccctcgccggatccgccctctccctcgcgatgcccgtcaaggcaatcaacattaagtccgtctctttctctggtttaaggaaagataatgtaacattctgtcttcagccagtgccacaaagatttgcagtctgctgtcccgctaaaaaggagacagtggaccaggtttgtgatattgtcaagaagcagcttgcacttgctgatggcactgaagtttgtggctcctccaagttccaagatcttggtgctgattcattggacactgttgagattgttatgggcctcgaggaggcttttgggatcagtgtggaggagtcgagcgcacagtcaattgcaaccgtggaagatgctgctaatctcatcgatgaccttgttgctgcaaaatcgtcctaaacttgcagctgtagtacttatcctggccctgaactaaggcatctcttgtcccatgctccttccctgctagattttaccctggagagccatttctttgtcattactatcattgtggatcttgcaatattattacattaaagcgtttgtgttc

SEQ ID NO: 42499 - protein, 132 aa, Panicum virgatum; identical to SEQ ID NO: 35130
  misc_feature: Ceres CLONE 2012414
  misc_feature (56)..(123): Pfam Name: PP-binding Pfam Description: Phosphopantetheine attachment site

SEQ ID NO: 42500 - DNA, 650 bp, Panicum virgatum
  misc_feature: Ceres CLONE 2012421
  misc_feature: Encodes the peptide sequence at SEQ ID NO. 42501
gagtcacgggtcaggcgctctcccccccctgacccggcgccatgagccactacaccatgcatgcaaccatcaactacgccgcgctgccgcccacgtcgccgctggagctccccctcacgtacctcccgccgcctccgccgccgccgttatcgctcccgccgttgctttcgccgccgccaccaccggcggcggcggcggcgtccactgatgcggggttccagaggaggatcagccccagcgtcctcttcatcatcctgatcttggccgtcatcttcttcgtctccggcctgctgcacctcctcgtccggttccttctccgcccggcgccgcgggacgccggcgacgcgtacgggggcgacgcgaacgccaccgcgttccaggggcagctccagcagctgttccacctccacgacgccggcgtcgaccagtccttcatcgacgcgctgccggtgttcctctacggcgccgtggtcggcgctggcgggaaggaccccttcgactgcgccgtctgcctctgcgagttcgaggccgacgaccgcctccgcctcctccccaagtgcagccacgcgttccacgtcgactgcatcgacacgtggctgctctcgcactccacctgcccgctctgccgccgcagcctcctcgccgacttt

SEQ ID NO: 42501 - protein, 202 aa, Panicum virgatum
  misc_feature: Ceres CLONE 2012421
  misc_feature (154)..(195): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 1939 in the 11/479,226 US patent application
MSHYTMHATINYAALPPTSPLELPLTYLPPPPPPPLSLPPLLSPPPPPAAAAASTDAGFQRRISPSVLFIILILAVIFFVSGLLHLLVRFLLRPAPRDAGDAYGGDANATAFQGQLQQLFHLHDAGVDQSFIDALPVFLYGAVVGAGGKDPFDCAVCLCEFEADDRLRLLPKCSHAFHVDCIDTWLLSHSTCPLCRRSLLAD

SEQ ID NO: 42502 - DNA, 1923 bp, Panicum virgatum
  misc_feature: Ceres CLONE 2012424
  misc_feature: Encodes the peptide sequence at SEQ ID NO. 42503
gcccgtccgcagcagcaagaagtaaggctcagtacccatccatcacttgcccaaagcaagtaaggatcgatctcaaggacacatatatagctagctacttccctagctaggtagcccacccagatcatcatcgactcagtagcagatcgatcgagatcatggctctcgcatctctgtccaaggtggtgctcggctccatcgccttcggcgtcttctgggtgctggccgtgttcccgtcggtgcccttcatgcccatcggccgcacggccggcgccctgctcagcgccgtgctcatgatcatcttccacgtgatcagccccgacgacgcctacgcctctgtcgacctgcccatcctcggcctgctctttgccaccatggtggtcggcacctacctcaagaacgccggcatgttcaagcacctgggcaccctgctcgcctggaagagccagggaggccgtgacctgctctgccgcgtctgcatcgtcaccgcgctcgccagcgcgctcttcaccaacgacacctgctgcgtcgtgctcaccgagttcgtgctggagctcgccgccgagcgcaacctgccggccaagcccttcctgctcgcgctcgcctccagcgccaacatcggctccagcgccacgcccatcggcaacccccagaacctggtcatcgccttcaacagcaagatccccttccccaagttcctcctgggcatcctgcccgccatgctcgccggcatggccgtcaacatggccatgctcctctgcatgtactggaaggacctcgcgggggccagcggcggccctgctgcatacgacaagccgcagatggaggccgtcgaggagggcctgcaggcgtcaaagactccctccccgtccccagggaagctgaggacgaccaacggaggagcaggatacagctcgccgttgatgacagaggacatctccaccaagcacccctggttcatgcagtgcacggagcagcgcaggaagctcttcctcaagagcttcgcctacatcgtgaccgtgggcatggtgatcgcctacatggttgggctcaacatgtcgtggaccgccatcaccacggccatcgccctggtggtggtggacttccgcgacgccgagccgtgcctggacaaggtgtcctactcgctgctcgtcttcttctcaggtatgttcatcacggtgagcggcttcaacaagacggggctgcccggggccatctggaacttcatggcgccctactccaaggtgaacagcgtcggcggcatctcggtgctatccatcatcatcctgctcctctccaacctcgcctccaacgtgcccacggtgctgctgatgggcggcgaggtggcctccgcggcggcgctcatctccccggcggcggtgacgagatcgtggctgctgctggcgtgggtgagcacggtggcgggcaacctctctctgctgggctcggcagccaacctgatcgtgtgcgagcaggcgcgccgggcgctgcgcaatgcttacgacctcaccttctggaaccacatcgtcttcggcgtcccatccaccctcatcgtcaccgccatcggcatccccctcatcggcaagatcaacgtctagctagtcctgccgccagccaccatgcatatcaacgccggccggcctgaccagcatgcatccatctgcattattattgcatcgcctgggttcaacttcaacctggaataccacatatatgcagcatacgtgtatgtgtctatatatatatatatacacacacacacacgaaaactggacattagtaccgggcgggaacccatggtcagtaccgattccttgcccggtacggtccgatcggtactaaatgcactagtatttagtaccggtcagtccgatcagtactaaatagcgcatttagtactggtcagaaacaccaaccggtact

SEQ ID NO: 42503 - protein, 479 aa, Panicum virgatum
  misc_feature: Ceres CLONE 2012424
  misc_feature (16)..(423): Pfam Name: CitMHS Pfam Description: Citrate transporter
MALASLSKVVLGSIAFGVFWVLAVFPSVPFMPIGRTAGALLSAVLMIIFHVISPDDAYASVDLPILGLLFATMVVGTYLKNAGMFKHLGTLLAWKSQGGRDLLCRVCIVTALASALFTNDTCCVVLTEFVLELAAERNLPAKPFLLALASSANIGSSATPIGNPQNLVIAFNSKIPFPKFLLGILPAMLAGMAVNMAMLLCMYWKDLAGASGGPAAYDKPQMEAVEEGLQASKTPSPSPGKLRTTNGGAGYSSPLMTEDISTKHPWFMQCTEQRRKLFLKSFAYIVTVGMVIAYMVGLNMSWTAITTAIALVVVDFRDAEPCLDKVSYSLLVFFSGMFITVSGFNKTGLPGAIWNFMAPYSKVNSVGGISVLSIIILLLSNLASNVPTVLLMGGEVASAAALISPAAVTRSWLLLAWVSTVAGNLSLLGSAANLIVCEQARRALRNAYDLTFWNHIVFGVPSTLIVTAIGIPLIGKINV

SEQ ID NO: 42504 - DNA, 1945 bp, Panicum virgatum
  misc_feature: Ceres CLONE 2012429
  misc_feature: Encodes the peptide sequence at SEQ ID NO. 42505
gatcagatatctattgctatcaagtttgcaggtgtaccatgcagaccaagtaaaaaataccacagatctcatctaagctgagattccttttttcccgtcacagatactttcaccatttgccaagtcttgttttgggcctttgttctacaaacaacggtacccaatgtttggaaaggcgttggttggttgatccatttcattcattcgtcagaaagcaaaacaagtctcagctctcaactgacaaggagtagcgctgcggctgccaacacttgcctgccatagtccaatggcaaccgcatccgacagcacccactcgcctccttccgtcccccacggccacgacgaggatgacgatgacgaattcgacgacgacgacgagccctcggcgtccccgtccgaggaggcgcgccacgaggccgtgctccggcggctcaccgccgatgaggtccggatccgggtgtaccaggtcacgatccggggttgcgcccgcacgcgccgcgccgcggtcgaggctgcggtgggcccggacctcgcgcgcgccgccaccgtgcgagacctcgtgcgcgccgccgccgcggccggcgaccgcctccgtcgcctcgccgccttcgatactgtctccatcacgctcgacgcggctccgtcagggatccccggcagcgccgtcgtcgtacttgttgacgtcgcagaggcccgcggccgcgctgccgctgaattcggcgtcttcgccaccacccagactcggtcatgttcacttgaaggttcactgaagttgaagaacctatttggatactgtgagacctgggatgcagcaggtgcccttgaattagataagacaacagaactaagtgctggagtggaaatgcctagaatcggagcgataccaactccgctggtggctagaatatcatttctgtccgaggactggttaaagtcctcactcaaagaacacctgatgggcgtttctgttggcttgctctccaccatgaaccacaaccttgcttacaatttgacatggcgaaaattaactgatccagcacgcaggtcatccaattctgtacaagaacagttagggcatagccttttgtcctctgttaagtatgcatacacggttgaccaaagggactcaagcataaggcctacacgtggatatgcttttctgtcgtcttctcaagtaggaggtcttgcaccggggagcagatgctcacggtttcttagacaggaattcgatcttcgagtggcgttgcctctgggtgtgcttaatagtgctctcaatgctggagttgcggcaggagtcatccatccattggaaaggggatccacaggatctgtctcaccactttcagaaaggttttacttgggaggtaacaggtctcttatatgccgcttgggtggaccatcgtcactcttaggcttcaaaacaagaggactaggagcaagggaattcagaacctgtgaccccaacaattctgaaaatggtagttccagttgtcctgagctaattggtcctggtggtgacatagcagtgacagcatttgcagacctctcctttgatatacctctgaagccactcagggatctaggaattcatggccatgcatttgtctgtgctggaaatcttggtaaattaactgagtgtgatctacggaaatttccccttactgacttcctacaaacgttcaggagttctgcaggatttggtgtagtcctgccaaccagattgtttcgcatagagataaattactgccacatcctgaaacagtttgaccatgataagggaaagccgggcatacagttaaactttgcttcaccctaatttcattggcaatatgttcacatcaagatgaatagttgtatttcccccctcactattctgatttttttatccttttgacaagagcttaccttgcacactcttaagtgataaattacttgttctgggctg

SEQ ID NO: 42505 - protein, 509 aa, Panicum virgatum
  misc_feature: Ceres CLONE 2012429
  misc_feature (165)..(506): Pfam Name: Bac_surface_Ag Pfam Description: Surface antigen
MATASDSTHSPPSVPHGHDEDDDDEFDDDDEPSASPSEEARHEAVLRRLTADEVRIRVYQVTIRGCARTRRAAVEAAVGPDLARAATVRDLVRAAAAAGDRLRRLAAFDTVSITLDAAPSGIPGSAVVVLVDVAEARGRAAAEFGVFATTQTRSCSLEGSLKLKNLFGYCETWDAAGALELDKTTELSAGVEMPRIGAIPTPLVARISFLSEDWLKSSLKEHLMGVSVGLLSTMNHNLAYNLTWRKLTDPARRSSNSVQEQLGHSLLSSVKYAYTVDQRDSSIRPTRGYAFLSSSQVGGLAPGSRCSRFLRQEFDLRVALPLGVLNSALNAGVAAGVIHPLERGSTGSVSPLSERFYLGGNRSLICRLGGPSSLLGFKTRGLGAREFRTCDPNNSENGSSSCPELIGPGGDIAVTAFADLSFDIPLKPLRDLGIHGHAFVCAGNLGKLTECDLRKFPLTDFLQTFRSSAGFGVVLPTRLFRIEINYCHILKQFDHDKGKPGIQLNFASP

SEQ ID NO: 42506 - DNA, 230 bp, Panicum virgatum
  misc_feature: Ceres CLONE 2012437
  misc_feature: Encodes the peptide sequence at SEQ ID NO. 42507
caggtctccctgcacttcctcgagatctggttacagatctctctgtcatcatggtgaagatctgctccatcggtgttggctatgtcggtggccccaccctggccgtcgttgtctctctgtgccccgaccattgacgtcgtcgtcgccgacatctccaagccccgcgttgcagcctgcagcggtgactccctccccatctaccagcctggtctcgatcatgtggagacgcc

SEQ ID NO: 42507 - protein, 49 aa, Panicum virgatum
  misc_feature: Ceres CLONE 2012437
  misc_feature: SWISSPROT Homolog: EC 1.1.1.22 UDP-glucose 6-dehydrogenase
  misc_feature: Functional homolog of the protein sequence given in SEQ ID NO 51302
  misc_feature: Useful for making plants with altered carbohydrate content
  misc_feature: Functional homolog of the protein sequence given in SEQ ID NO 51649
  misc_feature: Useful for making plants with altered cell wall content and/or composition
MSVAPPWPSLSLCAPTIDVVVADISKPRVAACSGDSLPIYQPGLDHVET

SEQ ID NO: 42508 - DNA, 1328 bp, Panicum virgatum
  misc_feature: Ceres CLONE 2012443
  misc_feature: Encodes the peptide sequence at SEQ ID NO. 42509
gcacaccacacacgccgcaccttcgcttccccttcgcctccgtctctcctctccccgcgcagatctagcgatggcggcggcggcggcggcgggcggcgagccggcgtgggggtaggcgcccgcggggcggcgccggcccaagaccaagatcgtctgcacgctcggcccggcctcgcgctccgtcgagatgatctcgcgcctgctgcgcgccggcatgtccgtcgcgcgcttcaacttctcccacggctcccacgagtaccaccaggagacgctcgacaacctccacgccgccatggagcgcaccgggatcctctgcgccgtcatgctcgacaccaagggtcccgagatccgaactggatttttgaaagatgggaagcctgttcaattgaagaagggtcaagaaatcacagtttccacagattataccattaagggtgatgagaaaatgatatcgatgagctacaagaagcttgcggtggatctgaaaccaggcagtgtcatattgtgtgctgatggtaccatcactcttactgtgcttcactgtgataaagagcaaggcttggttcgctgccgttgtgagaacacttctatgcttggtgagaggaagaatgttaatcttccaggagttattgttgatctcccaacactcactgacaaggacaaggaggatatccttaagtggggtgtcccaaacaagattgacatgattgccttgtcgtttgttcgcaagggttcggatcttgtggaggttaggaaggtacttggcgagcatgccaagtccataatgctgatgtcaaaggttgagaatcaagagggagtagctaactttgatgatatcctggcaaactctgatgcgtttatggtggcaagaggtgatttagggatggaaattcctatagagaagattttctttgcgcaaaaggtgatgattttcaagtgcaacattcagggcaagcctgttgttactgccactcagatgttggaatctatgatcaaatctcctcgccctactcgagcagaagcaactgatgttgcaaatgcagtgcttgatggcagcgactgtgtcatgcttagtggggagacagctgctggagcatatccagagctggctgtgcagactatggccaagatctgcttgcaagcggagtcttgtgttgactatggtgctgttttcaaatcaatcatggcctcagctccaattccaatgagcccattggagagccttgcatcatcagctgtccgcacagcgaactctgccaaggcagcactgatcttggtcctgaccagggaaggaacaactgctaggcttgtggccaagtataggccat

SEQ ID NO: 42509 - protein, 380 aa, Panicum virgatum
  misc_feature: Ceres CLONE 2012443
  misc_feature (1)..(329): Pfam Name: PK Pfam Description: Pyruvate kinase, barrel domain
  misc_feature: SWISSPROT Homolog: EC 2.7.1.40 Pyruvate kinase
MISRLLRAGMSVARFNFSHGSHEYHQETLDNLHAAMERTGILCAVMLDTKGPEIRTGFLKDGKPVQLKKGQEITVSTDYTIKGDEKMISMSYKKLAVDLKPGSVILCADGTITLTVLHCDKEQGLVRCRCENTSMLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGSDCVMLSGETAAGAYPELAVQTMAKICLQAESCVDYGAVFKSIMASAPIPMSPLESLASSAVRTANSAKAALILVLTREGTTARLVAKYRP

SEQ ID NO: 42510 - DNA, 703 bp, Panicum virgatum
  misc_feature: Ceres CLONE 2012453
  misc_feature: Encodes the peptide sequence at SEQ ID NO. 42511
aacccgcccattcccgcacgaagccgacgagccgccgccgccgcgcaagagcttgtgaggggcttcggaggaaggccgggtaaggcaagatgcagatcttcgtgaagaccctgacggggaagaccatcaccctcgaggtcgagagcagcgacaccatcgacaatgtcaaggccaagatccaggacaaggaaggcatcccgccggaccagcagcgcctgatcttcgccgggaagcagcttgaggatggccgcacccttgccgactacaacatccagaaggagtccaccctccacctcgtcctccgcctccgcggtggcatcattgaaccctctctccaggcgctcgcccgcaagtacaaccaggacaagatgatctgccgcaagtgttatgcacgtcttcaccccagggcagtcaactgccgcaagaagaagtgtggccacagcaaccagctgaggcccaagaagaagatcaagaactgaggcatggcgtatcggttccatgggtcgtccggatcaactagagcgtccgagtttaagtttttgcagctgcataatgctgcctctgttttgagtcagaacttagtggtctttctgttcaggttcttcagcatgtatttgctggcataaatttgtgacagaaatttgggtttatattatatggtagattataactctataaattcgtggtcgtcgatacttgtgtt

SEQ ID NO: 42511 - protein, 129 aa, Panicum virgatum; identical to SEQ ID NO: 41506
  misc_feature: Ceres CLONE 2012453
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time

SEQ ID NO: 42512 - DNA, 678 bp, Panicum virgatum
  misc_feature: Ceres CLONE 2012454
  misc_feature: Encodes the peptide sequence at SEQ ID NO. 42513
acaccggcttattgcctcagcattcagcaacaggcactccaaatcagctgccatcccggccggcgccggatcgccgcgcctcctctgctgcctcttcctggccctctccctggccgcggcggcgcgcgccgccacgcgccaccacgagtgggagatcagctaccagttcaagcactcggactgcgtgcgcaagctcgccgtcaccatcaacgggcagacccccgggccgaccatccgcgccgtgcagggcgacaccgtggtggtccgggtcaagaactcgctgctgacggagaacgtggccatccactggcacggcatccggcagatcggcacgccctgggccgacggcaccgagggcgtcacgcagtgccccgtcctccccggcgacgtcttcacctacgccttcgtcgtcgaccgcccgggcacctacatgtaccacgcgcactacgggatgcagcgctcggcggggctcaacgggctcatcgtcgtcgcggcggcgcccggcgggcccgacgccgagccgttcgcgtacgacggcgagcacgaggtgctgctcaacgactggtggcacaagagcacctacgagcaggcggcggggctggcgtcggcgcccatcgtctgggtcggggagccgcagtcgctgctcatcaacggccgcggcaggttcgccaactgctc

SEQ ID NO: 42513 - protein, 225 aa, Panicum virgatum
  misc_feature: Ceres CLONE 2012454
  misc_feature (51)..(168): Pfam Name: Cu-oxidase_3 Pfam Description: Multicopper oxidase
  misc_feature: SWISSPROT Homolog: EC 1.10.3.3 L-ascorbate oxidase
HRLIASAFSNRHSKSAAIPAGAGSPRLLCCLFLALSLAAAARAATRHHEWEISYQFKHSDCVRKLAVTINGQTPGPTIRAVQGDTVVVRVKNSLLTENVAIHWHGIRQIGTPWADGTEGVTQCPVLPGDVFTYAFVVDRPGTYMYHAHYGMQRSAGLNGLIVVAAAPGGPDAEPFAYDGEHEVLLNDWWHKSTYEQAAGLASAPIVWVGEPQSLLINGRGRFANC

SEQ ID NO: 42514 - DNA, 688 bp, Panicum virgatum
  misc_feature: Ceres CLONE 2012455
  misc_feature: Encodes the peptide sequence at SEQ ID NO. 42515
agagtcgagcgcccccccagctagcccaggccatcgatccatccatccagccggggccagggccagcgccaccaccccaacgaacgcgtacaccaccaacgacgccgaccacttctagggaggaggacccgaccgacccgacccccgcgagggcgagggcgagggcgagcggcgagccgggggccaaggggggattcccctcgtcgtcgtcggcggcggccatgggcgcggcctccgcggcgatgtgggccgggctcgtgctggcggccttgttattggcgcaatcggcggcgggggcggcggcgggggcgctgccgaggttcgccgaggcgcccgagtaccggaacggggaggggtgcccggcgccggtggcgggcgcgggggtgtgcgacccgggcctggtgcacatcgccatgacgctcgacgcgcactacctccggggctccatggcggccatctactcgctgctcaagcacgcctcctgcccggagtcgctcttcttccacttcctcgccgcggggggcggcggcgcgccgccggtcgccgacctccgggccgccgtcgccgcctccttcccctccctgcgcttcgagatctacccgttccgcgccgacgcggtcgccgggctcatctccgcctccgtgcgcgccgcgctcgaggcgccgctcaactacgcgcggaaccacct

SEQ ID NO: 42515 - protein, 155 aa, Panicum virgatum
  misc_feature: Ceres CLONE 2012455
  misc_feature: Functional homolog of the protein sequence given in SEQ ID NO 51650
  misc_feature: Useful for making plants with altered cell wall content and/or composition
  misc_feature: Functional homolog of the protein sequence given in SEQ ID NO 51651
  misc_feature: Useful for making plants with altered carbohydrate content
MGAASAAMWAGLVLAALLLAQSAAGAAAGALPRFAEAPEYRNGEGCPAPVAGAGVCDPGLVHIAMTLDAHYLRGSMAAIYSLLKHASCPESLFFHFLAAGGGGAPPVADLRAAVAASFPSLRFEIYPFRADAVAGLISASVRAALEAPLNYARNH

SEQ ID NO: 42516 - DNA, 748 bp, Panicum virgatum
  misc_feature: Ceres CLONE 2012474
  misc_feature: Encodes the peptide sequence at SEQ ID NO. 42517
gatcccatcctctcctctttcctcatgccgacggtggcgtctctgatgttgaagctctcccgtgacgcagctcgcgccgcccgcttggctgcatctgccgcatcacgctgtgcggagatggtgcgtcgccgaggttcagacggtgcggccgctccagatccgctgctgcgccctacaaccacccgctcctccgcatcagccgatccgccgccgccgggccgccccgcttcgccaacatctccatccccgatcctccaccagttaaatttccggtgatggaggctgacatggcttcagatgaagcactgtgggccttctatgagcgttggtgcaaggctttcaaccaggagcgtcaacctgatgagatggctcgccgattcagcaagttcaaggaggttgtgctgagggtggacaggcacaacaaagccaatctttcctccaaacttgggataaacaaatttgctgataggaagaatattgagcttatgaggatgaagaggttgtgactccaagaaagtccttgagggacatcaactgaactccccagatcaatcaccatgaatcgccataaccactgaatcttgaactagttgcaaccctgaatctgtaataagttatgcttgtttgtaccaggtcgtgcttcagaaccaagcctgtgccttcttcaaggcatgtaatagcttctactaagctatatgtgctcgtactatgttgtgctctgcttttgtaagatatgcaactttctgtc

SEQ ID NO: 42517 - protein, 76 aa, Panicum virgatum
  misc_feature: Ceres CLONE 2012474
  misc_feature (15)..(70): Pfam Name: Inhibitor_I29 Pfam Description: Cathepsin propeptide inhibitor domain (I29)
  misc_feature: SWISSPROT Homolog: EC 3.4.22.2 Papain
MEADMASDEALWAFYERWCKAFNQERQPDEMARRFSKFKEVVLRVDRHNKANLSSKLGINKFADRKNIELMRMKRL

SEQ ID NO: 42518 - DNA, 1120 bp, Panicum virgatum
  misc_feature: Ceres CLONE 2012486
  misc_feature: Encodes the peptide sequence at SEQ ID NO. 42519
agggtcttgcaaatcccaatccatcggtgctccgctccgctgctcatctgcctcttactgacaatggtaatgttcatccggtttgctcatcgatttctcgccatttattaaggggcctgcctggatgcacgcagggtgtgtttgagcttcgcgtcaagcagcaaggggagccggcgctggtgccgccggcggcggagacgccgaagggctcctactacctctccaacctggatcagaacatcgccgtcatcgtgcagaccgtgtactgcttcagcggggctgacgacggcgacggcgacagcagcagcgccggcgtcgtgctgagggagtccttggcgaaggtgctcgtccactactatccgctcgccggccggctgacgatcagcggcgaggggaagctggccgtcgactgcacgggcgaaggcgccgtcttcgtggaggccgaggcggactgcgccatggcggacatcggcgacgtcaccgagcccgacccgtcggtgctcggcaagctcgtgtacagcgtccccggcgccaagaacatactcgagatgccgctgcttgcggcccaggtgaccaagttcaagtgtggcggcttcgtgctcgggctggccatcaaccactgcatgttcgacggcgtcggcgccatggagttcgtcaactcgtggggcgagacggcacgcggcctcccgctctcgctcccgccggccctcgaccgcgccatcctccgcgcgcgcgacccgccgcagctcgagttcccacaccacgagttcgcgcagatcaccgacgacgacagcgacgaggtcgccccgccgccgcacgacggcgatccgctcctgcaccggtcgttccggttcacgccggcgtccatcgcgcggctgaaggcgctggcgctgctggagggccgcccgtgcaccacgttcgaggcgctggccgggttcgtgtggagcgcgcgcacgcgggcgctggggatggggccctcgcggcggagcaagctcctgttcgccgtggacgggcggccgaggttcgctccgccgctgcccgcggggtacttcggcaacgccatcgtgctcaccagcgcggcgtgcgcggcgggggagctggcggcgtcgccgccgcgcgc

SEQ ID NO: 42519 - protein, 372 aa, Panicum virgatum
  misc_feature: Ceres CLONE 2012486
  misc_feature (47)..(372): Pfam Name: Transferase Pfam Description: Transferase family
  misc_feature: SWISSPROT Homolog: EC 2.3.1.162 Taxadien-5-alpha-ol O-acetyltransferase
  misc_feature: Functional homolog of the protein sequence given in SEQ ID NO 51652
  misc_feature: Useful for biocontainment applications
GLANPNPSVLRSAAHLPLTDNGNVHPVCSSISRHLLRGLPGCTQGVFELRVKQQGEPALVPPAAETPKGSYYLSNLDQNIAVIVQTVYCFSGADDGDGDSSSAGVVLRESLAKVLVHYYPLAGRLTISGEGKLAVDCTGEGAVFVEAEADCAMADIGDVTEPDPSVLGKLVYSVPGAKNILEMPLLAAQVTKFKCGGFVLGLAINHCMFDGVGAMEFVNSWGETARGLPLSLPPALDRAILRARDPPQLEFPHHEFAQITDDDSDEVAPPPHDGDPLLHRSFRFTPASIARLKALALLEGRPCTTFEALAGFVWSARTRALGMGPSRRSKLLFAVDGRPRFAPPLPAGYFGNAIVLTSAACAAGELAASPPR

SEQ ID NO: 42520 - DNA, 714 bp, Panicum virgatum
  misc_feature: Ceres CLONE 2012503
  misc_feature: Encodes the peptide sequence at SEQ ID NO. 42521
tgaatcctcaactcccgacccaaccaccccagcgagagagaggagggaaggagcagcggcggcggcgaggtctatggcgtcgacggcggggttcctggcgcggcgggcggcgcagaaggagcgggtgcgcctgctctaccgccgggcgctcaagggcacgctcaactgggccgtccaccgccacctcttctaccaggatgcgtcggatctcagggacaagttcgaggccaaccgacatgtggataacctggacgtaatcgataggctcatcgaggatgcagaggctcagtacaggaatttccagcaccccgatccctacatcgttccatgggcacctggtggcactaaattcacaagaaaccctcctccacctcaagggattgagatcgtctacaattatggcaaggaggactagtaaacaagagtcctgcaagtggggacagaactcggcacatccagagttctaaatcacttcttgtttgatcgagttgttgtacgagaaataagaatgaaatagctggacttaatctgtgtttctcattttccatgtatgcttgttctaataaccctgtggtcttcatctagtcattggtcaagtgatgtttgccgtgacacaatggagttttgctttatttgtcaatgcagttaagcgcaaactgatgggccgcatgtcacctgtaccccattggccctctggctggctatacccaagtt

SEQ ID NO: 42521 - protein, 113 aa, Panicum virgatum
  misc_feature: Ceres CLONE 2012503
  misc_feature (13)..(78): Pfam Name: Complex1_LYR Pfam Description: Complex 1 protein (LYR family)
MASTAGFLARRAAQKERVRLLYRRALKGTLNWAVHRHLFYQDASDLRDKFEANRHVDNLDVIDRLIEDAEAQYRNFQHPDPYIVPWAPGGTKFTRNPPPPQGIEIVYNYGKED

SEQ ID NO: 42522 - DNA, 1793 bp, Panicum virgatum
  misc_feature: Ceres CLONE 2012512
  misc_feature: Encodes the peptide sequence at SEQ ID NO. 42523
aggtgtgccatgcacctgctatagctagtccactataggactgcaagcaaggcgcactgcctaccctttgcatctcttcacacacccacccaccgagactacgcatacatatctgcccaatcaacccattagcggtcgtctccgctcctacttgcagaactgaaacgcagtagctcatagcagagcagctagtgcaatggatcttcaatctgcgagcatgttgcagagcatccatggccgtatcagcaacatggggccgctggctccgcctcttgttgtcgtgggtgcgaccctgatgtgcatttggttagcccactactttctcaaaaagataaaccacagacgacgaatggagaggttcggtcctattttcaagacaaacttggtcggtaaggacctgattgtctctcttgacccggacatcaaccactacgtgctccagcaagaggagaaggcgttccacatatggtttccggaatcgttcatgagactcctgggcgaggagaacatcgccaaagtttacgggtccctgcacaagaacactaggaacatgatccgccgagtcttcggcccagagaacctcaggctggtgctgctccatgatatgcaaggtgccgtggagaagacccttagctcctggcacgacagcggaagcgttgaactcaaacctgccctctcaagtatgatatttggtattgctgccaaatggatgattggtcacgaggcgtcggtattatcaggggatctgtggaaaaattttgatgcgttcaaccaaggactgttgtcctttccgctttatatccctggaacagcgttctacagatgtatgcagggacgcaataatgtcatgaagaccttgaagcaagtgcttgacgagagaaggaaaaaggcagaaacaccggaaaggatggatttcattgacgttatagtcagcgagttaaataaggagaatcccgcgctctccgaaaaccttgctttaaatgtgctattcttgatgatatttgctagctttgagacaacatcatctggactaactgcagcactcaagtttctatcagacaaccctagagcattacaagaactagaggaggagcatcagcagatccgggcaagaagggctgatccgaacacaggagtcacttgggaggaatacaaatccatgaaattcacctcccatgttataaatgaatcattaaggctagccaacgtcgcccctgtgttgtttaggaaagcaacacaagatgtcaacataaaaggttatactattccagagggatggatattgatgatctgtcctccagcagttcatttcaatcctaccaaatatgaggatcccaatgtcttcaatccatggagatggaaggatctttcggaaccagttgggagctccaaggattttattgcctttggatccggattgaggttatgtgtcggtgtagactttgcaagacttcaaatgactatgttcctccacttcttagtcaccaagtatagattgaaggtggtcagtggtggggacatggtttttggccctggactagggtttcctaatggatttcaaatccaacttgaacgcaaaaaataattttgtcggatctacaatatctcagcaatttttctcattttgtatgcatgtagttatgctatcaactcaaataatgtaccataaacaaatgatgtcttgatctgtgttgcttgtatgatctgctgatcttatgtaagtggacgtacatcacaatgatcttatatttgctatttaagtgctacaaataaactagcaagttgatggatac

SEQ ID NO: 42523 - protein, 462 aa, Panicum virgatum
  misc_feature: Ceres CLONE 2012512
  misc_feature (21)..(458): Pfam Name: p450 Pfam Description: Cytochrome P450
  misc_feature: SWISSPROT Homolog: EC 1.14.13.93 (+)-abscisic acid 8'-hydroxylase
MDLQSASMLQSIHGRISNMGPLAPPLVVVGATLMCIWLAHYFLKKINHRRRMERFGPIFKTNLVGKDLIVSLDPDINHYVLQQEEKAFHIWFPESFMRLLGEENIAKVYGSLHKNTRNMIRRVFGPENLRLVLLHDMQGAVEKTLSSWHDSGSVELKPALSSMIFGIAAKWMIGHEASVLSGDLWKNFDAFNQGLLSFPLYIPGTAFYRCMQGRNNVMKTLKQVLDERRKKAETPERMDFIDVIVSELNKENPALSENLALNVLFLMIFASFETTSSGLTAALKFLSDNPRALQELEEEHQQIRARRADPNTGVTWEEYKSMKFTSHVINESLRLANVAPVLFRKATQDVNIKGYTIPEGWILMICPPAVHFNPTKYEDPNVFNPWRWKDLSEPVGSSKDFIAFGSGLRLCVGVDFARLQMTMFLHFLVTKYRLKVVSGGDMVFGPGLGFPNGFQIQLERKK

SEQ ID NO: 42524 - DNA, 703 bp, Panicum virgatum
  misc_feature: Ceres CLONE 2012552
  misc_feature: Encodes the peptide sequence at SEQ ID NO. 42525
ctcctcagatcccgattcgatcagccgccatgggggcccgctcctcttcgcagtcccagtcctcgcgcggcacggccgcagctgccgccggcatgcgccgccaacgcgccaccgccagaaccgccagagggggcttctccggcggcggagggagcaacatgcatcgattctgcaccgacgaggccccgggtctgcgcctctcgccaaccatggtgctcgtcatgtcgctgtgcttcatcggattcgtcaccgccctctacgtcttcggcaagctctaccgctcccgcaccgcagcagcctccgcgtgatccatcccatcgcatccctccggcgcgagtatcatcagatcacaaggttttcaatatatcatcatcagtctacttactcgtcttgcctagctttccttcctgtgctagatctggagggagatgaatggaaccctacaacttaaatgatgccctttcttttgccttgttcatcccctttcctttttttagtgcctttttatttactcccagatgcaaagagttgtgcctagtcactgtaatcatggggattgctacaattaattttgcatctcagtaacttagcgtgtgctccaggaatcgtgcatcttgcttctgaatttgttacttgcttaaccatccatctttgtttgctggcattagaaaattggattggatggctccttcgccctggtgat

SEQ ID NO: 42525 - protein, 92 aa, Panicum virgatum
  misc_feature: Ceres CLONE 2012552
  misc_feature (38)..(83): Pfam Name: Sec61_beta Pfam Description: Sec61beta family
MGARSSSQSQSSRGTAAAAAGMRRQRATARTARGGFSGGGGSNMHRFCTDEAPGLRLSPTMVLVMSLCFIGFVTALYVFGKLYRSRTAAASA

SEQ ID NO: 42526 - DNA, 1837 bp, Panicum virgatum
  misc_feature: Ceres CLONE 2012557
  misc_feature: Encodes the peptide sequence at SEQ ID NO. 42527
ataatctcaaaaactaaatctcatttattaccacagcctctaaacatgtcttgtttagcctgcataaccctcccaatttatggccttatcctgtttgttgtctatcaatactacaggttcttcatgaagcccaaggcccagcttgctcactatgaaaagcaaggacttcccgtcatctttgctcctttctacggcttcctccaaggtctcactgaaggtgtccaaaaacacaaggatctcttctatggctggaaacaactcaattacatgaaccccaagcccagagcttttgccagcaaccttggtgccgctcccgttgttggtttaaaagaccctgaacttatcaaggctttcttccagacccaagaaaaaagctacatcaaggctcctgctgcttgcgacgttgctaagatgatcctcagaaatggtaccctccttgttgacggaagcacttggaaggcccacagaaagctctccaaccctctttacagctttgaccacgtcaaggaaagaatccccgaaatcaccgccgtcgccaacaagatgctcgaaaaactcaaggaaaaagatcttaagaaagttaacttcatgagagaaatgcaacatattctccttgaaatcaccggaaagctcttcttcgatctcgaacttagcaccctctcattcaaaggagataccgtctctggtttcgtcgctgacttgatcgacagatctgctgttgaagccctcacccccttcaccatcttcttctccactgatatcgtcaagactggcatccacccccgccacaaggcccttgttaaggatatcaatgaccttagaggattcctttatggtgctgccaaggctaagctcggagaaattcttgctgctaaagccaacggaaccgacactggaaaactccccctcttgctcgaaatcctttatcagcaacaccaaaaattgactgaagaacatttggatgaagtcgatcttgtcgatgaattcgccatgttcactttgggatctatggacaccaccagtcacgtcatcactatgaccagttacttccatctcaactgccctgaatcccaaaagaaactcaaccaagaagtcaacgaaaccttcaaggatgtctctcaaatctccttggacaacctcagcaagatggactacatgaccgctgtcatgagagaaaccctcagaatggcccctcccctccccaacttcctccccagacaagccactgaagaccacaagctcggtgaccttgatatcagagccggaactattgtcgttgtcgctggtgttaccaacaactgtgaccctgaataccacgatgaacccaacactttcaaccctgaaagatggcttgacgaaaagagcagaaccagacaaagcactggcaagaattcatatatcagtcttcccttctttactggccccagagtctgcccaggaaaagaattgggcaccaatttggtcagaatcgtctttggcctctttgtcaagaagttcaactacgaatacactgacaagaactacgaaatggccttcactaccaagttgttccaagaacctttggaaactttgaactactctttgacccccaagaactgagtataaagcgaataaataaaaattactatgagattaaatatcaggtagtattataaaaattccttggacttttctcaagtctttggattaattcaaaaaagtatatggttacttgtgtgcataatgagaagatagtagtaactcaattctttaaaaaaacggtttttcaaattcgtattctgttcatacatatttgcttatttattatttagtctcatctatgatcaatcaatcaaac

SEQ ID NO: 42527 - protein, 517 aa, Panicum virgatum
  misc_feature: Ceres CLONE 2012557
  misc_feature (41)..(515): Pfam Name: p450 Pfam Description: Cytochrome P450
  misc_feature: SWISSPROT Homolog: EC 1.14.14.1 Unspecific monooxygenase
MSCLACITLPIYGLILFVVYQYYRFFMKPKAQLAHYEKQGLPVIFAPFYGFLQGLTEGVQKHKDLFYGWKQLNYMNPKPRAFASNLGAAPVVGLKDPELIKAFFQTQEKSYIKAPAACDVAKMILRNGTLLVDGSTWKAHRKLSNPLYSFDHVKERIPEITAVANKMLEKLKEKDLKKVNFMREMQHILLEITGKLFFDLELSTLSFKGDTVSGFVADLIDRSAVEALTPFTIFFSTDIVKTGIHPRHKALVKDINDLRGFLYGAAKAKLGEILAAKANGTDTGKLPLLLEILYQQHQKLTEEHLDEVDLVDEFAMFTLGSMDTTSHVITMTSYFHLNCPESQKKLNQEVNETFKDVSQISLDNLSKMDYMTAVMRETLRMAPPLPNFLPRQATEDHKLGDLDIRAGTIVVVAGVTNNCDPEYHDEPNTFNPERWLDEKSRTRQSTGKNSYISLPFFTGPRVCPGKELGTNLVRIVFGLFVKKFNYEYTDKNYEMAFTTKLFQEPLETLNYSLTPKN

SEQ ID NO: 42528 - DNA, 1204 bp, Panicum virgatum
  misc_feature: Ceres CLONE 2012583
  misc_feature: Encodes the peptide sequence at SEQ ID NO. 42529
aaatttaaaacctaattagaaaataataagatgacatattttggcaataaaagaggtgaggtcaaggaactggagagaaacttggccgactttaatgttgatgtgaagttgactgctcttcgtaacattatctttgctatgactttgggcaaagatgtgtcaatgttatttatggcggttctcaagaacatggaaactcaaaacatcgaattgaaaaagttggtctacttgtacgtgatgaactacgccagatcacatcccgataaagccatcatgggtataaatacttttagaaaagattccagagaaagatcaaacccccttttgagagccctcgctatcagaactatgggctgcatcaagattgagcaaattgtcgaatacttgattgatcccttaaaggaggctttgagagacgaggattcctacgttagaaagactgccgttttgtgcgctgcaaagatgtacgaaatcaaccctgcagttattgagcaacaaggattcttgaaggttatcgagaaccttttgaccgatggtaatgctatggttgtttccaacgccgttgctgcccttcaacaaattgctgaaggtagaggaacctacgcaattgatttgaagccttacaccgttcaaaaacttttgacagccatcaacgaatgcaacgaatggggccaaactgttatcatcgatagtttgtcaaactacattcccgctgatcctaaagaaactgaagatattttggacagagtttcctcaagattgtcccattctaaccccggtgtggttatcgcaaccgtcagactgagcattagatacctcgattatttgaccaaccccgattcaatcagaaagtacactaaaaagctcggagctccccttgtctccctcttgtcttcagaaagcgaagttgtctatgttgctttgaagagcatcaatatcattcttcaaaagagacccaatgtcttggaaaaggaattaaagatgttcttctgccaatactctgatcctatttacattaagctcgaaaagctcgatattttggtgaagctcggagatatgaagaacattgatttgattctccacgaattgaaggaatatggtaacgaagtcgatgttgagttcgtgagaaagtccatcagaaccatcggcagactcgcaatcaagctcgacggcgcttctgagagatgcgctcaagcccctttgg

SEQ ID NO: 42529 - protein, 391 aa, Panicum virgatum
  misc_feature: Ceres CLONE 2012583
  misc_feature (7)..(391): Pfam Name: Adaptin_N Pfam Description: Adaptin N terminal region
MTYFGNKRGEVKELERNLADFNVDVKLTALRNIIFAMTLGKDVSMLFMAVLKNMETQNIELKKLVYLYVMNYARSHPDKAIMGINTFRKDSRERSNPLLRALAIRTMGCIKIEQIVEYLIDPLKEALRDEDSYVRKTAVLCAAKMYEINPAVIEQQGFLKVIENLLTDGNAMVVSNAVAALQQIAEGRGTYAIDLKPYTVQKLLTAINECNEWGQTVIIDSLSNYIPADPKETEDILDRVSSRLSHSNPGVVIATVRLSIRYLDYLTNPDSIRKYTKKLGAPLVSLLSSESEVVYVALKSINIILQKRPNVLEKELKMFFCQYSDPIYIKLEKLDILVKLGDMKNIDLILHELKEYGNEVDVEFVRKSIRTIGRLAIKLDGASERCAQAPL

SEQ ID NO: 42530 - DNA, 512 bp, Panicum virgatum
  misc_feature: Ceres CLONE 2012583-R
tcttaagaccaatgttgatattctcatcttctttgttccttgctctttatccgttttattgttgaaagatgcagcagtatcaacaagtgagtatcaagaactttcaacaaagggataccccaagactcaaaacagtttgaagactactttgacaaaggaccaaattaaaaccaagtttaatgataatgatgtgatgtatgttgcaagcagaacaaacaattctggagttgaaatgatgagttactctgccaagattgtgaacggcatgacagtcacctttgacgctattttggatgaagctgccggaaatttacaaatgtcatactctgccccttatgattcgattttacctttgttctatcaagctgttggttttattctcaacatgtaatctttgaataatgtattgattgatgaataaatctgaaaagaggcaaaaattcaataaaatagcttaacaaattatatacataaatatatgtcaactttttattcacactttaaaccttttg

SEQ ID NO: 42531 - DNA, 1297 bp, Panicum virgatum
  misc_feature: Ceres CLONE 2012589
  misc_feature: Encodes the peptide sequence at SEQ ID NO. 42532
aaacccgatccccccacaaccccaaccccaacccaatccgcccgcccaaaaagtcatgcgagatcacccgacatcctagcccccccaaccctagcagatatcagcagatccagatatgagcaccagcctgtccccgcccgactcctcgccgccgccggcggaggtccccctcgccccgggcttccgcttccaccccaccgacgaggagctcgtctcctactacctccgccgccgcgtcctcggccgccgcctccgcgtcgacgccatcgccgaggtcgacctctaccgcctcgagccctgggacctcccctccctctcccgcatccggagccgcgacgcccagtggtacttcttcgcgcgcctcgaccgcaaggtcgccggggccggcgccggcggccgggggggcccggggaacaggaccaaccgcgccacgccgcggggatactggaagaccacgggaaaggaccgcgaggtctaccaccgcggcaaggccgtcggcatgaagaagacgctcgtcttccacgccggcagggcgcccaagggggagaggagcaactgggtcatgcacgagtaccgactccttgacgccgacgggccccaggatctgcacgtggtgtgtcgaatcttccagaagcatggttctggaccacagaatggagcgcagtatggtgcaccatacatggaagaggaatgggaagaagaagatgatgctattgagaatgcacctgctaatggcacatctgccggaatggctacaatcacatgtactgtagatgagtcgaacgaggaggatgagaatggatattgtaaaaccaatgagcttgctcaggcccatggaatgctcagctcacctgagatggcccctctcaaagctcaaggttccaaagacaccggtgaaggaagctgtgctgatggtgttatttctctggaggagattatacaggaacctttgtcagctattaatgcagagaatgtagatagatctgaagggcagaatgccactgatgataacttcagtgttgacgacttattatctgcgtgccccaggaaagataatgactacgtaggtcaggattgcactctgaatgggagttacccggctgatggcgatgacacacattggcctttgagagcatatagtaatcagaactatgccaatggtactcttagtgctgaggagttctttgacacacagaatgatagcaatgggaatacatattcagagtaccagcaggttgatggctttccagcacctcaccaagtggatggcagtatggtattttacgatgcttcatct

SEQ ID NO: 42532 - protein, 393 aa, Panicum virgatum
  misc_feature: Ceres CLONE 2012589
  misc_feature (19)..(156): Pfam Name: NAM Pfam Description: No apical meristem (NAM) protein
MSTSLSPPDSSPPPAEVPLAPGFRFHPTDEELVSYYLRRRVLGRRLRVDAIAEVDLYRLEPWDLPSLSRIRSRDAQWYFFARLDRKVAGAGAGGRGGPGNRTNRATPRGYWKTTGKDREVYHRGKAVGMKKTLVFHAGRAPKGERSNWVMHEYRLLDADGPQDLHVVCRIFQKHGSGPQNGAQYGAPYMEEEWEEEDDAIENAPANGTSAGMATITCTVDESNEEDENGYCKTNELAQAHGMLSSPEMAPLKAQGSKDTGEGSCADGVISLEEIIQEPLSAINAENVDRSEGQNATDDNFSVDDLLSACPRKDNDYVGQDCTLNGSYPADGDDTHWPLRAYSNQNYANGTLSAEEFFDTQNDSNGNTYSEYQQVDGFPAPHQVDGSMVFYDAS

SEQ ID NO: 42533 - DNA, 688 bp, Panicum virgatum
  misc_feature: Ceres CLONE 2012589-R
gcatgttgggctctatcccggctccacctgcaatggcttcagaaccgtcagcaactggaaaatctgttggcgctctctcggctgtcagcccgagctcgattcgtgttacagctggcatcatccaactcgatggcctcacttttagtggtgtctctgagcggtggcccctgcagaagaatggagacttcaatttgcttctgtcttttaccgtggagagcgatgtgtcatccaagcctgctggttttgagcaggctacacggattagcaccatcccgatggtgctgcgcagcggcatgtatcttttctttgtatcagccatgattcttctgttgagctacaaagtagggtcgtgtgtctacagcaggtaagttaatgtggccccgttctgtctgagggctgttacatttgatttggaacgtgtctcctcaacgagggtataacaatggaggcagtttgtctttacacatttatcttgcaaaccattctgacttgttaaacatgtactgaaaataaacttccgatgatagcgatggtttgtgctgagaccatgtgcttcatcagggagggacacagcagtgtatctatttttgcttcttttttttttctctctgggaactagggcggtagggcccccttgtatcgatgtaaccatgcaaaaaattaactggttgacattattatttacatt

SEQ ID NO: 42534 - DNA, 1107 bp, Panicum virgatum
  misc_feature: Ceres CLONE 2012594
  misc_feature: Encodes the peptide sequence at SEQ ID NO. 42535
aaaacacacaccgtcccattgaccgaaatacgcccagctcaaatcctcaatccgagggttccgaccagcgcaaaacccacatccgccgccgccgccgccgccgcgctcgtgacctctcaccgccggccggcgcccctccacgcacagcaatgatggtccccctcgaccccgcggacaagcccacctcgcagagtcgcatcgcggagggcgacaccgtcgtggtgtacgagcgccacgacgcgatgcgtgccgtcgcggtccgcgccggcggcgtgctccagaaccggttcggcgtcttccgccacgacgactggatcggcatcccctttggatccaaggtcttcagcacctccggcggcggaggcaggggtggagggggcaaggggggcggcggcggaggcaaggccggcggtgggttcgtgcacctcctggcgccgaccccggagctctggacgctcgtgctcagccaccggacccagatcctctacatcgccgacatcagtctcgtcgtcgcctacctcgagctcgtcccggggtgcgtcgtgcttgagtccggcacgggcagcggctcgctcaccacctcgcttgcgcgcgccgtcgcgccgcacggccgcgtccacaccttcgatttccacgagcagagggctgcctccgcgagggaagacttcgagaggaatggcctttgccgcctgatcacagtcaatgtgagggatatacagggggaaggattcccagaggagcatcgagcaactgctgatgctgtcttcctggacctgccccagccttggcttgcaataccatctgttagtttaatgctgaagcaagacggtgttctgtgttctttttcaccttgcattgagcaagtgcagcgagcttgcgaagctatgagatcatgtttcacagatattagaacctttgaaattcttcttcgcacatatgaagtaagagatggtgctcttaagactaagcaatctctcatacccacacttgggcgtccttggccgctgcatctctcggtttctcaatggcgccctccgctatgatccgctgcgccgccgccgtcgcgacgctcgccctcctcgccgctggcggcgaggccgcggtgtt

SEQ ID NO: 42535 - protein, 297 aa, Panicum virgatum
  misc_feature: Ceres CLONE 2012594
  misc_feature (2)..(297): Pfam Name: GCD14 Pfam Description: tRNA methyltransferase complex GCD14 subunit
  misc_feature: SWISSPROT Homolog: EC 2.1.1.36 tRNA (adenine-N(1)-)-methyltransferase
MMVPLDPADKPTSQSRIAEGDTVVVYERHDAMRAVAVRAGGVLQNRFGVFRHDDWIGIPFGSKVFSTSGGGGRGGGGKGGGGGGKAGGGFVHLLAPTPELWTLVLSHRTQILYIADISLVVAYLELVPGCVVLESGTGSGSLTTSLARAVAPHGRVHTFDFHEQRAASAREDFERNGLCRLITVNVRDIQGEGFPEEHRATADAVFLDLPQPWLAIPSVSLMLKQDGVLCSFSPCIEQVQRACEAMRSCFTDIRTFEILLRTYEVRDGALKTKQSLIPTLGRPWPLHLSVSQWRPPL

SEQ ID NO: 42536 - DNA, 726 bp, Panicum virgatum
  misc_feature: Ceres CLONE 2012605
  misc_feature: Encodes the peptide sequence at SEQ ID NO. 42537
aactcgatcactccacacaaaattcggctacctcacttgggtctcgcgtcagctcataaaccaaacagagaggcctcgtcgacagtggccaccagcccggagcagagaaggcagatcaggaggaaggcagtatgctgctgaacgccatccgggagcaccagctggaggagccgtcggaggcgctggtgctggacaccatccggcagcacctcctggaggaggagccggcggaggcgcggccggcgtaccggcggagcgagagcttcgggagcctcgtggcggaccagtggagcggctcgctgccgttccgcaccgacgacgccgacgacatggtcgtgttcggggcgctgcgggacgccttcgcctacggctggctccccgacggctccttcgcgccggtcaagcccgagccgctgccgtccccggacgactccgactactcctacgacggcctcggcctcccgtacccgtacccggacccggagccgatgacgcccagcagcgccaccgcgacgcccaagacggaggaggccgcggcgggcgtggcgaggggcaagcactaccgcggggtgcggcagcgcccgtggggcaagttcgcggcggagatcagggacccggccaagaacggcgcgcgcgtctggctcggcacctacgacaccgccgaggacgccgcgctcgcctacgaccgcgccgcctaccgcatgcgcggctcccgcgcgctcctca

SEQ ID NO: 42537 - protein, 198 aa, Panicum virgatum
  misc_feature: Ceres CLONE 2012605
  misc_feature (142)..(194): Pfam Name: AP2 Pfam Description: AP2 domain
  misc_feature: The sequence is a functional homolog of SEQ ID NO 503 in the 10/374,780 US patent application
  misc_feature: Functional homolog of the protein sequence given in SEQ ID NO 50251
  misc_feature: Useful for making plants with altered oil content
MLLNAIREHQLEEPSEALVLDTIRQHLLEEEPAEARPAYRRSESFGSLVADQWSGSLPFRTDDADDMVVFGALRDAFAYGWLPDGSFAPVKPEPLPSPDDSDYSYDGLGLPYPYPDPEPMTPSSATATPKTEEAAAGVARGKHYRGVRQRPWGKFAAEIRDPAKNGARVWLGTYDTAEDAALAYDRAAYRMRGSRALL

SEQ ID NO: 42538 - DNA, 706 bp, Panicum virgatum
  misc_feature: Ceres CLONE 2012608
  misc_feature: Encodes the peptide sequence at SEQ ID NO. 42539
gtcatagctttcccttctgaggacttggatgttggtgccgatcgcaggcggcgtgacgtccatggacgacttcctgaagaagttcttcccggacgtgtaccaccggaagcaggcgcacctgcgcgagacggactactgcaagtacgacaaccaggtgctgacgctcttcacctcctcgctctacttcgccggcctcgtctccaccttcggcgcctcctacgtcaccaagcgccgcggccggcgcgccagcatcatggtcggcgccaccagcttcttcctcggcggcgccgtcaacgccgccgccgtcaacatcgccatgctcatcgtcggccgcgtgctcctcggcgtcggcatcggcttcggcaaccaggccgtcccgctctacctctccgagatcgcgccctaccgcatccgcggcgccgtcaaccagctcttccagctcaccacctgcctcggcatcctcgtcgccgacatcatcaactacttcaccgaccgcctgcacccgtgggggtggcgcctctcgctggggctcgccatgggccccgccaccgccatcttcgtcggcgcgctcttcctgccggagacgcccaacagcctcgtcgagcgggggctgttcgaggaggcccgccgcgtgctggagaaggtgcgcggcacgcacaaggtggacgccgagttcaaggacctcagggaggccagcgaaggcggc

SEQ ID NO: 42539 - protein, 225 aa, Panicum virgatum
  misc_feature: Ceres CLONE 2012608
  misc_feature (1)..(225): Pfam Name: Sugar_tr Pfam Description: Sugar (and other) transporter
MLVPIAGGVTSMDDFLKKFFPDVYHRKQAHLRETDYCKYDNQVLTLFTSSLYFAGLVSTFGASYVTKRRGRRASIMVGATSFFLGGAVNAAAVNIAMLIVGRVLLGVGIGFGNQAVPLYLSEIAPYRIRGAVNQLFQLTTCLGILVADIINYFTDRLHPWGWRLSLGLAMGPATAIFVGALFLPETPNSLVERGLFEEARRVLEKVRGTHKVDAEFKDLREASEG

SEQ ID NO: 42540 - DNA, 669 bp, Panicum virgatum
  misc_feature: Ceres CLONE 2012625-R
  misc_feature: Encodes the peptide sequence at SEQ ID NO. 42541
gagaaggctaagattcaagcagacaatattgggcacaaacttctatctaagatgggctggcgggaaggtgagggccttggtagcgagagaagaggccgtgcggatcccattatggctggagatgtgaagaaggatcatcttggtgttggtgctgtccagcctggtgaggtcacatctgaagatgacatttacgagcaatacaagaagcgaatgatgcttggctaccgttatagaccaaacccactgaacaatccaaggaaagcatactactgatgcaagcgagttcatctggggggagatgtaaggcaccaatttttgctgcatttttgctcacagaactaactgttggttagaggatatcactaatggcattgaaagtttttgttcatcagcagaaaatccaagaagttcacttgttcaggatataacttgtagtgccaacagatctaaggcttctggggattctgctgcagctctgttctttgtttaatgttgatgcatgtatttttcaagtgcacgtgttgagttgtagataggttccaaacttgtgatgtattgctttctttatggatgactattttccttattattcaactttgattgttattattgtggagatatttgataaggataagccacaaaattattgcaagagttctatcttgtcag

SEQ ID NO: 42541 - protein, 90 aa, Panicum virgatum
  misc_feature: Ceres CLONE 2012625-R
  misc_feature (7)..(52): Pfam Name: G-patch Pfam Description: G-patch domain
EKAKIQADNIGHKLLSKMGWREGEGLGSERRGRADPIMAGDVKKDHLGVGAVQPGEVTSEDDIYEQYKKRMMLGYRYRPNPLNNPRKAYY

SEQ ID NO: 42542 - DNA, 622 bp, Panicum virgatum
  misc_feature: Ceres CLONE 2012625
gattcgagcccgcgcgcatcgattcgggattcgtagctgtctttgggacattcggggttcattttgttttttggaagagagcaagttggtttgatgcgtgaaaccgcctctagggttctggatccatttcgatcggaagcgagcgttggtgggattttttttgttgtgcagcggtggttggtgattaattggagtttcatagaattgtagctatttgacgcggcaagggtgccaagccatggataagggtctcttcgccaacgacggctccttcatggagaggttcaagcagatgcagcaggagcaggagaaggccgccaccgccgccgcctcatcggcggcgcccaagcctgcgaaccccaaacaggggtttgctgtggcggcgaacaagaggccgtttgagctgaagaaggccggaccagtcgccacgggtggcaagctggctttcagcctcaagaaggccaaggtcgcaattgcgcctgttttcgcgcccgaagatgaagaggaggatgcggcagatgtcgacagggaggagcctgccaagcgccagaaatctgtgaaagctgatactcctgcggtggctgccccgaccggggctgttgcccccccaccaccaaatgat

SEQ ID NO: 42543 - DNA, 1339 bp, Panicum virgatum
  misc_feature: Ceres CLONE 2012641
  misc_feature: Encodes the peptide sequence at SEQ ID NO. 42544
gcgccaagcattcttcttcacaccgccacacaagtagcagaagatggaagcagtggctcgttacgcggaccaggtgagggtgccatcggcttcgagcaccgtttggaaggatgagtgtgcttactcgtttgaatcgccggaagctgacgagggcctcttcatcgatctcaactcgtggctcggctttaggaaggactttgccaagttcaactacgacaagaccggccacggcctctacttgaacatcaagcgccgaatcaaggagaagaaggaagaaccagaggagaaggaagaaggcgaagagccccccaagaagaaggcctccatcctgggcatcggtgtgcagggtggtttcgaaggcgacgcaaagacagaacaagaggagacgtactctttggtggtgctgcccgacttcacttcgttccccatcaccgcagatgagctgcctgagaaggtcaaggaagcggtcaatgccatcatcgcgtcagattcggcctctaaggtggaggacctggcggcgtgggtagccgataaggacctagaagtgagcaagcatgccgacagcctgctgcagctcgacgtcaacaaaaaggtgccgctgtccaactggaagtgcgagcgcgagggatgcgacaagacggaaaacctgtggctcaacctgtccgacggcctcatcctctgcggacggaggaactgggacggttctggcggcaacgggcatgctctcgaccatttcgaccagaccggatttcctctctcggtcaagctgggcacaatcaccgcacaaggcgcagacgtgttcgactatgtgaagggcgacctggtgctggatccaaagttggtggagcatctggcccactggggcattgacatgcacaagatggagaagacggagaagaccatggccgagcttgagctggatctgcagtactcgtacgactggaacaggatccaggagcagggcaagacccacagccccatttacggtgccggtttcactggcatccagaacctaggcaacagctgctacatgtcctctgtgatgcaggttctctttgcacttccggagttccagaagaggtacaacgaccacaaggacgaaatctttagccgagctccgaccgatcccactcaagacttccacgtacaaatggccaagtttgcagacgggcttctctctggcgtctattctcagcctcccagagacaaaatggaggaggatgagcaggctggtagggacattcattcgatgggcatcaggccccgcatgttcaagagtctcgtgggcaaggggcatcccgagttctccacaatgagacagcaagacgcgctggagttc

SEQ ID NO: 42544 - protein, 431 aa, Panicum virgatum
  misc_feature: Ceres CLONE 2012641
  misc_feature (191)..(268): Pfam Name: zf-UBP Pfam Description: Zn-finger in ubiquitin-hydrolases and other protein
  misc_feature: SWISSPROT Homolog: EC 3.1.2.15 Ubiquitin thiolesterase
MEAVARYADQVRVPSASSTVWKDECAYSFESPEADEGLFIDLNSWLGFRKDFAKFNYDKTGHGLYLNIKRRIKEKKEEPEEKEEGEEPPKKKASILGIGVQGGFEGDAKTEQEETYSLVVLPDFTSFPITADELPEKVKEAVNAIIASDSASKVEDLAAWVADKDLEVSKHADSLLQLDVNKKVPLSNWKCEREGCDKTENLWLNLSDGLILCGRRNWDGSGGNGHALDHFDQTGFPLSVKLGTITAQGADVFDYVKGDLVLDPKLVEHLAHWGIDMHKMEKTEKTMAELELDLQYSYDWNRIQEQGKTHSPIYGAGFTGIQNLGNSCYMSSVMQVLFALPEFQKRYNDHKDEIFSRAPTDPTQDFHVQMAKFADGLLSGVYSQPPRDKMEEDEQAGRDIHSMGIRPRMFKSLVGKGHPEFSTMRQQDALE

SEQ ID NO: 42545 - DNA, 699 bp, Panicum virgatum
  misc_feature: Ceres CLONE 2012641-R
  misc_feature: Encodes the peptide sequence at SEQ ID NO. 42546
atgaagaattgctgcccgagggcgaggaaccgaagaaaatgcctgaccccagcgctgcggtcgtcgcccagttgcagatgatgggcttcccggagctccactgcaagaaggcagccctcaactctggtaactcggatcccgaggcagccatgaactggctgctttcgcacatggacgaccctgatcttgacaagcccctcgaacctttgccctccgcctccagtgctggtgcctctggcggtgaatcagttaacgaggaagcggtcatgatgctctccagcatgggcttcacccgcgagcaggccgtgcgtgctctaaaggccacgaatggcgacgttgagagggccaccgattggattttcagccacgccgacgagctggactctgctgagcaggcccccagtggcgctggtgaggccagcggagctgacgccgtgggcgaggatgcgatggacgtggaaggcgctacacggtatcgactggtcgcgttcatctcgcacatcggtggatcgaccgccaccggccactacgtctgccacatcaagaaggacggccgctgggttatcttcaacgacgagaaggtcgccctctccgaagacacccccaaggacatgggctacctctacttctttgagcgcttgtaaagagccaaggtgctctccagagacacattgagctctcagcagagcgtttttggtc

SEQ ID NO: 42546 - protein, 213 aa, Panicum virgatum
  misc_feature: Ceres CLONE 2012641-R
  misc_feature (83)..(119): Pfam Name: UBA Pfam Description: UBA/TS-N domain
  misc_feature (16)..(53): Pfam Name: UBA Pfam Description: UBA/TS-N domain
  misc_feature: SWISSPROT Homolog: EC 3.1.2.15 Ubiquitin thiolesterase
EELLPEGEEPKKMPDPSAAVVAQLQMMGFPELHCKKAALNSGNSDPEAAMNWLLSHMDDPDLDKPLEPLPSASSAGASGGESVNEEAVMMLSSMGFTREQAVRALKATNGDVERATDWIFSHADELDSAEQAPSGAGEASGADAVGEDAMDVEGATRYRLVAFISHIGGSTATGHYVCHIKKDGRWVIFNDEKVALSEDTPKDMGYLYFFERL

SEQ ID NO: 42547 - DNA, 610 bp, Panicum virgatum
  misc_feature: Ceres CLONE 2012648
  misc_feature: Encodes the peptide sequence at SEQ ID NO. 42548
aatccacgctccccacgcccccctcccaccagctcccacctctcccaaatctccactcgccgacgtccaccagccctcgtccgcaggccgccgcgcgcctggccccatccaggtctccgcccggcgccccgcgaggaggccgtccagtaggccgccgccctgcgccccgagcccgacatcgacgcctccaggaggcaagggcgccgagatgactcgcggcagccagagggagcgcgaccgcgagcgcgcggcggcgcggaagcccaacgccaaggggtcccaggacgggctcaccccggagcagcgccgcgagagggacaagaaagcgctggaggagaaggcggccaagaaggcgcagcaggcggcggccggcgcctccggtacttccacggacaacaagaacaagggtgggggcaagaagtaggcgccaccaacgctcgcggcgcaacctctgtacgactatcgatgttattaggttgtaccttcgcacctacgtagatgcgatgtttgttgggtcataaactcgttgtctgcaagcttttagttacctgatacatcaaacatcatgacatgagttggtgatgacaataatacgtggtgatgtggtttt

SEQ ID NO: 42548 - protein, 71 aa, Panicum virgatum
  misc_feature: Ceres CLONE 2012648
  misc_feature (1)..(56): Pfam Name: 4F5 Pfam Description: 4F5 protein family
MTRGSQRERDRERAAARKPNAKGSQDGLTPEQRRERDKKALEEKAAKKAQQAAAGASGTSTDNKNKGGGKK

SEQ ID NO: 42549 - DNA, 710 bp, Panicum virgatum
  misc_feature: Ceres CLONE 2012651
  misc_feature: Encodes the peptide sequence at SEQ ID NO. 42550
accaattcgggaaccctactccgctgccgccgccgccgccgccatgagccgccaacctgaggttctgtgggctcagcgctctgagaagatttacttgactatctcattgccagatgcaaaagatgttgagctgaagactgaacctaaaggcctctttactttctcagctgttgcccatggggaaccttttagcttcactttggagctctttgattccatactgccagagggaagtaaaacaaagacaaagatgggcttgcgaaacataatctgttcaatccagaaggaaaagaaaagttggtggaagcgcttgctgaagtcagaggaaaagcgtccatacatcaaagttgactggaacaaatggtgtgatgaggatgaagaatctgaagcctcgggggattctgatgatgactttgatggggccaatgaaggagatgaaagtggtgatgatgacgggatgctttatctccctgaccttgaaaagttaaggggcaagtgacttggctgctcaggtgagggaagtaggtctgctgtaacagattatcattgacgtgacagataggctctccattaacgtagttgctgttacctgcaaagcatctgcgatggcaccagagttttggcatgatctttgcttggcgtgtcttttatctccggggtgtctttcctgactagtgagcttgtgctctgaatgtagctatgagctgtgt

SEQ ID NO: 42550 - protein, 151 aa, Panicum virgatum
  misc_feature: Ceres CLONE 2012651
  misc_feature (5)..(81): Pfam Name: CS Pfam Description: CS domain
  misc_feature: SWISSPROT Homolog: EC 5.3.99.3 Prostaglandin-E synthase
MSRQPEVLWAQRSEKIYLTISLPDAKDVELKTEPKGLFTFSAVAHGEPFSFTLELFDSILPEGSKTKTKMGLRNIICSIQKEKKSWWKRLLKSEEKRPYIKVDWNKWCDEDEESEASGDSDDDFDGANEGDESGDDDGMLYLPDLEKLRGK

SEQ ID NO: 42551 - DNA, 1292 bp, Panicum virgatum
  misc_feature: Ceres CLONE 2012660
  misc_feature: Encodes the peptide sequence at SEQ ID NO. 42552
gtgagcggcggcgcggtagaagccgccaagccggcgcgcgagacgagcaccgtccggtggccgcggatgtgctgatctcgagtggaggagagccgagaaggaaacgaggagttggggcggcgagtagctctacgatggcgcagtttctcggcgcgtccagctcgaagaagcggcgggcgggtgaggaaggggaggaaatcgatgcggcggcgacggctgaggaccgcatctcggcgctgccggaggatctgcggctgcgcatcctggccctgctcccgctcaagtcggccatccgcacgggggcgctctccacgcggtggcgcgcgctctgggagcgccgctggcccgcgccctcctccctcgatctcctcctccgccccggcgacgacacggaggagccactcctatcgctcgggcgccgcggcctccggcgcctcgaccgcttctccctcaccatagagcggagcaggagccccgcagaaccccgcgtcagggctccccagtgcttcatcgactacgccgccgcctgcggcgtcgaggacctccacgtcgatgtcgccaatcacttcatgagcttgatctcaacgctcaacttcccgcggggttgttcgcacctcgcgcgtctcttcgtccgccacttggccggggtttccttcggcttccccctctgcttggacgccttccccgccctcgaggtcgtccacctccacctcgtcagggttgacattaacatgcttctctgggcgtgctctcgtcttaagaccctttacctccgccactgcaactgcaagggggtcggggcaatcaacctcatgcccgccggggcgcacctgaggagcgtcaccgtcgtggagtgcaatggaatcacccacattgacgccaggagggcccatggcctccgctccttccgcttcagcagtgcccggttccccacctacgacattgcagccacagcctcgcttgacgatctttgcatcagtctaaggggccaaaactgcaatcctctcggacactggattcaggcgcttcccgacctcgctagcctcacggtgctcaccatctgcagcattgcactccggagagtttatgcgttggaatgttttggatcagctacttgtttgaccaagttgagttatcttccaagcttaagagagttgcagctcataatgcttgaaatggaccacaccaatttagcatatatgtatgttttcctccggtgctgccggtgtccccagctggagaggctctttgtgcagctccccatcaacagccatgatatcttggaggtggag

SEQ ID NO: 42552 - protein, 385 aa, Panicum virgatum
  misc_feature: Ceres CLONE 2012660
  misc_feature (30)..(77): Pfam Name: F-box Pfam Description: F-box domain
MAQFLGASSSKKRRAGEEGEEIDAAATAEDRISALPEDLRLRILALLPLKSAIRTGALSTRWRALWERRWPAPSSLDLLLRPGDDTEEPLLSLGRRGLRRLDRFSLTIERSRSPAEPRVRAPQCFIDYAAACGVEDLHVDVANHFMSLISTLNFPRGCSHLARLFVRHLAGVSFGFPLCLDAFPALEVVHLHLVRVDINMLLWACSRLKTLYLRHCNCKGVGAINLMPAGAHLRSVTVVECNGITHIDARRAHGLRSFRFSSARFPTYDIAATASLDDLCISLRGQNCNPLGHWIQALPDLASLTVLTICSIALRRVYALECFGSATCLTKLSYLPSLRELQLIMLEMDHTNLAYMYVFLRCCRCPQLERLFVQLPINSHDILEV

SEQ ID NO: 42553 - DNA, 690 bp, Panicum virgatum
  misc_feature: Ceres CLONE 2012660-R
ttgatgaagttcaaaggccatttactttgagatgcgactagtaagctttctgttgaggagggccactgttctccagaaactgctattggtacctcctcctgtgggtatggggaattacatggaagcatttggagaagaaccattggacacatcccattttctagagacaatattgaactttgaaaaagcgtcaccagatgctcagatagttctaggtgactctgatcctgctgcaattcagccagtgcattctgatgtgctttagtttgccatcagttgaagtgtaccagatgagattgcaagtaagaacttgtctagtggtatatgaatcctatatgtgcatgtatggagatgctagctacattttttgcaccccttgaatagagtattgaaagagtgaaagtatgattgacattgtcaatttaagatgatgattttggccatttatgaatggtggaacaggaaagtcaaatgcttgtttgtttggcatactgtccatagaccatgaaggaccagggagctgtatcccctaggcatttggttctagactagaagaaaagtgtatgtttttattatctttgttgatcagaattcagtgcaacagctggacaagaaatcttgtaaaacaatttctggcagttctcacttggatcactcatctcggtctgcaggaaatataaaagttaactg

SEQ ID NO: 42554 - DNA, 636 bp, Panicum virgatum
  misc_feature: Ceres CLONE 2012671
  misc_feature: Encodes the peptide sequence at SEQ ID NO. 42555
acagaaacatctgaattgttattcccccagctgcagaggaacaggcagagcttggccagaattcaggatggccgcaggcgtgctgtgcttcagggcgtttgccctctccatggcctgccttctccttgccgtgcccctgctagtggctcaggacccttccaagctgagcctggagtactactccaagacatgcccgaatgtggagcacgttgtccgcacggagatggagtgcgcggtgcgtgccgacacccgcaatgccgccctaatgcttcgcctgcatttccatgactgcttcgttcagggatgtgatggatcagtgctgcttgatgacaccgcgaccatgatcggggagaagcaggcggaccagaacgtcaactcgctaaaagggtttgagctggtcgacaagatcaaggagaagctggaagccgagtgccctggaacagtttcttgcgcagacttgctcgccattgcagctagggacgcagttgtgctggtaaccaaaccacatctatgttctgtttctctgtgacgatgtgcatttctgaaatgtctagtacgtgaagttagcctcgtgccatgcattctttattttttctcgaaacagcttcaatttggataaactctgaagtttcatat

SEQ ID NO: 42555 - protein, 153 aa, Panicum virgatum
  misc_feature: Ceres CLONE 2012671
  misc_feature (49)..(152): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50245
  misc_feature: Useful for making plants with altered carbohydrate content
  misc_feature: Functional homolog of the protein sequence given in SEQ ID NO 50246
  misc_feature: Useful for making plants with altered cell wall content and/or composition
  misc_feature: Functional homolog of the protein sequence given in SEQ ID NO 51417
  misc_feature: Useful for making plants with modulated oxidative stress sensitivity
  misc_feature: Functional homolog of the protein sequence given in SEQ ID NO 50230
  misc_feature: Useful for making plants with modulated nitrogen use efficiency
MAAGVLCFRAFALSMACLLLAVPLLVAQDPSKLSLEYYSKTCPNVEHVVRTEMECAVRADTRNAALMLRLHFHDCFVQGCDGSVLLDDTATMIGEKQADQNVNSLKGFELVDKIKEKLEAECPGTVSCADLLAIAARDAVVLVTKPHLCSVSL

SEQ ID NO: 42556 - DNA, 730 bp, Panicum virgatum
  misc_feature: Ceres CLONE 2012672
  misc_feature: Encodes the peptide sequence at SEQ ID NO. 42557
gcaccgacaattcgggttccgatccagttcttcggaaacgggtcctggaagcggcatggcgaggcgggtcatctccgtgctgcttctcgcagccctggcgtgcgacgtcgcgttcgccgagttcggcaggcacagcttccccgagggcttcgtcttcggcaccggctccgcggcgtaccagtacgagggtgcctacaaggaaggaggcaaaggtcccagcgtgtgggacatcttcagtcacttaccaggtaaaatcatgaacaatgatactggcgatgtagcggatgacttctaccatcgatacaaggtgattgcttggaatacttcttattattagctctgatcggatcggtcattttgacatttctgaatcaagcgatatatatttattagtagtatgagctaatgattggtaaatggaattgagtactatactaacgctccaagatttggagcgctcccgttcgctctggccccacgtgggcccgggggtactgttcacaattttaaaaataataaaaggtactgttcatgtgggcccgggggtactgttcataataaagtaataaaaaatactattcatgtgggcccggggtactgttcataataaaaaaatataattcgaaattaaaaataaaaaataaaaagtggccccgtgtgttttaatgtttagttttttatgcacaaaaataataataaaaaaatttgtatactacatttacctctatta

SEQ ID NO: 42557 - protein, 93 aa, Panicum virgatum
  misc_feature: Ceres CLONE 2012672
  misc_feature: SWISSPROT Homolog: EC 3.2.1.21 Beta-glucosidase
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 51134
  misc_feature: Useful for making plants with altered cell wall content and/or composition
MARRVISVLLLAALACDVAFAEFGRHSFPEGFVFGTGSAAYQYEGAYKEGGKGPSVWDIFSHLPGKIMNNDTGDVADDFYHRYKVIAWNTSYY

SEQ ID NO: 42558 - DNA, 673 bp, Panicum virgatum
  misc_feature: Ceres CLONE 2012674
  misc_feature: Encodes the peptide sequence at SEQ ID NO. 42559
attcttgtggtcgccacgagacgcagcctttcaaccacgcacacggcgcacgcggacgagagagagggagcagccatggccgccttgtactaccacccggccgccgggaaggcgagcctggaagcagtggccccgtcctcgccttctctggccctgcggccatctcagagcaaggtgctgtgcatcggcagcagccggtggtggatgaggagatgggaggggaaggcgagggcgagcggcatcagcagcagggcgagggcaagggcaagggcacggcctgtggcgaggccggccttgttctctcccgtcgccatggagtggcaggagtgcaccactgaacttgaagttgacattccttgttccgttgcctatcagtgttactcagaacgggagagcattcctcagtggatgccattcatctcatctgtcaaggtccttgaagataaaccagatctttcacgctggagtctgaaatacgaggtatttggtcggaatgtagagttctcttggcttgctcgaaatatgacgcctactaaaaaccaaaagatccattggcgatctcttgaaggccttcctaacagaggcactgttcgcttcttccctaaaaccccatcgtcttgtagagtacaagtgagcacagtcctacggattctctcgcaaaaaaagtattgtc

SEQ ID NO: 42559 - protein, 199 aa, Panicum virgatum
  misc_feature: Ceres CLONE 2012674
  misc_feature (91)..(197): Pfam Name: Polyketide_cyc Pfam Description: Polyketide cyclase / dehydrase and lipid transport
MAALYYHPAAGKASLEAVAPSSPSLALRPSQSKVLCIGSSRWWMRRWEGKARASGISSRARARARARPVARPALFSPVAMEWQECTTELEVDIPCSVAYQCYSERESIPQWMPFISSVKVLEDKPDLSRWSLKYEVFGRNVEFSWLARNMTPTKNQKIHWRSLEGLPNRGTVRFFPKTPSSCRVQVSTVLRILSQKKYC

SEQ ID NO: 42560 - DNA, 699 bp, Panicum virgatum
  misc_feature: Ceres CLONE 2012676
  misc_feature: Encodes the peptide sequence at SEQ ID NO. 42561
gaaactgagaatggaagcaagagagactggcgcactcaaagaagctaaagacaagcttgaaaagagagtagaagaacttacatggcggttagatgttgaaaagcgtttgaggactgaccttgaagaagccaagggccaagaaattggaaagttgcaatctgcattgcaagaaatgcaagaaaagattgaggaagcccatgcagcagtggtaaaggagaaagaagccgcgaagttagcaattgaacaggcaccaccaaagatagtagaagtgccagttgtggacactgaaaaagttgagcagttgacaagtaaaaataaagaacttgaggatgaactaagtgcatttagacagaaggctgaagatcttgaaaataagcttcttgagatgcaaaaacggtctgatgaattgtcacaggagacacaagaacgagaatccaaagttaatcaacttcaagagatgatcgaaaggctagaaacaagtttatccaatatggaatctgaaaaccaggttctacggcaacaatctttggtcgttgcaacagcagatgaggataaatcaaaacagatagagagactggaaagcaagattgccatcttggagtccgagatcaagttgctccacagtaatttggcgcttgctgttcaggccatggtcacccctgcaatgaatcagacatcagtaatggagaacctcattca

SEQ ID NO: 42561 - protein, 232 aa, Panicum virgatum
  misc_feature: Ceres CLONE 2012676
  misc_feature: SWISSPROT Homolog: EC 2.7.11.1 Non-specific serine/threonine protein kinase
KLRMEARETGALKEAKDKLEKRVEELTWRLDVEKRLRTDLEEAKGQEIGKLQSALQEMQEKIEEAHAAVVKEKEAAKLAIEQAPPKIVEVPVVDTEKVEQLTSKNKELEDELSAFRQKAEDLENKLLEMQKRSDELSQETQERESKVNQLQEMIERLETSLSNMESENQVLRQQSLVVATADEDKSKQIERLESKIAILESEIKLLHSNLALAVQAMVTPAMNQTSVMENLI

SEQ ID NO: 42562 - DNA, 688 bp, Panicum virgatum
  misc_feature: Ceres CLONE 2012687
  misc_feature: Encodes the peptide sequence at SEQ ID NO. 42563
attataccagagaagtaagctagtcactattgaaagtattgaaactggaaacaatgtcgacagttacttctcacaccctactgagccgaccggcaagatctcccggtggtttattctttggttgtgtgaaaccagcagtggttggcctcccttgtgcctctgttgggaagaacaggcctcgttccatctgttactctgtggataccaagagtactgaccatcagttcaacatctcaccagtcgcccttgtgcatccatacatgccgcccacgtcgaccccgcgatgggagatcaaggatgacagcaagaatgtcaggctgacattattcaacatgccggagggtgccttgccaggcgatttccaggtcgccattgaggacgacgtactcgtgatcaggacaaaaaatcccaagctgccagtggagcagcaagaagtacccgagagcagcatctcgttccacatccggctgctggtgcccaaggggtatgacaaggagaacgtccgcgccgaactacaactccgggcactagtggtcaccatccccaaggttaatcctgcgttcacccaggaggttgctatcgatggaaagtagaaatgcaggaaccctgttttctggcaaatgatgtcacgtccatatttcattgcaatatgtgtgtatgtggtttatcaattatcatgatgaggcag

SEQ ID NO: 42563 - protein, 179 aa, Panicum virgatum
  misc_feature: Ceres CLONE 2012687
  misc_feature (79)..(177): Pfam Name: HSP20 Pfam Description: Hsp20/alpha crystallin family
MSTVTSHTLLSRPARSPGGLFFGCVKPAVVGLPCASVGKNRPRSICYSVDTKSTDHQFNISPVALVHPYMPPTSTPRWEIKDDSKNVRLTLFNMPEGALPGDFQVAIEDDVLVIRTKNPKLPVEQQEVPESSISFHIRLLVPKGYDKENVRAELQLRALVVTIPKVNPAFTQEVAIDGK

SEQ ID NO: 42564 - DNA, 1457 bp, Panicum virgatum
  misc_feature: Ceres CLONE 2012696
  misc_feature: Encodes the peptide sequence at SEQ ID NO. 42565
gtcctcgcctccactgtctagctagctctagcagcctcccagctatatacgcgccccccacccaccctaccgcctccccacacccgtcctcctcgctcctcgaccaccgccgccgctcgcctcctgctgcaggctctcgccagaaagggaaaccgcatctgctgcttcggcgcgccgcccctgatcgacggccagagcggggggtgtggtgacgagacgaggtcggccggccggccggcgcgcagatctgaggcgtgagcagctagcgcggagggagctgaggtgcgtcatgcagggcggaggcgcggccgacagccccggcgcggcggcgggcgggaacgcgccgcggccgagccggtacgagtcgcagaagcgccgggactggcacaccttcgggcagtacctgcgcaaccaccggccgccgctggagctggcgcgctgcagcggcgcgcacgtcctcgagttcctgcgctacctcgaccagttcggcaagaccaaggtccacgcgccgggctgccccttcttcggccacccgtcgccgcccgcgccgtgcccgtgcccgctccgccaggcgtggggcagcctcgacgcgctcgtcggccgcctccgcgccgccttcgaggagcacgggggtcgccccgaggccaaccccttcggcgcgcgcgccgtgcgcctctacctccgcgaggtccgcgacagccaggccaaggcgcgcggcatcgcctacgagaagaagcgccggaagcgcccctcctcctcgtcccagcactcccagcagcagcagcaagccgccgcgactcccccgccccaggctgccgctcccgcctcctcgccggctctgtcggacgaggcgactgagagggccacggccaccgaagcgcgggcgcacgccgtgcaccagcaccaccacttcctgcacggcttcatcccgcacccgcagttcctgcacggcttcagcctggtgccgggcggccaccccaaagcggtcgctgctggcaatggcagcagcagcggcagcagcgccggcgccggcgccggcagcggggacgagatagcgctggcgatggcggcggcggcggaggcgcacgcggcggggtgcatgctgccgctctcagtgttcaactagccgtgtagccgaatcgaggtactaggtcttaaacaatggatgaattactcatcgtcggaggtttatctagtgttaagatcgatctcgtcgtgatagatcgatcaacacgcgtacttgctgcagctgttcttaaggattttctacccgatctcttttggttggttacatgcatttcctgctgttctagctgctcagctctgctgggaaatagtagtaggtgtacttggtactgtagggtttcctggatcctgcttggtttgtgtatgcaatgcaatgaagatgggagataatataatggaaggcttaattaccaggcttctctttctggact

SEQ ID NO: 42565 - protein, 278 aa, Panicum virgatum
  misc_feature: Ceres CLONE 2012696
  misc_feature: Functional homolog of the protein sequence given in SEQ ID NO 51087
  misc_feature: Useful for making plants with modulated low light sensitivity
  misc_feature: Functional homolog of the protein sequence given in SEQ ID NO 50806
  misc_feature: Useful for making plants with modulated nitrogen use efficiency
  misc_feature: Functional homolog of the protein sequence given in SEQ ID NO 50807
  misc_feature: Useful for making plants with modulated flowering time
  misc_feature: Functional homolog of the protein sequence given in SEQ ID NO 50808
  misc_feature: Useful for making plants with modulated biomass
  misc_feature: Functional homolog of the protein sequence given in SEQ ID NO 50809
  misc_feature: Useful for biocontainment applications
MQGGGAADSPGAAAGGNAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLYLREVRDSQAKARGIAYEKKRRKRPSSSSQHSQQQQQAAATPPPQAAAPASSPALSDEATERATATEARAHAVHQHHHFLHGFIPHPQFLHGFSLVPGGHPKAVAAGNGSSSGSSAGAGAGSGDEIALAMAAAAEAHAAGCMLPLSVFN

SEQ ID NO: 42566 - DNA, 659 bp, Panicum virgatum
  misc_feature: Ceres CLONE 2012698
  misc_feature: Encodes the peptide sequence at SEQ ID NO. 42567
accgaacggaacgagacccccaacacacgtcaaagcggaaaacctcagataacccccaggaaatcgtattataatctcgccctccactccccctgctccgctgcaactccactcggccgccccccaccctgatccttcccccagccattggtgcgtgcttgatcggatccatggacacccacatcggatccgtggacgggccggcgctggcggcggcgaacggcgcggtgggctgcccggcgtcggcgccggggtgcccgatggcgtccacgccggcgcagcccgcggcggcgctgacggccggggaggcgtcgctggggcgccacctcgcgcgccgcctcgtgcaggtcggcgtcggcgacgtcttcgccgtccccggggacttcaacctcacgctgctcgaccacctgatcgccgagcccgggctgcgcctcgtcggctgctgcaacgagctcaacgccgggtacgccgccgatggttacgcccgcgcgcggggcgtcggggcgtgcgccgtcacgttcaccgtcgggggcctcagcgtgctcaacgccatcgcgggggcctacagcgagaacctgcccgtcatctgcatcggcggcgggcccaactccaacgactacgggaccaaccggatcctccaccacaccatcgggcctccc

SEQ ID NO: 42567 - protein, 162 aa, Panicum virgatum
  misc_feature: Ceres CLONE 2012698
  misc_feature (47)..(162): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
MDTHIGSVDGPALAAANGAVGCPASAPGCPMASTPAQPAAALTAGEASLGRHLARRLVQVGVGDVFAVPGDFNLTLLDHLIAEPGLRLVGCCNELNAGYAADGYARARGVGACAVTFTVGGLSVLNAIAGAYSENLPVICIGGGPNSNDYGTNRILHHTIGP

SEQ ID NO: 42568 - DNA, 689 bp, Panicum virgatum
  misc_feature: Ceres CLONE 2012701
  misc_feature: Encodes the peptide sequence at SEQ ID NO. 42569
ctggtcgtctttcatatcgagccattgaagcagcgcgtcgggctataatcggacaattccatcgtgctatgagcggacaattccgaagaaattgtaagatatgggtaagagttttcgcagatcttcctattacggggaaacccgcagaagttcgaatgggaagaggaaaaggaaatcctacgggttggattgctcgtgtgtccacgggacaaatcctatttgaaatggatggtgtgagtttgtcaaatgctcgacaagccgctagattagcggcgcataaactatgtttgtcaaccaagtttgttcagtggtcgtaacgtaattggttagtggggaaaaaccgggccgggaacgctagcagtggcatcacccccgaagcagcagctctccgtccccgcccccatcaccgaggagagagagagagggagagaggccagccagccgcagagcgacgagcgccccacatggccaccaccgcgcccggcggtgggccccccgccgccgccgacgccgacgccatggaggtcgacccgccgcgcgtctccgccgacgagaagcacgtcgccactgttatggggggaaatgatgcagttacaggacatataatctcgaccacaattgggggaaaaaacggtgagccaaaaaggaccattagctatatggctgagcgagttgttggaactggatca

SEQ ID NO: 42569 - protein, 74 aa, Panicum virgatum
  misc_feature: Ceres CLONE 2012701
  misc_feature: SWISSPROT Homolog: EC 2.7.11.1 Non-specific serine/threonine protein kinase
MATTAPGGGPPAAADADAMEVDPPRVSADEKHVATVMGGNDAVTGHIISTTIGGKNGEPKRTISYMAERVVGTG

SEQ ID NO: 42570 - DNA, 673 bp, Panicum virgatum
  misc_feature: Ceres CLONE 2012709
  misc_feature: Encodes the peptide sequence at SEQ ID NO. 42571
atcggctcctccaattgaacccctaatcgcagagaaagcaacctgacagcagtatcaggttgtttcttcagagagcaatgtgatcaggcaaataatttcttgcttaaatgctgcatttgcagaagtacttcggggacaagagggaggataagatagcgctcatcaaagggatcaccaccggggaaggcttccagctcgctcctctgcctcaggaggttttgatcatctggggcgagttcgaccagatcttccctgtggagaaagcgcacaagatgaaagagaagctcgggaagaaggcgacggtgaaggtgatcccgaacacggggcacctgccgcagcaggaggatcccaagctcttcaaccaaatcctcctcgacttcctgctgcacccggccacatccaacggcagtgccgccgccgccgccaaatagcgcctagtattcgcgccgccttgatgttgtgtgcatccggtgatcgttcgtggagattctgtcttctccttttgttttcccagcctgttttgaaatgcagaggcaatgcagattgctgtgtgcctgtgttttaccaaggtgtagggagagagtttgcagccttgctttttttcagtttttttttctttttctttgcgagcaattgatattttggatcgatgtcacaaagaagctgcacataa

SEQ ID NO: 42571 - protein, 107 aa, Panicum virgatum
  misc_feature: Ceres CLONE 2012709
  misc_feature: SWISSPROT Homolog: EC 2.3.1.12 Dihydrolipoyllysine-residue acetyltransferase
MLHLQKYFGDKREDKIALIKGITTGEGFQLAPLPQEVLIIWGEFDQIFPVEKAHKMKEKLGKKATVKVIPNTGHLPQQEDPKLFNQILLDFLLHPATSNGSAAAAAK

SEQ ID NO: 42572 - DNA, 1793 bp, Panicum virgatum
  misc_feature: Ceres CLONE 2012718
  misc_feature: Encodes the peptide sequence at SEQ ID NO. 42573
aagaagcggcctttcccgtttcgatcagagacttgctctcatcttatcgatcgatcgattccctctctctcgctctgctactccgatcctagtttcatgagtagataggtgtttttttttggtggtagagcgacgtacccgcacgcgaaaggtgcggtgcgtgcagagaacaggtagctgggatcaagaagaagaatacgaatccatggagcggtcgccggcgccggcgccggtggaggtgcccaagttcttcgtgtgcccgatctcgctggaggtcatgcgggacccggtcacgctgtcgtcggggatcacctacgaccgggacagcatcgagcgctgggtgttcaccgacggccacggcgactgccccgtcaccaagctcccgctgggcgccgccgacctggagcccacgcccaaccacacgctgcgccggctcatccaggcctggtgcgccgcgcacgccgtcgagcgcttccccaccccgcgcccgcccgtcgacgccgaccgcgtcgccgcgctcgtcgacgcggcgaggaagggcggtcgccccgacgtgctgaccgcgctcagggagctcgcggacatcatcggcgagagcgaccgcaaccgccgctgcgtcgagggcgcgcccggcgccgtggagttcctcgtgtccgtcgtcaaggaccatggcgcgagcagcttggcgaagccttcgggcggatcccgagaggaatcggcgcacgacgtgctggaatcgcccaaggggacgtcgccggcggaggcggccctgagcatcctgcattcgcttaagctctcggaggagacaatgaagagagtcctggagagcggcgatgatctcgtggacaccctagcgtccgtgctgcggtggccgagccaccgggcgcgcacgcacgggatgcacctgttgaaggcggcgttggcggcgatgcagccctcgcggctgagctcggcgagcaccgagctgatcgaggccgtggtgcgggtggtgggagacagggcgtcgttgccgccgaaggccgtcaagctggctctccacgtgctctgccggctctgcccgtggggccggaaccgcatcagggtggtggaggccggcgccatggcggcgctcgtggagctgctcctcaacgagggttgcggcggcagcaccggcgggaagcgggcgggcgagctcgccgcggtggcgatcgaccatctgtgcggctgcgctgaggggcgccaggagctggtggcgcatccggcgggcctggcggccgtggcgagggcggcgacgcggctgtctcccacgggaaccgagagcgcggtgcgcgcgctgcacgcggtggcccggcactcggcgacccccgcggtgctgcaggagatgctggccgtcggggtggtggcgaggctgctgtacctggtgcaggccggcgctgccggcgagcggccgagggagagggcgagggagatgctcaagatgcacgccagggtgtggaggggctcgccgtgcttggcgtcgcacctggcatcgtcctacccttgctgatccatatcgcatgacgcggccgagcaagatcatgatcgatctggtggtgaccattttgcaccttcttccatcgataccaagattcgaagtaaattggcaaaacccttttatctttgcttcatttttgcatgtaaagattgtatttttaaaccgcaaggtttgatgtgtaacttccccaagatggggagattggaattggatatagagattcgctacaccagtatataaattgtaacattttggcaaaattataaaatgcaatgatcag

SEQ ID NO: 42573 - protein, 439 aa, Panicum virgatum
  misc_feature: Ceres CLONE 2012718
  misc_feature (11)..(88): Pfam Name: U-box Pfam Description: U-box domain
MERSPAPAPVEVPKFFVCPISLEVMRDPVTLSSGITYDRDSIERWVFTDGHGDCPVTKLPLGAADLEPTPNHTLRRLIQAWCAAHAVERFPTPRPPVDADRVAALVDAARKGGRPDVLTALRELADIIGESDRNRRCVEGAPGAVEFLVSVVKDHGASSLAKPSGGSREESAHDVLESPKGTSPAEAALSILHSLKLSEETMKRVLESGDDLVDTLASVLRWPSHRARTHGMHLLKAALAAMQPSRLSSASTELIEAVVRVVGDRASLPPKAVKLALHVLCRLCPWGRNRIRVVEAGAMAALVELLLNEGCGGSTGGKRAGELAAVAIDHLCGCAEGRQELVAHPAGLAAVARAATRLSPTGTESAVRALHAVARHSATPAVLQEMLAVGVVARLLYLVQAGAAGERPRERAREMLKMHARVWRGSPCLASHLASSYPC

SEQ ID NO: 42574 - DNA, 720 bp, Panicum virgatum
  misc_feature: Ceres CLONE 2012723
  misc_feature: Encodes the peptide sequence at SEQ ID NO. 42575
agacctgcacacgagcaatagccatggcggcctctgcttctttccttattattaggggcttcggcgtcatcgacaacatcaaggcgcaggtggaggctttgtgcccgcagaccgtctcctgcgccgacatcctcgccgtcgccgcccgtgactccgtcgtcgcgctcggcgggccttcatggaccgttccgctgggaagaagggactctaccaattcaagcgcggccctggcaaatagcgacctcccacctcctcagtttaacctctcgcagcttatcactgcgtttgggaacaagaacctcgacccaacagacctggttgccctctctggtgctcacacaatcggacaagcgcagtgcctcaacttccgggcccacatcaccgagcccaacatcaaccccaccttcgccgcgtcgctcagggccaactgccccgccacaggcggcgacaccaacctggcgccgctggacgtcaccacgcccaacaccttcgacaacgcctactacaccaacctgctcaaccagagggggctcctgcactccgaccaggagctcttcaacaacgccagcaccgacagcactgtccgcaacttcgcgtccaacgcagccgccttcaccaccgccttcaccacggccatgatcaagatggggcacctccagccgctcaccggggaccagggtcagatcaggcgcaactgctggagggtcaactcgtcgtaat

SEQ ID NO: 42575 - protein, 231 aa, Panicum virgatum
  misc_feature: Ceres CLONE 2012723
  misc_feature (2)..(193): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
  misc_feature: Functional homolog of the protein sequence given in SEQ ID NO 50229
  misc_feature: Useful for making plants with altered cell wall content and/or composition
MAASASFLIIRGFGVIDNIKAQVEALCPQTVSCADILAVAARDSVVALGGPSWTVPLGRRDSTNSSAALANSDLPPPQFNLSQLITAFGNKNLDPTDLVALSGAHTIGQAQCLNFRAHITEPNINPTFAASLRANCPATGGDTNLAPLDVTTPNTFDNAYYTNLLNQRGLLHSDQELFNNASTDSTVRNFASNAAAFTTAFTTAMIKMGHLQPLTGDQGQIRRNCWRVNSS

SEQ ID NO: 42576 - DNA, 829 bp, Panicum virgatum
  misc_feature: Ceres CLONE 2012726
  misc_feature: Encodes the peptide sequence at SEQ ID NO. 42577
acgcaccccacctccctccaccccccttgccgtcctcgatctcggctcctcctcctccccacccaaaccctcgcggcgggcgggggaggaagcgagcgatggcggcgctggaggcggcgagggagtgggcggcgtcggtcatcccgccggagctcgcagctgccgcggggggagacccgctcgccgcgctcgcggccaccgccgcgaccctcgtcgcggggctgcttatcctcgccgtatggttccaatccgggggcggggcgcaggccaagccggcccccacgccggtacgcctggcgccggtgaaggtcgacgccgacgccgacgtggacgacgggcggaagcgcgtcaccatcttcttcggcacgcagaccggcacagccgagggattcgccaagtccatggccgaggaggcgagggcgcggtacgagaaggccgtgttcaaagtggtggatctggatgactatgctcaggaggacgaagagtacgaggagaagctgaagaaggaaaccatagtgctcttcttcttagcaacatatggggacggagagcctacggataatgcagcaagattctacaaatggttcactgagttgaaacaggggaaagagaaggaagtttggctgaaggatcttaaatatggagtctttgggcttgggaaccggcagtacgaacattttaataaggttgcaaatgtggtggatgagctgctacacgagcagggtgggaaacgccttgttcctgtcggccttggagatgatgatcagtgcattgaggatgacttcaccgcatggaaagaactagtgtggccagagttagaccaattgct

SEQ ID NO: 42577 - protein, 243 aa, Panicum virgatum
  misc_feature: Ceres CLONE 2012726
  misc_feature (86)..(232): Pfam Name: Flavodoxin_1 Pfam Description: Flavodoxin
  misc_feature: SWISSPROT Homolog: EC 1.6.2.4 NADPH--hemoprotein reductase
MAALEAAREWAASVIPPELAAAAGGDPLAALAATAATLVAGLLILAVWFQSGGGAQAKPAPTPVRLAPVKVDADADVDDGRKRVTIFFGTQTGTAEGFAKSMAEEARARYEKAVFKVVDLDDYAQEDEEYEEKLKKETIVLFFLATYGDGEPTDNAARFYKWFTELKQGKEKEVWLKDLKYGVFGLGNRQYEHFNKVANVVDELLHEQGGKRLVPVGLGDDDQCIEDDFTAWKELVWPELDQL

SEQ ID NO: 42578 - DNA, 1369 bp, Panicum virgatum
  misc_feature: Ceres CLONE 2012737
  misc_feature: Encodes the peptide sequence at SEQ ID NO. 42579
caactgcaatcacttcttttcttagctggggccataccgtcggataagcagtagggagttgccacgagataaaaggaggagcaggcaggacaccagcggccggggtatcgacttggcaccgccccgcacaggctgtgaggtggaaaggtccttcgttcatccgggctgggagctgctcaacttgtaagcttcctaaatcatcccctttctccctgattcttgccttcttttctttaatttcgtccgcgtgacgcaagttggatttcacccctggatatctcttcttcgccgccgtgttttcttagataaaaaaaaagtggttagggggttgattcctctatactgtccgaaaggattcatcatcattcctacggattcagatcagactagccgaacttgtgctacatacagatcgaccacccaccgattggattagcttgtatgtatggtgttcttttagcttgtatcccaaatcatcccctgcttctccgtagtattttcttcgtctggatgggttgactggatgcgtttcttctccccccaactgttcttgagaaaaaaaagggcaattaatagatcatataaacagactaataatacaactttccgaatccctggtcacaaatcgattggctgatttaatttttgcatccgatccgagccctgcaatctgtttttccgatccatttctctctcttgcctgttcatttgttgacatttgttcgtcaggcacgcatggcggagtcgagcacccaagggcggcgaaagcaagctcgaggcaacaagttggcaccgcggtccggcttgtgggcgcacttgacccgactcagggatgacgacggcaaagtggagtgcaaccgttgcggtgcccagttgagcgcaaggcatggcaccaccagcctgtggaagcacttgaagaacaagaaggtgtgcagcggacaggaagaggaagctgatgatgctgctggtggtggtgtcggggcagcacgtccgccacatcaggatcagcagccccctccgctcctgccagcgacgccgccttccccggcagccggagcccacgagcacgagctccaactgcagcggagcatgaagccagctgttcccgtgccgccggcgccacagcggccgcagaagcagtaccgcggcgtgcggtgcgtcaagtgggaggccgacatccggctcccccgggaacgcacccgcctgtggctggggacgttcgacaccgccgaggaggccgcgctggcctacgaccaggcggcctaccgcctccgcggagacgcggcgcggctcaacttccccagcagcgcggcgtccttggtgccgctcgacccagccgcggaggccaagctccaggcggccatcgccg

SEQ ID NO: 42579 - protein, 211 aa, Panicum virgatum
  misc_feature: Ceres CLONE 2012737
  misc_feature (134)..(182): Pfam Name: AP2 Pfam Description: AP2 domain
  misc_feature (22)..(67): Pfam Name: zf-BED Pfam Description: BED zinc finger
MAESSTQGRRKQARGNKLAPRSGLWAHLTRLRDDDGKVECNRCGAQLSARHGTTSLWKHLKNKKVCSGQEEEADDAAGGGVGAARPPHQDQQPPPLLPATPPSPAAGAHEHELQLQRSMKPAVPVPPAPQRPQKQYRGVRCVKWEADIRLPRERTRLWLGTFDTAEEAALAYDQAAYRLRGDAARLNFPSSAASLVPLDPAAEAKLQAAIA

SEQ ID NO: 42580 - DNA, 503 bp, Panicum virgatum
  misc_feature: Ceres CLONE 2012737-R
ccgacgaagcctcagagtccggatcggacgacgagacgacctacctcctcgggtcccagcagcaggcattgggttcctcctccggccaagcctcagattccggattggacgacgagaacgagatgacctacctccccgggtcccagcagcaggccctgcgtcccagcagcggcctggacgagaagatcgaccgcctgaagcgcgacaagaacatcctgcattcctgctggtggatgcggggaagctgggtcaggagcagcggagcacgcgggcgaacatgcgggccatggcggaccagctgcagcacacggagctcaggcagacgcagatgatgaggttcctggcgctagcggtgcagaacccgggcttcctccagcagctgtatcccgaataatctcctgtttctccgtagtattttcatttgacttgttgcatttctccttttgcgccacccccaccccaaactgttcttgagaaagaaataaaaaggtgtctcccaagtc

SEQ ID NO: 42581 - DNA, 665 bp, Panicum virgatum
  misc_feature: Ceres CLONE 2012745-R
  misc_feature: Encodes the peptide sequence at SEQ ID NO. 42582
gtgaaaacggggtgaggcaaagcaggaggttttctggagagctggacatctctaacagcgatggcattgctgctgatccagctggaacagatggtgaatctgagaatgatacagaggatcaacaactcctagatgaagagaaagatatcgtgtcatctcttgtactcctgatacctgacatatgtagtcctggagaatgggtgcctatggagaaactccattcagagcttcttgaacgctttggttataactggcctagtgccagggtcaggaggtacctgcaacaacaggacgcctcagtctcatcaactgaaacagaaggcaggccatggtgcaacctgttgccactactcaggaagtatccagatgattttgtcctgagctcagtgaccagaggggaagtaacaacagagtatgttgggttggtatccctagtgtccttggggaatggaccatgaaccttaaaaccgttctctgaattctgatgctgctcaggccatcatcagcctttgttctaaagaaaccgggacatgttgtttgtatccgaggctcatgttgtagggcctatcatgatgtattgtaaacctgtgcaccttcgttgtgggtatctttaggatttgatctgtgcagtccattgcaacaatttgcaaactttctttcgacag

SEQ ID NO: 42582 - protein, 151 aa, Panicum virgatum
  misc_feature: Ceres CLONE 2012745-R
  misc_feature: Functional homolog of the protein sequence given in SEQ ID NO 51653
  misc_feature: Useful for making plants with altered alkaloid content
ENGVRQSRRFSGELDISNSDGIAADPAGTDGESENDTEDQQLLDEEKDIVSSLVLLIPDICSPGEWVPMEKLHSELLERFGYNWPSARVRRYLQQQDASVSSTETEGRPWCNLLPLLRKYPDDFVLSSVTRGEVTTEYVGLVSLVSLGNGP

SEQ ID NO: 42583 - DNA, 273 bp, Panicum virgatum
  misc_feature: Ceres CLONE 2012745
aaatcggttccgcttcaagtagggtttgtgggcggagctctcctatccccgcgtgcttcgccggagtaggcgcggtggctagggagggggcggcggtgattgggatcggccggggtggggcaacggggactgggatggatttggaagggagtacaagggatgatgcggtcgaaccggccgtgtggtggccggtggaggtcaatggcgggggtggagggaaagtggcgccggctttcagtccgcggcgggtgcgcagcgcgggataggcggcgc

SEQ ID NO: 42584 - DNA, 579 bp, Panicum virgatum
  misc_feature: Ceres CLONE 2012747
  misc_feature: Encodes the peptide sequence at SEQ ID NO. 42585
ctagaagccctctgcctcctgcgcctccaccctcctcgccgcctctcgccctctgagacaggagatcccatcaggtgagaggaatctcccgccgccatgtcgtccagcgagatcgcctgcacctacgccgccctcatcctcagcgacgatggcatccccatcaccgccgagaagatcgcgactatcgtgaaggccgccaacatcaaggtcgagtcttactggccggcgctcttcgccaagctccttgagaagcgcagcgttgaggacctcatcctctccgttggatctggtggtggtgctgccccagttgctgctgctgccccagctggtggtgctgcagctgctgctgccccggctgccgaggagaagaaaaaggaagaggagaaagaggagtctgatgacgacatgggcttcagcctgttcgactgaggatacacatgcccatctattagcaaattcacttatgctgtccaagactatctttgttatgtctctaggcttttgttacaagtactcaaattttgagttttgggtcgtggtgctatggctatgtgatgatgaaccagataccatcttatt

SEQ ID NO: 42585 - protein, 110 aa, Panicum virgatum
  misc_feature: Ceres CLONE 2012747
  misc_feature (21)..(109): Pfam Name: Ribosomal_60s Pfam Description: 60s Acidic ribosomal protein
MSSSEIACTYAALILSDDGIPITAEKIATIVKAANIKVESYWPALFAKLLEKRSVEDLILSVGSGGGAAPVAAAAPAGGAAAAAAPAAEEKKKEEEKEESDDDMGFSLFD

SEQ ID NO: 42586 - DNA, 629 bp, Panicum virgatum
  misc_feature: Ceres CLONE 2012750
  misc_feature: Encodes the peptide sequence at SEQ ID NO. 42587
tgttcctcaagcagctcaagtctggcctcctcctcatctctgggcctttcaagataaatggagtaccaatccgccgtgtgaaccagacctacgttgttgctacatccaccaaggttgacatctctggtgttgatgttgcgaagtttgacgacaagtactttgccagggaaaagaagcagaagtctaaaaagactgagggcgagctttttgagacagagaaggaggcttcaaagtctctgcctgacttcaagaaggatgaccagaaggctgtggatgctgctctgatcaaggctattgaggctgtcccagacctgaaaacctacattggtgcccggttctctctcagggatggtgacaagccccatgagatggtcttctaaatttagttttggagttctgaagaagtcgttttgcctagtgtgctcctgtactgagttttgtactcctggtagcggacctttgatccctattgaagtctgcctgtcaaatattatgagaagatttaagaaagttttatccctagttgtggtttatgattgtgttatcagctgggtccatcgagttataattcacggcatcccattttgtttgaattgctcaatatttgtttatattgtcatttgagtgcc

SEQ ID NO: 42587 - protein, 125 aa, Panicum virgatum
  misc_feature: Ceres CLONE 2012750
  misc_feature (18)..(125): Pfam Name: Ribosomal_L6e Pfam Description: Ribosomal protein L6e
FLKQLKSGLLLISGPFKINGVPIRRVNQTYVVATSTKVDISGVDVAKFDDKYFAREKKQKSKKTEGELFETEKEASKSLPDFKKDDQKAVDAALIKAIEAVPDLKTYIGARFSLRDGDKPHEMVF

SEQ ID NO: 42588 - DNA, 679 bp, Panicum virgatum
  misc_feature: Ceres CLONE 2012756
  misc_feature: Encodes the peptide sequence at SEQ ID NO. 42589
tgacacagagagacgcgccgaccggaatggcggccagcagcgtagcaacgcctcgtggtcgtggcatggcgtggccgtggctggcgttggcgttgtgcgtcgcgacggcgctgcgggtaccggccgcgtcggccgaggcggcggcctacatcgtgcacatggacaagtcggccatgcccagggcgttcgcgagccaccagcggtggtacgagtccacgctctccgcggtcgccccgggcgccggcatgtactacgtctacgaccacgcggcgcacgggttcgccgcgcggctgcgcgacggggaggtcgaggcgctccggcggtcgcgcgggttcgtgtcgtgctaccgcgacgacgcccgggcggtgacccgggacacgacgcacacgcccgagttcctcggcgtcagcgcgccgggggccctgtgggaggcggccgggtacggcgacggcgtcatcgtcggcgtggtggacaccggcgtgtggcccgagagcgcgagcttccgcgacgacgggctcccaccggtgccggcgcggtggaagggcgcctgcgagtccggcaccgcgttcgacggctccaaggcgtgcaaccggaagctcatcggcgcgcgcaagttcaacaaggggcctcatcgccaacgagaacgtgaccatcgccgtcaactccccgcgggacaccg

SEQ ID NO: 42589 - protein, 217 aa, Panicum virgatum
  misc_feature: Ceres CLONE 2012756
  misc_feature (39)..(115): Pfam Name: Subtilisin_N Pfam Description: Subtilisin N-terminal Region
  misc_feature: SWISSPROT Homolog: EC 3.4.21.25 Cucumisin
MAASSVATPRGRGMAWPWLALALCVATALRVPAASAEAAAYIVHMDKSAMPRAFASHQRWYESTLSAVAPGAGMYYVYDHAAHGFAARLRDGEVEALRRSRGFVSCYRDDARAVTRDTTHTPEFLGVSAPGALWEAAGYGDGVIVGVVDTGVWPESASFRDDGLPPVPARWKGACESGTAFDGSKACNRKLIGARKFNKGPHRQRERDHRRQLPAGH

SEQ ID NO: 42590 - DNA, 673 bp, Panicum virgatum
  misc_feature: Ceres CLONE 2012776
  misc_feature: Encodes the peptide sequence at SEQ ID NO. 42591
ctgtcgtccccggtgactcggataaagctgcatttgatcctcataaatgatgaacgagtcttttcttgataggatggtttcccagcttccatcaggatgcaagtactacactggatatcccaaggacctagggccatcaagaattataccattcacatctgagcgtcagtttgtacagctattgcatgaaggaaggcctgtaattgttgcctttactattaagtgcacttatacacaacatcttgataaagtactggaagaggctgccgcctcattttatccacatatcaagttcatcagagttgaatgcccaaagtatccacggttatgcctcacgaggcaaacaaatgaatatccatttgttgaagtattttacaatccagaacaggctgcaagccaaggaaagagcgtggatcctaacatcaccaagtattctgtaaaagtgctacccttcaactatgatcagagcttgtatggatttcgggaatatttcaagaagcatggtttcaagtattctgaaacaagataattctatcaatataaatatgcaatgtgagaacttctagggagttcattgtcatagttgaactgtggggctgatgtctttcctagttgaaggaatgcctgccctgtgctcatgtcacggtatcatgcctatagaatagaactgcaa

SEQ ID NO: 42591 - protein, 160 aa, Panicum virgatum
  misc_feature: Ceres CLONE 2012776
  misc_feature: SWISSPROT Homolog: EC 5.3.4.1 Protein disulfide-isomerase
MMNESFLDRMVSQLPSGCKYYTGYPKDLGPSRIIPFTSERQFVQLLHEGRPVIVAFTIKCTYTQHLDKVLEEAAASFYPHIKFIRVECPKYPRLCLTRQTNEYPFVEVFYNPEQAASQGKSVDPNITKYSVKVLPFNYDQSLYGFREYFKKHGFKYSETR

SEQ ID NO: 42592 - DNA, 471 bp, Panicum virgatum
  misc_feature: Ceres CLONE 2012778
  misc_feature: Encodes the peptide sequence at SEQ ID NO. 42593
aaccccttcctccgctttcccttcgcgcgcacgcctcctccgcgatttcgtcgagcaccccccgcgccgcgccgcgccatgccggcgcccgccggcgcgtcccgctccggcgccggctccgaagaacccgagtccgcggcggcgcgccgcctccgccgcctctccctgcacctcctccacctcgagccctcccccgccccgggcgatcaggcggcgggcccggcgctggcccccgcggcgtgcgcggggggggtgcggcgcgtcgagggcggcgcggacgtggcggcggcgctggcggcgtacctgcagggccggcaccgcgcggcgcagctgcggctgttcgacttcctcggcgcgcgcccggacttgcatacgcccgtggagctcgccgcggccgcgcaccgggagctctgcttccgccagctgcgcgcgctggggctcgacgccggggtgcgcccgctcacggctcat

SEQ ID NO: 42593 - protein, 130 aa, Panicum virgatum
  misc_feature: Ceres CLONE 2012778
  misc_feature: SWISSPROT Homolog: EC 1.3.3.6 Acyl-CoA oxidase
MPAPAGASRSGAGSEEPESAAARRLRRLSLHLLHLEPSPAPGDQAAGPALAPAACAGGVRRVEGGADVAAALAAYLQGRHRAAQLRLFDFLGARPDLHTPVELAAAAHRELCFRQLRALGLDAGVRPLTA

SEQ ID NO: 42594 - DNA, 634 bp, Panicum virgatum
  misc_feature: Ceres CLONE 2012790
  misc_feature: Encodes the peptide sequence at SEQ ID NO. 42595
ctcccacgccgcctcacctcgcgctaggtagcttgcttcgaatcccacatccccatccgcttctcgccatgggcgccgccgcggacaaccacgaggaggagtcgagcccgctcctcccagctgcggttggcgccgccatccccgcggacgagaagcccccgcaggcgccagcgccggccccggctccggaggccaccaagctctacgccaatggggtccccgtcgtgatcggcgagccggtcgcggcgcacgccatcccgcgggagagctggagctccgggatcctctcctgcctcggccgcaacgacgagttccgcagcagcgacgtcgaagtgtgtcttcttggaagcgtagcaccatgcgtgctgtatggcagtaatgttgagaggcttgcggctggacaaagcacttttgcaaacagctgtttgccttacactggtctctatatgcttggaaactccctctttgggtggaactgcctagccccatggttctctcatcccactcgtacagctattcgtcggcgctacaatcttgagggtagctttgaggctttcaccaggcaatgtgggtgctgcggtggtctggtggaggatgaggagaggcgcgagcacctagaggctgcctgtgacct

SEQ ID NO: 42595 - protein, 188 aa, Panicum virgatum
  misc_feature: Ceres CLONE 2012790
  misc_feature (68)..(179): Pfam Name: PLAC8 Pfam Description: PLAC8 family
MGAAADNHEEESSPLLPAAVGAAIPADEKPPQAPAPAPAPEATKLYANGVPVVIGEPVAAHAIPRESWSSGILSCLGRNDEFRSSDVEVCLLGSVAPCVLYGSNVERLAAGQSTFANSCLPYTGLYMLGNSLFGWNCLAPWFSHPTRTAIRRRYNLEGSFEAFTRQCGCCGGLVEDEERREHLEAACD

SEQ ID NO: 42596 - DNA, 1338 bp, Panicum virgatum
  misc_feature: Ceres CLONE 2012796
  misc_feature: Encodes the peptide sequence at SEQ ID NO. 42597
aactaacgctaaaaaagtaacagtttctgtactttattgccgaagcgaagagttgtatcggagcgtcggtttgagaacacctgccaacacacaaaccccccgtgccgcaagtaacaatgaccacacagcccgcacacatcatggcggccgcccactcgaccgccgcgccgccgaaaagcacgccggtgaagcccgccaagacgcgcaagaagtacaacgcctcggagggcaccgtcgggcgcatcacgatgatcttcgtcatgatgaactacgcgttgatgatgctctggggctacatccgtgagggcttccgctggttcttccccgaccgcgagctgaaggccccggacggctacgcgccgctgctgcgcgggtcggacgatttcttctcccgccgcatgtaccgccgcgtgcgcgactgctggaaccgcccaatcgccacccgcgccggccgcatcatcggcgtcatggagcgcacgtcagacagcgcgaacaagaaattcaccatgacgggcaatacgatcccggccatcaacctcgcctcgtacaactacctgggcttctccgaggacctaccgtccgtgacggaggacaacctcgcggccctggagcgctacggcaccggcgcgtgcgcctcgtcgcaggagggcggccagacgcacgtgctccgagaacttgagaccgagatcgcacacttcgttgggaaggaggccgcggtcgtgtacgcgatgggcttcgtgaccaacttcagcgggctcgcgccgctgttctgcaaggacacgctggtcatctccgactcgctgaaccacgcgtcgctcgtcgcgggcgtgcgcacgtcgtacggccgcgtgaaggtgttcaagcacaacgacatgaagtccctggaccggactgttcgccaggcgatcatcgacggccagccccgcacccaccgcccgtggaagcgcatcgtcctcctcgtcgagggcgtgtactcgatggagggtgagatcctggacctgccgcgcgtcgtggagatcaagaagaagtacaagtgcctgctgtacgtggacgaggcgcatagcatcggcgcgctgggcccgcacgggcgcggcgtgtgcgaccaccacggcgtgaacccggcggacgtggacctgctcatgggcaccttcaccaagtccttcggcagcatcggcggctacatcgcgggcgacgcgaagctcgtcgcggatctgaagcgctacagcggcgcgagcctgctgggcgacgccatgtcgtcggcggcggcgcagcaggcgctgtcgtcgctgaaggtgatgctgggcaaggacggcacgacggtcggcaaggacaagatcc

SEQ ID NO: 42597 - protein, 399 aa, Panicum virgatum
  misc_feature: Ceres CLONE 2012796
  misc_feature (128)..(399): Pfam Name: Aminotran_1_2 Pfam Description: Aminotransferase class I and II
  misc_feature: SWISSPROT Homolog: EC 2.3.1.50 Serine C-palmitoyltransferase
MAAAHSTAAPPKSTPVKPAKTRKKYNASEGTVGRITMIFVMMNYALMMLWGYIREGFRWFFPDRELKAPDGYAPLLRGSDDFFSRRMYRRVRDCWNRPIATRAGRIIGVMERTSDSANKKFTMTGNTIPAINLASYNYLGFSEDLPSVTEDNLAALERYGTGACASSQEGGQTHVLRELETEIAHFVGKEAAVVYAMGFVTNFSGLAPLFCKDTLVISDSLNHASLVAGVRTSYGRVKVFKHNDMKSLDRTVRQAIIDGQPRTHRPWKRIVLLVEGVYSMEGEILDLPRVVEIKKKYKCLLYVDEAHSIGALGPHGRGVCDHHGVNPADVDLLMGTFTKSFGSIGGYIAGDAKLVADLKRYSGASLLGDAMSSAAAQQALSSLKVMLGKDGTTVGKDKI

SEQ ID NO: 42598 - DNA, 646 bp, Panicum virgatum
  misc_feature: Ceres CLONE 2012796-R
gtggccgctgtacttgctcaagtaaggtccttccctccacgcacaggggtcgccctcatccctcgtggcggtgccttgccctctgccgttccgtcgcacatttgctccctggcaaagggcgcataacggctgccctctgtctcaaccacgctccgtacgcggcgccgcggccaagacgtgacggcgcactcatttctgcgccggttcactgactccctcgcgcgcttcgaaccccctcccctctccagtttaatttcgtttctctttttgttgtgagaatcaccctcccacccgcacacgcaacacagccaacccgccgacaccaaccggcatctcgcccacacaactgggaccacggaggtcagcgcggccacgcgacctgtccaaaacacagcaaacaactacgaacgagcgcacgacgccggacgacactgtaaaccgtcgctgctgccagctgcacggccaccgccgcgcaggtagagaggcagtgagaaaatccgcgcgtcatcaccagcggcgcgcgtgagtgaattcgcgcgcgcgcctctcggacccgccaggccattcgtcgaccccccgccccccggaagtaaccgcattaacggaaggagattggattgtgaagatgtcagagcccattacgctt

SEQ ID NO: 42599 - DNA, 1452 bp, Panicum virgatum
  misc_feature: Ceres CLONE 2012807
  misc_feature: Encodes the peptide sequence at SEQ ID NO. 42600
aaaccaaccacacgctcgctcgcaccgggccgaccggtcgccgacggccgatggcctcctccctccgccatttcgccggccccgcctgcatccccgcccccgcccccgcctccgccggggccggggcgtccggcgccacctgcttgctgcgccgctacacccccgacttctgcgccttcgcggcgctccgcccgatcaggcccgccgccgccttctccgccgcgaatccactcgcctctccggccgagcacgagcagcgccagcagcagcagcaggccgtcccgtgccacgacggcgacccaccggccccgtcgccgtcgccgtcgccgccgccgccgccgccgtccccggccccggcgccgctgcgggtggggatcgtcgggttcggcaacttcgggcagttcatcgcggggggcatccagcggcagggccacgccgtgctggcggcctccagatccgactactccgactactgcgccggccgcgggatccccttcttcacgagcgtcgacgcgctctgcgaggagcagccggacgtgctgctcatctgcagctccatcctgtccacggaggccgtcgtccgcgccatcccattccacaagctccgccccgacaccatcgtcgccgacgtgctctccgtcaagcagttccctcgcaacctcctcctcgagattcttccactggggtttgggattgtctgcacgcacccgatgttcgggccagagagcggtaaaaatggctggggtaagctcccattcgtctacgacaaggttagggtgacagaagatggggatcaagcagtcaaatgcgaacaattcttgagcatatttgagcatgagggatgtaggatgatggagatgtcatgcgcggagcatgatcgctatgccgcaggaagtcaatttatcacacacacaattgggagggttttgtcacaactgaacctaaagacaactccaattaacacaaagggttacgagagcttgttgcaacttactcataacactgtaagtgatagttttgatctatactatgggctttttatgtacaatatcaatgccacggagcagcttgataatttggagcgggcatttgagagtgtgagacagatgttgtatggtcggctccatgatttactacgaaagcaaatcgtggagagagtccccgtgacaacgatctcttcaggaaaattggaaaatagcaggtcaaattctttcgcagcatctcccttatcgcctataataacagaagagaataaacatgtatcttcaattacttctgtagcatctcctactaatattttacaaccgaccacttccagtacagggtaatggtaaattagtatatctagctattgttgttttgttgtacatttatattttgttgtggaagatacacgtgtgaaattgtatagttgttagtattgacgggtggagtaaaatcattgctttgctt

SEQ ID NO: 42600 - protein, 425 aa, Panicum virgatum
  misc_feature: Ceres CLONE 2012807
  misc_feature: SWISSPROT Homolog: EC 1.3.1.78 Arogenate dehydrogenase (NADP(+))
MASSLRHFAGPACIPAPAPASAGAGASGATCLLRRYTPDFCAFAALRPIRPAAAFSAANPLASPAEHEQRQQQQQAVPCHDGDPPAPSPSPSPPPPPPSPAPAPLRVGIVGFGNFGQFIAGGIQRQGHAVLAASRSDYSDYCAGRGIPFFTSVDALCEEQPDVLLICSSILSTEAVVRAIPFHKLRPDTIVADVLSVKQFPRNLLLEILPLGFGIVCTHPMFGPESGKNGWGKLPFVYDKVRVTEDGDQAVKCEQFLSIFEHEGCRMMEMSCAEHDRYAAGSQFITHTIGRVLSQLNLKTTPINTKGYESLLQLTHNTVSDSFDLYYGLFMYNINATEQLDNLERAFESVRQMLYGRLHDLLRKQIVERVPVTTISSGKLENSRSNSFAASPLSPIITEENKHVSSITSVASPTNILQPTTSSTG

SEQ ID NO: 42601 - DNA, 382 bp, Panicum virgatum
  misc_feature: Ceres CLONE 2012808
  misc_feature: Encodes the peptide sequence at SEQ ID NO. 42602
aaaactcaaaggagaggaacacaagcggaacaagaaaggcagaaagcgaagggggtcaggctagaaagagacgctcgtctcgtctcgtcacgtccgccgccatggctctgggccggggcctgctcgccgccgccgcggcggcggcggccttcctcctgctcctcgccgccgcctccacggcgcccgacatgtccatcatctcctacaacgaggagcacggcgcgcgggggctggagcggacggaggccgaggtgcgggcgatgtacgacctctggctcgccgagcacggccgggcctacaacgcgctcggcgagcacgaccgccgcttccgtgtcttctgggacaacctccgcttcgtagactctcacaatgcccgcgctgc

SEQ ID NO: 42602 - protein, 93 aa, Panicum virgatum
  misc_feature: Ceres CLONE 2012808
  misc_feature (55)..(91): Pfam Name: Inhibitor_I29 Pfam Description: Cathepsin propeptide inhibitor domain (I29)
  misc_feature: SWISSPROT Homolog: EC 3.4.22.14 Actinidain
MALGRGLLAAAAAAAAFLLLLAAASTAPDMSIISYNEEHGARGLERTEAEVRAMYDLWLAEHGRAYNALGEHDRRFRVFWDNLRFVDSHNARA

SEQ ID NO: 42603 - DNA, 1830 bp, Panicum virgatum
  misc_feature: Ceres CLONE 2012811
  misc_feature: Encodes the peptide sequence at SEQ ID NO. 42604
actaacgctaaaaaagtaacagtttctgtactttattgcttcctgaacgcagtttctctgccatttttatacgcccttacagtgtgcacacctcgccttcacacactgcggccccgctccccttgttcaaaatcgttgggttatcatcatcacacgctgactcactatgggtattccaggactcttccagattctcgaaccgacgcaggttaccgcaccgctaggtcgcttcgccgctgatccgcgacccattggcgtcgacggacccaacatcatccacgggctggcccgaaagcacgcactgacccttgcgctcggcaaggtcgatgccttcgcgaaggacgcggcgaagctgttcttggggttgcaaaagcgctgccatgtccgattcatggttgttttcgatggggcctcaccgccaatgaaggcggaggaggcaaagaagcgagacgcagagcgcgcctcaaatcgctctatcgctgcggaacttctcgcacttggcgacacggaggccgcggtgcctcttctacgagcgtcgccgaccgtcggccgcttcgtccacgacgtcgcgttggcgattcgcgccagcggggttgcagtgctgtttgcaccgatggaagcggaggcgcagctggcgttcatgtcccgcaccggtgagctcagcgctgtctggagcaacgacagcgacttggtcatgtacggctgcggtgcgatcattcgagacatcgatccggccagtaagtgcgtggccacagtcattccgcccttgcgaaagctgccgacaaagtcagcgaaatgtttcagtattcctccggacagcaaatgtcacccggggctgcaagagctagcggagaaaccatacgcgttggccatggcgtgctctctcgcgggcggcgatttctcgccgcagttcagccactcgctcgagaaggctattcaggtggtcctgtcggaggctcgggccaacaccacattcatgggcttactcgagggcgtggccgcgtcgttgaatatgaaagagttcggcgtcgagacgcttcacaaggcggtatacgccattacataccactgggtgtacgatgtcaatacggagcgttgggtcacgaataccccgctgaagggtcaagacgttgtcgaggaactactgggatccgcgccgtcgcccgcggagcagaaaacatttgtctactctggcgcgtcggacggcacaaaaccgatgagtctggtcgacgagtttatgggtgatccacagtccttcatgtacgccgtccaaccggcgccgacaaagttgccatccgactcggtcttctgttccgcgtgtgggctcgtcgtgacgacagcatacttgcccactcacaacacaacgaaacgccacacagcgatggctgctctttcccggcttcgcgaactcaaacgaccaccgtggcacacgaagcccgcagctgctgttgtcgcgtcagcagagcgggcgccaacaatccccgcacgcacaacgccggtcgacgacaagtcttcatcagtggatagcctcaaggcgcagtacgcgtgcgagggcgtgcagtcagtaagcgtgcccatcgagtcggcttcggcgatgtcacccagcttcgcgaaagcggagccggattcatctagcggcaaaggcacaaccaaagctgacgtgttgcccctcggtgatgcggtgaccgtggacggcgcaacagcagatcgtttcgtggatcgcgcgcaggtgttgcagctggtgctcgtcaccatgaagcggcggccgcgggcttgacgagatgaaccttctcgctttccttctggttcacttcctctcacttcttttgc

SEQ ID NO: 42604 - protein, 536 aa, Panicum virgatum
  misc_feature: Ceres CLONE 2012811
  misc_feature (139)..(248): Pfam Name: XPG_I Pfam Description: XPG I-region
  misc_feature (1)..(101): Pfam Name: XPG_N Pfam Description: XPG N-terminal domain
MGIPGLFQILEPTQVTAPLGRFAADPRPIGVDGPNIIHGLARKHALTLALGKVDAFAKDAAKLFLGLQKRCHVRFMVVFDGASPPMKAEEAKKRDAERASNRSIAAELLALGDTEAAVPLLRASPTVGRFVHDVALAIRASGVAVLFAPMEAEAQLAFMSRTGELSAVWSNDSDLVMYGCGAIIRDIDPASKCVATVIPPLRKLPTKSAKCFSIPPDSKCHPGLQELAEKPYALAMACSLAGGDFSPQFSHSLEKAIQVVLSEARANTTFMGLLEGVAASLNMKEFGVETLHKAVYAITYHWVYDVNTERWVTNTPLKGQDVVEELLGSAPSPAEQKTFVYSGASDGTKPMSLVDEFMGDPQSFMYAVQPAPTKLPSDSVFCSACGLVVTTAYLPTHNTTKRHTAMAALSRLRELKRPPWHTKPAAAVVASAERAPTIPARTTPVDDKSSSVDSLKAQYACEGVQSVSVPIESASAMSPSFAKAEPDSSSGKGTTKADVLPLGDAVTVDGATADRFVDRAQVLQLVLVTMKRRPRA

SEQ ID NO: 42605 - DNA, 705 bp, Panicum virgatum
  misc_feature: Ceres CLONE 2012838
  misc_feature: Encodes the peptide sequence at SEQ ID NO. 42606
aacagagcccaccaccaccgcctccccatcgcgccaccgcaaaagctgcgaccaagtactgctagtactacccacaacaagctcctgctcctcctgattcttctgctagtcgtcgtcttcttcttcttcttgatcccgaccgtcttgttgcccccagaccgaaccatgtcgtcgtcgtcgtcgtcgtcttcctctgcatcggacgccgccgcttcgacgccgttcgagaagcccagggccgtggtcaagaagctcctcgccgagtcgcagcccgagggtcagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggcgccttcacccaccaggattttgcaggccacaagggcaccatcaggacaggggatgtccagtggatgactgccgggcgtggcatcgtgcactcggagatgccggcgggagacggggtgcagaagggcctgcagctctggatcaacctctcctccaaagacaagatgatcgagccccggtaccaggagctccagagcaaggacatcagccgcgccgacaaggacggcgtggaggtccggatcatcgccggcgaggccttcggcgtgcgctccccg

SEQ ID NO: 42606 - protein, 179 aa, Panicum virgatum
  misc_feature: Ceres CLONE 2012838
  misc_feature (40)..(136): Pfam Name: Pirin Pfam Description: Pirin
MSSSSSSSSSASDAAASTPFEKPRAVVKKLLAESQPEGQGATVRRSIGRHELRNLDPFLMLDEFSVSKPAGFPDHPHRGFETVTYMLEGAFTHQDFAGHKGTIRTGDVQWMTAGRGIVHSEMPAGDGVQKGLQLWINLSSKDKMIEPRYQELQSKDISRADKDGVEVRIIAGEAFGVRS

SEQ ID NO: 42607 - DNA, 721 bp, Panicum virgatum
  misc_feature: Ceres CLONE 2012840
  misc_feature: Encodes the peptide sequence at SEQ ID NO. 42608
gtctttccttcgactcgcgctcgaaatccgccgccccgaggttccaaaccctagcttcttcccagcttccacgaaccctagatcccaaatccaccacccgtcatcccctgatcgccgtacctgacccttctctttgcagtcgattctacgccgacccgctcgtttctcttttccgccgtccccgagatctcgaggcaggatggtggaggcgaaggacaacgaggtgtacgaggaggatctcgtcgactacgaggaggaggtggagaatgtcgccgacggcgccccaaccaacggctccgccgatgtcgtcaagaaggggtacgtggggatccacagctcggggttcagagacttcctgctcaaaccggagcttctccgtgccatccaggactgcggatttgagcatccttccgaagtgcaacatgaatgcatccctcaagccattcttggaatggatgttatctgtcaagcaaagtcagggatgggtaagactgcggtttttgtcctatcaactcttcagcagattgatcctgttgctggccaagtagctgcacttgtgttgtgccacacaagagagttagcttaccagatttgccatgaatttgagagatttagcaaatacctgcctgaattaagagtcgctgtcttctatggtggtgttcacataaaaaatcataaggatctgttgaagaatgaatgcccccatattgtggttggcacg

SEQ ID NO: 42608 - protein, 173 aa, Panicum virgatum
  misc_feature: Ceres CLONE 2012840
  misc_feature (71)..(173): Pfam Name: DEAD Pfam Description: DEAD/DEAH box helicase
  misc_feature: Functional homolog of the protein sequence given in SEQ ID NO 50368
  misc_feature: Useful for biocontainment applications
  misc_feature: Useful for making plants with modulated biomass
  misc_feature: Useful for making plants with modulated cold sensitivity
MVEAKDNEVYEEDLVDYEEEVENVADGAPTNGSADVVKKGYVGIHSSGFRDFLLKPELLRAIQDCGFEHPSEVQHECIPQAILGMDVICQAKSGMGKTAVFVLSTLQQIDPVAGQVAALVLCHTRELAYQICHEFERFSKYLPELRVAVFYGGVHIKNHKDLLKNECPHIVVG

SEQ ID NO: 42609 - DNA, 669 bp, Panicum virgatum
  misc_feature: Ceres CLONE 2012849
  misc_feature: Encodes the peptide sequence at SEQ ID NO. 42610
acgcaatctaggcgttattcgttcggcttcgctgcgcgctcgaattgcgtgatcgatcatgcggccggcggcggaagaattggggtcgagatcaggcaggagcgaggagatggcgcaggggacgctggaggtgctgctcgtcggagccaagggctgcgagatcaccgatcgcctgagtaacatggatccctacgcggttctgaaatgccgctcccaggagcagaagagcagcgttgcgtctgggaaaggatgcgatcctgaatggaacgagacgtttgtgttcaccgtctccgacagcacaacagagctattcgtcaagctcctggacagcgatggtggcacggatgacgactttgttggtgaagcaacgattccactggaagcagtttttactaatggaagcatccctccaattgaataccctgttgtgaaagatgaaaaaaactgcggagaaatcaaacttggtctcacattcactccagaggatgctcgtgatcagggcttctgatacatagtagtcttgaaaagaagcagattccttgatgtcttgccgcaatgtcatgtgtgaccaagtcagtgttcttgagcatgtacaccttatatagtattgaagcctgcaacttattactctaaaacgagtccccgttttgttggcatgttgctgaaagt

SEQ ID NO: 42610 - protein, 149 aa, Panicum virgatum
  misc_feature: Ceres CLONE 2012849
  misc_feature (23)..(104): Pfam Name: C2 Pfam Description: C2 domain
  misc_feature: Functional homolog of the protein sequence given in SEQ ID NO 50618
  misc_feature: Useful for making plants with modulated nitrogen use efficiency
MRPAAEELGSRSGRSEEMAQGTLEVLLVGAKGCEITDRLSNMDPYAVLKCRSQEQKSSVASGKGCDPEWNETFVFTVSDSTTELFVKLLDSDGGTDDDFVGEATIPLEAVFTNGSIPPIEYPVVKDEKNCGEIKLGLTFTPEDARDQGF

SEQ ID NO: 42611 - DNA, 603 bp, Panicum virgatum
  misc_feature: Ceres CLONE 2012856
  misc_feature: Encodes the peptide sequence at SEQ ID NO. 42612
aatcacatttcctctcccccccttgctccctttccaaattattatctatcacgcacatcagcgatcgagtttgcattgcattgcattcggggcttgccatggccaaacccatctctgccgtggccgccgaggtgcgcgcgcagcgcggcatcgccctccccctcatcgccatgaacctcacctggttcgccaagctcgccgtcagcaccgccttcctgggccgcctcggcgacctcgacctggccgccggcacgctcggctacagcttcgccaatgtcaccggcttcgccgtcctcaccggcctctgcggcgccatggagcccatctgcggccaggcgcacggcgccaggaacgtggccctcctccgccggacgctgctcatggccaccctcatgctcctcgccgcctccgtccccatcgcgctcctctgggcgcgcgtcgacgccgtgctcctgcgcttgggccagcagcccgacatcgccgccgcggccagggcctacgtgctcggcctcctcccggacctcgccgtcacctccctgctcagcccgctcagggcctacctcagctcgcaggaggtgaccctgcccacgctggtggccgccg

SEQ ID NO: 42612 - protein, 168 aa, Panicum virgatum
  misc_feature: Ceres CLONE 2012856
  misc_feature (21)..(168): Pfam Name: MatE Pfam Description: MatE
MAKPISAVAAEVRAQRGIALPLIAMNLTWFAKLAVSTAFLGRLGDLDLAAGTLGYSFANVTGFAVLTGLCGAMEPICGQAHGARNVALLRRTLLMATLMLLAASVPIALLWARVDAVLLRLGQQPDIAAAARAYVLGLLPDLAVTSLLSPLRAYLSSQEVTLPTLVAA

SEQ ID NO: 42613 - DNA, 129 bp, Panicum virgatum
  misc_feature: Ceres CLONE 2012856-R
  misc_feature (68)..(68): n is a, c, t, g, unknown, or other
gagggccaccaggcgggaacccaggggggcgccgccgcgagccaggcggggcgggaggcggcgaccgngcgcagggacagggcggcggaggcggacaaggcgcggaggcgggccgccggcgggggcgcc

SEQ ID NO: 42614 - DNA, 676 bp, Panicum virgatum
  misc_feature: Ceres CLONE 2012860
  misc_feature: Encodes the peptide sequence at SEQ ID NO. 42615
acattccccacctacgttataacaccctccttctcccccacccccgcgcccccttccaatctgaaattctccacccaaccctagccgcccgccgccatggccgaatccggcgactcgtccccgcactccgccgcggccacggacgacacgcaccacgacggctcggagtccgcggcggccacggcggcagggcacgcgccgcctctgccgccggcgaaggtgcggctgatggtgagctacggggggcgcatccagccgcggccccacgacaaccagctcgcgtacgtcaacggcgagaccaagatcctctcgctcgagaggccgctccgcttcgccgacttcgccgcgcgcctcgccgcgctcgccgggaacctcggggacatctgcgtcaagtaccagctgcccggggaggacctcgacgcgcttgtctccgtcaccaacgacgaggatctggagcacctcgtcctcgagtacgaccgcctccacctgctccgccccgctccgggctccggtgccggctccaaccgcggatccacgctccggctgagggtcttcctcttccccgtccagtcgcccccgccaccgccgcagccagccggcctcctcgagcccaagccgcagcgccactggttcgtcgaggcgctcaacaacgtccctcagccgaagcaagagacgt

SEQ ID NO: 42615 - protein, 193 aa, Panicum virgatum
  misc_feature: Ceres CLONE 2012860
  misc_feature (56)..(157): Pfam Name: PB1 Pfam Description: PB1 domain
MAESGDSSPHSAAATDDTHHDGSESAAATAAGHAPPLPPAKVRLMVSYGGRIQPRPHDNQLAYVNGETKILSLERPLRFADFAARLAALAGNLGDICVKYQLPGEDLDALVSVTNDEDLEHLVLEYDRLHLLRPAPGSGAGSNRGSTLRLRVFLFPVQSPPPPPQPAGLLEPKPQRHWFVEALNNVPQPKQET

SEQ ID NO: 42616 - DNA, 1005 bp, Panicum virgatum
  misc_feature: Ceres CLONE 2012863
  misc_feature: Encodes the peptide sequence at SEQ ID NO. 42617
atgtccttctccctcacgccgagccgaggaggtgaagtcaggtcagagaccttcgactactagtcatggcccgcatctaggagggagcagaagggaccggatggggcgcgcgttcgtgtacgtgatcctgggcggcggcgtggccgcgggctacgccgcgctcgagttcgcccgccgcggcgggtactcccgcggtgagctctgcatcatctccgaagaggccgttgctccttatgaacgtcctgcattaagcaaaggatatttactcccagaaggtgctgttcgtcttccaggatttcatacttgtgttggcgcaaatgatgagttactgacaacaaaatggtacaaagaacaaggcattgaacttgttcttggaacaaaagtgatttctgctgatgtgaggcgcaagacattgcttacagccacaggagaaactatcagctataatactcttattattgcgacaggtgctcgggttctgaagttgcaagaatttggaatacaaggttcggatgcttcaaacatatgttatttacgcaatattgatgatgcggataagttggtcaatgcaatgaaatcatgccctggtggaaatgctgttgtcattggtggtggctacattggaatggaatgtgcagcggcattggtcactaacaagataagggtcaccatggtcttccctgagaaacactgcatgggtcgtctgtttacagaaaaaattgcagaatattatgaaaactactacacctcaagaggggtcacctttgttaaaggaactgtgcttacatctttcgaaagagacacgacagggaaggtgactgcggtaatcctcaaagatggtagacaccttcctgctgatatggtagtggttggtattggcatccgtgcgaacactagtctttttgaaggtcagctggtgatgtcaatggagaatggtgggataaaggtaaatggacagctgcagacaagtgacagctctgtatatgctgttggagatgttgctgc

SEQ ID NO: 42617 - protein, 301 aa, Panicum virgatum
  misc_feature: Ceres CLONE 2012863
  misc_feature (7)..(301): Pfam Name: Pyr_redox_2 Pfam Description: Pyridine nucleotide-disulphide oxidoreductase
  misc_feature (165)..(260): Pfam Name: Pyr_redox Pfam Description: Pyridine nucleotide-disulphide oxidoreductase
  misc_feature: SWISSPROT Homolog: EC 1.6.5.4 Monodehydroascorbate reductase (NADH)
MGRAFVYVILGGGVAAGYAALEFARRGGYSRGELCIISEEAVAPYERPALSKGYLLPEGAVRLPGFHTCVGANDELLTTKWYKEQGIELVLGTKVISADVRRKTLLTATGETISYNTLIIATGARVLKLQEFGIQGSDASNICYLRNIDDADKLVNAMKSCPGGNAVVIGGGYIGMECAAALVTNKIRVTMVFPEKHCMGRLFTEKIAEYYENYYTSRGVTFVKGTVLTSFERDTTGKVTAVILKDGRHLPADMVVVGIGIRANTSLFEGQLVMSMENGGIKVNGQLQTSDSSVYAVGDVA

SEQ ID NO: 42618 - DNA, 686 bp, Panicum virgatum
  misc_feature: Ceres CLONE 2012863-R
  misc_feature: Encodes the peptide sequence at SEQ ID NO. 42619
tactccagggtcttcacattgtcctggcagttctacggggataatgttggtgaggtggttcactttggagacttcgcaagcagcagcccgaggtttggtgcatattgggtcaataaaggcctaattgcaggtgcatttcttgaaggtggaagtcgggatgagtatgaggccatatcagtagctgtttggcggaaagcaaaggttgcaaacatggctgaacttgaaaaacaaggcctggcgtttgccattcaggagagccagaaggaagcgcctgacagcgggcttgccgtggttggaaaacctacttatgcatggcatgccaccgctgtggttgcagcagtgtcaatcgctgcaattggttattggtatggcaggaagcgccgcaggtggtgaactcaggaccaactcgttttaatttgtatgccatctgttgggatcttgtggtcagctgatgcaacaagatctgggatgtgctattgggttcagctactcaaagcaagtcctgtgtaacatgtatgaaagtatagccttgatttcagctttcaaatgtaaacagatagtatacaaagttgcaaacaccgccatgtactttttaatgagcaaaattctgctgctaaactctcaggagcactcttgttgtaaaatcacaattcttttcccaaatgagatgcacagttctgtgacct

SEQ ID NO: 42619 - protein, 130 aa, Panicum virgatum
  misc_feature: Ceres CLONE 2012863-R
  misc_feature: SWISSPROT Homolog: EC 1.6.5.4 Monodehydroascorbate reductase (NADH)
YSRVFTLSWQFYGDNVGEVVHFGDFASSSPRFGAYWVNKGLIAGAFLEGGSRDEYEAISVAVWRKAKVANMAELEKQGLAFAIQESQKEAPDSGLAVVGKPTYAWHATAVVAAVSIAAIGYWYGRKRRRW

SEQ ID NO: 42620 - DNA, 935 bp, Panicum virgatum
  misc_feature: Ceres CLONE 2012870
  misc_feature: Encodes the peptide sequence at SEQ ID NO. 42621
ctttcagtccatcaaacaaaaatggcagcagtcttcgcctcatcccgtgctctgaccgtgaccgtccaggctgccaagaagggcaccaaggccgctaaggtctccaggtccagcggtggtggcatcaccttctatggccccgaccgtgctaagtggctgggcccatactccgagaacgccaccccatcctacctgaccggcgagttccccggtgactacggctgggacactgctggtctgtccgctgacccagagaccttcaagcgctaccgcgagttggagctgatccatgcccgctgggccctgctgggtgccctcggcattgtcaccccagagctgctggctggcaacggtacctccttcggcgaggctgtctggttcaaggctggcgcccagatcttcgctgacggtggcctgaactacctgggcaaccccgccctgatccacgcccagaacattgtcgccacactggcctgccaggttgtgctcatgggtctggttgagggataccgtgtgaacggtggcccagccggcgagggcctggaccccctgtaccccggtgaggccttcgaccccctgggcctggctgacgacccagacacattcgctgagctgaaggtcaaggagctcaagaacggccgcctggctatgttctcatgcttcggcttcttcgtccaggccatcgtcaccggccagggcccaattgccaacctgaactcccacttggctaacccagcggagaacaacgccttcgcctacgccaccaagttcacccctctgtagattacctaccccactaccctcccaggttccagttttgtttttggtttgatggcgcgtgccatgtagggtagagctttgtgctttctgaacctgcaagccgttagctttttgcgtgggttgaggccttgttcctgtaacagagctggcggatc

SEQ ID NO: 42621 - protein, 253 aa, Panicum virgatum
  misc_feature: Ceres CLONE 2012870
  misc_feature (53)..(221): Pfam Name: Chloroa_b-bind Pfam Description: Chlorophyll A-B binding protein
MAAVFASSRALTVTVQAAKKGTKAAKVSRSSGGGITFYGPDRAKWLGPYSENATPSYLTGEFPGDYGWDTAGLSADPETFKRYRELELIHARWALLGALGIVTPELLAGNGTSFGEAVWFKAGAQIFADGGLNYLGNPALIHAQNIVATLACQVVLMGLVEGYRVNGGPAGEGLDPLYPGEAFDPLGLADDPDTFAELKVKELKNGRLAMFSCFGFFVQAIVTGQGPIANLNSHLANPAENNAFAYATKFTPL

SEQ ID NO: 42622 - DNA, 1670 bp, Panicum virgatum
  misc_feature: Ceres CLONE 2012873
  misc_feature: Encodes the peptide sequence at SEQ ID NO. 42623
agcgcccttgcatcggcttccacatccctccgccgcgctgcgctatctcacattccatctctggtcggtcgcgcgcgtctcccggaaccccgctttatagcttgcaggttgtcaccagcatttggacgcaccatccaccccaattggccgtgtccaccgcctgctgcaaaagctactaccataccttctaccttcaacacctatcccacaccacatcgaacccgcagacaactcgtttcgttgcctgcatcctattgaccagtcaagctcctattgcaacactcgtcacacaaccataatgtcggcaccgcaagacgcaatcccgcccaatgggtctgatcttcctgaggcccttgaccagctcaatctcaacgacaatgagccacgcctcggcccggacggagagccggccccaaagacagacgaagagtatgcccagacacagctgactctgcgcgcgattgtctcgtcaaaggaggctggcgtcatcattgggaagggcgggaagaacgtcgccgacttgcgcgacgaaaccggcgtgaaggctggcgttagcaaagtcgtccaaggtgtttacgaccgggtcttgaccatcaccggcggctgcgaagccatctcgagagcctacgccgttgttgcccgcgccctgctcgagggtgctcccacgattggcatgggcggagtcgtccagagcaatggcacacacccgattaaacttcttatctcccacaaccagatgggtactatcatcggtcggcaaggcctgaagatcaagcacatccaggatgtgtccggcgtgcgcatggtggcacaaaaagagatgctgccgcagtcaaccgagcggatagtcgaggttcagggcacccccgagggcatccagcgcgccatctgggagatctgcaagtgcctggtggacgattggcagcggggtgccggcaccgtcttgtacaaccctgtcgtccggactcaaggtgcgggcgccgcaccaggcgttaccggaaccaccaacttcgtacaggacagagccccgtacggcggctcccgtgtgacgcggacaggcaacggcgctgactttagcaacggcgggccccggccttataaccgccgttcggactctgacgccgccgctcgtggtccgccgactcacgacgagaatggcgaggagatccaaacgcaaaacatcagtatcccagccgacatggttgggtgcattattggccgtggcgggtccaagatcagcgagatccgcaagacgtcaggggcccgcatctccattgccaaggctcctcatgacgagacaggcgagcggatgttcaccatcatgggctcggctaaggccaacgagagggcattgtttctcctctacgagaatctcgaggcggagaagatgcgtcgacaacagcaggctgcccagacctccgagtagagtgcggacgagggcagacggaactataggctgtaagaaaaccggacatgttgtaactgatggagttgcgcgagtgggatccttagcagctgcccagccacgccctccagggtttttggcttgggtcggatttggcagcccctcgtcacgggtcattcaccagatctggctgccgcaaggcgttattattcaatggagggaacgatgcgacgacaattctcttaacctcaaaaagtattccgcc

SEQ ID NO: 42623 - protein, 375 aa, Panicum virgatum
  misc_feature: Ceres CLONE 2012873
  misc_feature (292)..(355): Pfam Name: KH_1 Pfam Description: KH domain
  misc_feature (137)..(200): Pfam Name: KH_1 Pfam Description: KH domain
  misc_feature (51)..(113): Pfam Name: KH_1 Pfam Description: KH domain
MSAPQDAIPPNGSDLPEALDQLNLNDNEPRLGPDGEPAPKTDEEYAQTQLTLRAIVSSKEAGVIIGKGGKNVADLRDETGVKAGVSKVVQGVYDRVLTITGGCEAISRAYAVVARALLEGAPTIGMGGVVQSNGTHPIKLLISHNQMGTIIGRQGLKIKHIQDVSGVRMVAQKEMLPQSTERIVEVQGTPEGIQRAIWEICKCLVDDWQRGAGTVLYNPVVRTQGAGAAPGVTGTTNFVQDRAPYGGSRVTRTGNGADFSNGGPRPYNRRSDSDAAARGPPTHDENGEEIQTQNISIPADMVGCIIGRGGSKISEIRKTSGARISIAKAPHDETGERMFTIMGSAKANERALFLLYENLEAEKMRRQQQAAQTSE

SEQ ID NO: 42624 - DNA, 729 bp, Panicum virgatum
  misc_feature: Ceres CLONE 2012876
  misc_feature: Encodes the peptide sequence at SEQ ID NO. 42625
agcctcgcctcgcacgcaggctcgcagcctctcgcccccgcgacccgacaccgccgacgccccacgcctctaccgccgccgaggcccaccgtctccgccgcctcccctccggcaaagcttaccccggttcgttcgccctgccttgatgcgcgcatcagcaacccccctgtgagaggagggctcgtatcgacatctcagagcagagaagaggcagatcctacatggatgtcatgcagacaagtgactcttcacatcatggaattgtagaaaatagcccatatagaattccgtatagcagaaatgcagaaggcggcaaacttggtaattcgtggtattttagtagaaaagaaatagaagaaaattccctttccaggaaagatggcattgatctgaagaaggagtctcatcttcgcaagacgtactgcgtttttctgcaggatttgggaatgaggcttcaagtacctcaagttacgattgctacagctatagtgttctgtcatcgttttttccttcgtcaatctcatgcaaaaaatgataggcggacaattgcaacagtttgtatgttcttggcgggaaaagttgaagaaacccccagacctcttagggatgtcatactcctttcttatgagatcattcacaaaaaggatcctgctgcggttcagcgaatcaagcagaaggaagtatatgaacaacagaagggacttattttacttggggagcgtgttgttc

SEQ ID NO: 42625 - protein, 169 aa, Panicum virgatum
  misc_feature: Ceres CLONE 2012876
  misc_feature (35)..(169): Pfam Name: Cyclin_N Pfam Description: Cyclin, N-terminal domain
MDVMQTSDSSHHGIVENSPYRIPYSRNAEGGKLGNSWYFSRKEIEENSLSRKDGIDLKKESHLRKTYCVFLQDLGMRLQVPQVTIATAIVFCHRFFLRQSHAKNDRRTIATVCMFLAGKVEETPRPLRDVILLSYEIIHKKDPAAVQRIKQKEVYEQQKGLILLGERVV

SEQ ID NO: 42626 - DNA, 531 bp, Panicum virgatum
  misc_feature: Ceres CLONE 2012881
  misc_feature: Encodes the peptide sequence at SEQ ID NO. 42627
gtcttctcctcctccttccccacggatttccgcgaaccccgaactcgtttgcctccggatccaccagcccgccttcccaaatcgcacctcccgaaaccctaaccggcggaaggttaatgcttgtggacatggctgggtctgaaaacattgaagctgcaggacaaactggttttgaagccaagatgcagacagcaaagattaatcaaggaaacactgctttaaagcgagtggtcgaatctattgctaacggcgattcccatgttccatttagagacagcaagctcacaatgctactgcaggattcatttgaggatgataaatcaaaaatcctgatgattctgtgtgctagtcctgatcccaaggaactgcacaagacagtttctacattggagtacggtgctaaggcaaagtgtattatccgtgctgctcatgccgcaacaccgagggacaaaataagctctgaggagtcatctacaatgcttaactctagaattgttgcgatgaaccagttcatctacaagcttcaaaagg

SEQ ID NO: 42627 - protein, 176 aa, Panicum virgatum
  misc_feature: Ceres CLONE 2012881
  misc_feature (1)..(139): Pfam Name: Kinesin Pfam Description: Kinesin motor domain
LLLLLPHGFPRTPNSFASGSTSPPSQIAPPETLTGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKISSEESSTMLNSRIVAMNQFIYKLQK

SEQ ID NO: 42628 - DNA, 1935 bp, Panicum virgatum
  misc_feature: Ceres CLONE 2012888
  misc_feature: Encodes the peptide sequence at SEQ ID NO. 42629
gcagccaccaccaaccccgcggcggccggcctcgcccgataagacgccggcccgcctcccgcctccggcctccccctccccttccgctcccacctgcccccgcggcgggcggcctcgcccgataagacgccggcccgcctcccgcctccggcctccccctccccttccgctcccacctgcccccgcgtgccacgaccagccacctcctgccgcagcgatgccacccccgtccctcttgctcctccactcccgcgccccgcttcagccccgcccattccggatgaactcccggggagctccgagcagggtagtcgtctgctccgccgcgtccgccgaggggttcatctccgcggctccgatccttctcccagagggtccctggaagcaggtagaaggtggcgttactgccgcgaaggggttcaaggcggcgggcatctacggtgggctgcgcgccaagggcgagaagcccgacttggcattggtcgcctgcgacgtcgacgccaccgtagcaggagcttttactacaaacgtagttgctgccgcacctgttttgtattgtaagaacgtcctcaatacatcgaaaacaggtcgtgctgtgttaattaatgctggacaagcaaatgctgcaactggtgatcttggctatcaggatgcagttgatagtgcaaatgctgttgccaagcttctcaatgtgagcacagatgacatactgattcagtctactggtgtcattggtcaaagaataaagaaggaggcacttctaaattcactgcctagacttgtgggttcactgtcttcttcagttcagggcgcgaattctgctgctgtggccattacaactacagaccttgttagcaagagcattgctgtccagactgagattggaggagtggctatcagaataggaggaatggctaaaggttctggaatgattcacccaaacatggcaactatgctcggtgttttaaccactgatgctcaagtcagcagtgatttctggagagaaatggtccgaacctcagttagtagaagtttcaaccaaattactgtggatggtgatacaagtaccaatgactgtgttattgctatggcaagtgggttatctggtttatctggaattctcagtcttgacagcactgaggcccaacagttccaagcatgcctagatgcagtaatgcaaggtcttgcgaaatccattgcatgggatggtgagggtgcaacgtgcttaattgaggttactgtaagtggtgcgaacaatgaggcagaagctgctaaaattgctcgttcagtagcatcttcttctctggttaaagccgctgtgtttggaagagatccgaattggggacgtattgcttgctcagttggctattcaggcattcagtttgatgcaaatcgacttgatatttctctgggagctattccactaatgaaaaatggtcaaccactaccctttgacagatctgcagctagcaagtatctcaaagatgctggagatgtccatggtacagtgaacattgatatatcagttggaagtggaggaggaaatggaaaggcatggggctgtgatctgagctacaaatacgttgaaataaatgctgaatatacaacgtgagatatattcactttgaagaaaaatgtcttcattggttggaacgatgaatctttcggtgcaaccaccatctggagaatgtatatcgtgttgcaacagccagccttttcttaccaagatgttgcacgtgtactgttctttcacgcgagatcaatttaaaccaatgccttgtaagtgtaataatgcgatgaataatggtggcacagtaactgtgatgacaccaccttgttcggttctgaatctttgatgacgatatgggaaagtataggtctgacaaacaaaaatctgaaatctggtatccatgcgcatcgatggttctacatgtc

SEQ ID NO: 42629 - protein, 464 aa, Panicum virgatum
  misc_feature: Ceres CLONE 2012888
  misc_feature (68)..(464): Pfam Name: ArgJ Pfam Description: ArgJ family
  misc_feature: SWISSPROT Homolog: EC 2.3.1.35 Glutamate N-acetyltransferase
MPPPSLLLLHSRAPLQPRPFRMNSRGAPSRVVVCSAASAEGFISAAPILLPEGPWKQVEGGVTAAKGFKAAGIYGGLRAKGEKPDLALVACDVDATVAGAFTTNVVAAAPVLYCKNVLNTSKTGRAVLINAGQANAATGDLGYQDAVDSANAVAKLLNVSTDDILIQSTGVIGQRIKKEALLNSLPRLVGSLSSSVQGANSAAVAITTTDLVSKSIAVQTEIGGVAIRIGGMAKGSGMIHPNMATMLGVLTTDAQVSSDFWREMVRTSVSRSFNQITVDGDTSTNDCVIAMASGLSGLSGILSLDSTEAQQFQACLDAVMQGLAKSIAWDGEGATCLIEVTVSGANNEAEAAKIARSVASSSLVKAAVFGRDPNWGRIACSVGYSGIQFDANRLDISLGAIPLMKNGQPLPFDRSAASKYLKDAGDVHGTVNIDISVGSGGGNGKAWGCDLSYKYVEINAEYTT

SEQ ID NO: 42630 - DNA, 1338 bp, Panicum virgatum
  misc_feature: Ceres CLONE 2012908
  misc_feature: Encodes the peptide sequence at SEQ ID NO. 42631
agcagcagcgggcactggcagcgctgcagcagcgcggagagagaaaaaagtcggcagggatttccttccccgccccctgttagctccgggagctttcggtgctcgcgtgcccgagcttcgcctccgatcgagcccgcccgccgaggcaggcgcccgatcgccgcgctccgggggtgcgccggacggatggagccgtacgcggctgcgaaggagggcggcgacgccagcaccggcttggaagagccgatgcggaggctggggctcggcggggacggggaggcgggggacgcgaagctgccggagcggccgggcgaggcggactgcacctactacctccgcacgggcgcctgcggctacggggagcgctgccgctacaaccacccccgcgaccgcgatcgggccgccccggttaatggagttggaaggaccgcaggtgcagtggagtaccctgagcgtccgggacagccattgtgtgagtactatgcgaagaatgggacctgtaaatttggttccaactgcaagtttgatcatcctagggaaggtggttttgcacctgtggcattaaacagcagtgggttccctctacgtcagggtgaaaaggaatgttcctattacatgaaaactggacattgcaagtttggaggtacatgtaaattccatcacccggaacttggtattctttcagagacacctaccatgtatccaccagtgcaaccatcaccagtttcctccccgcatccatatccacatcttgccaattggcaaatggggaggcttcctgttgtgccagggtcatttttaccaggctcgtatccaccaatgatgcttccacctacacttatgccaatgcagggatggaacccttatatttcacctatgaaccaagttgcaccagctgggggtcagcaaactattcaaccagggccaccttatggcttgtcacaccaggggcctacctctgcagtcacttatggtagtcattatgctcaattgtattcctccgctgggacttcaagcagcaacatacaagaatatgccttaccagagcggcctgggcagcctgaatgtgagcattacatgaagacaggagcctgtaaatatggagcagcctgcaaataccatcatcctcaatacttcagtgggccgaaatctaactgtgcgctgagccctctgggtcttccacttcggcctggttctcagccctgtacttactatgcacatcatggcttttgcaagtttgggccgacatgcaagtttgatcacccgatgggcactctaaactatagtccttcagtgtcatcacttactgatgtgcctgtcactccatatcctctcact

SEQ ID NO: 42631 - protein, 383 aa, Panicum virgatum
  misc_feature: Ceres CLONE 2012908
  misc_feature (91)..(117): Pfam Name: zf-CCCH Pfam Description: Zinc finger C-x8-C-x5-C-x3-H type (and similar)
  misc_feature (289)..(315): Pfam Name: zf-CCCH Pfam Description: Zinc finger C-x8-C-x5-C-x3-H type (and similar)
  misc_feature (41)..(67): Pfam Name: zf-CCCH Pfam Description: Zinc finger C-x8-C-x5-C-x3-H type (and similar)
  misc_feature (135)..(161): Pfam Name: zf-CCCH Pfam Description: Zinc finger C-x8-C-x5-C-x3-H type (and similar)
  misc_feature (335)..(361): Pfam Name: zf-CCCH Pfam Description: Zinc finger C-x8-C-x5-C-x3-H type (and similar)
MEPYAAAKEGGDASTGLEEPMRRLGLGGDGEAGDAKLPERPGEADCTYYLRTGACGYGERCRYNHPRDRDRAAPVNGVGRTAGAVEYPERPGQPLCEYYAKNGTCKFGSNCKFDHPREGGFAPVALNSSGFPLRQGEKECSYYMKTGHCKFGGTCKFHHPELGILSETPTMYPPVQPSPVSSPHPYPHLANWQMGRLPVVPGSFLPGSYPPMMLPPTLMPMQGWNPYISPMNQVAPAGGQQTIQPGPPYGLSHQGPTSAVTYGSHYAQLYSSAGTSSSNIQEYALPERPGQPECEHYMKTGACKYGAACKYHHPQYFSGPKSNCALSPLGLPLRPGSQPCTYYAHHGFCKFGPTCKFDHPMGTLNYSPSVSSLTDVPVTPYPL

SEQ ID NO: 42632 - DNA, 707 bp, Panicum virgatum
  misc_feature: Ceres CLONE 2012908-R
catacttgtcatcttctgatctgcggccacagtacactctgaccaaggagcactctgctaatccacctgcagtgcctggaactacttatggacctgttgggacaatatcaaaggtttatgccccccacacacttatccgacccctgaacgccacagctgctggcatgcaagcgtcctaaggagccagcatggagagctccagtgtcccctttctgtcatgaagatgatgcatctttcagcaagcttctctgcactttccgccacaggtgaaatgaggtctcggattctttttgctccaattcgactccccatcgattgtgaataaaggctgcagctgacataggaataaatgcaaagataggaattggcaagctcattcccttgccatttttctgtccgtctctgaaacgagagaagggagagacttctgattgtagttcagagctccgttattatctcgtacataattaacggagcaggccagtaactgttggaggggacttcttatctggaagctaatgggcagctctttcccaaatcttcttttgttttatctcatcatctatatatatatgtatatcccccggaacagtaactatgacttctgcaatatgtatatgcgaactgggaacacgggagacattataacgagacacttagaaccattaacagagtcatcggaaaccattcgctggtcatttatctcc

SEQ ID NO: 42633 - DNA, 1299 bp, Panicum virgatum
  misc_feature: Ceres CLONE 2012921
  misc_feature: Encodes the peptide sequence at SEQ ID NO. 42634
accaccaaactagtcttgtagccagtacttccattgctctcatctcatctcatctcatctcatctatcccttagcttcttgctcttcttctttcccctcttcttccagctgctgctctttccattagccagccagcagagatctcttccagcttgcttggcacttggtgatcgatccggcctcgatctttctcttgattgtgtttctgccagcgatcgattaccatcagaattgtaatccacatatatagatagagagagagagagagagagctagctgattgttggatctctactcgctcgctccggccgggatatattgttttagctagctatagctaggcggcctctaataattagattaaagcagctgctggtatatattagtagatcgacgactagctagctaggcagctgcctgcagcaggtggatcatcgatgcttgaggtgtcgatcctgcggagccctagcaaggcggatcatcatcagcgcgggttcgtgggcgaccatcatgtcgtgttcccgacgtccggcagcgtctgctgcgacgatttcatggtcgacgacaacctgctggactacatcgacttcagctgcgacgccgtgcccttcttcgacgccgacggggacattctccccgacctggaggtggacccaacggagctcctcgccgagttctcctccccggaggcgagcccgacggcggctcgcgcggaggccaagccgccggacgacctacgacgacgacaaccagaagaagaagcagtagtactgagcacgagtacaacgacggcgacgacagtagaagagaagaaagcagagcgggtgttgtcggccaaagacgagaaattagccgcggcaggtgtgagtgtgacgacgaggacgatgaggaagaaggtggatggtgaggggtcgagcgcggaggaggactctggcggcgccgggtcggacaccaagtggtcggcgtcggcggggggccacggcaagaagaagacggcggcggcggacaagaactcttccagcggcaaaaggaaggtgaaggtggactggacgccggagttgcaccggcggttcgtgcaggcggtggagcagcttggcatcgacaaggctgtgccgtcccggatcctcgacatcatggggatcgactgcctcacacgacacaacattgccagccacctccagaagtaccggtcgcacaggaagcacctgatggcgcgggaggcggaggccgcgacctgggcgcagaagcgccaccagtacatgtacgcgccggcgccggcgaggaagctggacgcggcgg

SEQ ID NO: 42634 - protein, 287 aa, Panicum virgatum
  misc_feature: Ceres CLONE 2012921
  misc_feature (201)..(251): Pfam Name: Myb_DNA-binding Pfam Description: Myb-like DNA-binding domain
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MLEVSILRSPSKADHHQRGFVGDHHVVFPTSGSVCCDDFMVDDNLLDYIDFSCDAVPFFDADGDILPDLEVDPTELLAEFSSPEASPTAARAEAKPPDDLRRRQPEEEAVVLSTSTTTATTVEEKKAERVLSAKDEKLAAAGVSVTTRTMRKKVDGEGSSAEEDSGGAGSDTKWSASAGGHGKKKTAAADKNSSSGKRKVKVDWTPELHRRFVQAVEQLGIDKAVPSRILDIMGIDCLTRHNIASHLQKYRSHRKHLMAREAEAATWAQKRHQYMYAPAPARKLDAA

SEQ ID NO: 42635 - DNA, 654 bp, Panicum virgatum
  misc_feature: Ceres CLONE 2012921-R
gcagcatcaggtataatgcggccaggaagtgggtccacatcatcaggcagcagcagtgacgcccgccatggtgccgcagctgccgaggttcccggtgccgccgcacccggccaccatgtacagacccacctgcagcagcagtatggtcgtcccgccgccgccgacgacgagcaccaagctcgccgacttgcagcttcagctcgacgcgcacccgtccaaggagagcatcgacgcggccattggagatgttttagtgaagccatggctgccgctgccgctggggctcaagccgccctccatggacagcgtcatgtcggagctgcacaagcaaggcataccaaaggtcccaccctccagcgcctgatccatccatgctgcatgcaatgcaatgcaactactcgtcgacatgtaatgtattatattatattatattgccaccagagcaagagtacactagtatgtagcaagctaggcagagggcgttctgtgcgtgcgtgcgtgcgtgtattaaattaattaaataatctaggtgtgcaaggacccaacttatatgtatgtgcatgtatgcaaactgattcatgatagaataaccatctgaatggattgcacttgtgttgatttattgtgaatgaaaaatactactggttggttgat

SEQ ID NO: 42636 - DNA, 574 bp, Panicum virgatum
  misc_feature: Ceres CLONE 2012928
  misc_feature: Encodes the peptide sequence at SEQ ID NO. 42637
agattgggcacgaggaagaccgctactcggtagctgtcgaggaccgcgtgaccaagacgcaaaaggtctacttcggctacgttctcgcttatgcattccagttcctggtgctcctctcaggtctgctcgctggagcgttcctggccgtgtaccaggtcactcacggccaggccacccctggtgacttcattatgcttctgacatattgggctcaactggtctctcctctcaccttttttgccggcctcggcaaaagcatctcgagggatctccttcatgcggagcagcttctggagatcatgcagaccaagccaagtgtgctcagcgaggagggagcaccgcccctgcgattcaaaggcggcgaagttcgctttggcggtgtctgcttttcctacgacaagaaaaaagagattctgaaggacatcaacttcaccgcaacgccgggcatgacggtggcttttgttggtgcaacgggggctggcaagtctaccatcctgaagctcctcgaccggttttacgacgttacaaagggctcaatcgaaattgacgaacaggatatccgaaaggttgatct

SEQ ID NO: 42637 - protein, 190 aa, Panicum virgatum
  misc_feature: Ceres CLONE 2012928
  misc_feature: SWISSPROT Homolog: EC 3.6.3.42 Beta-glucan-transporting ATPase
IGHEEDRYSVAVEDRVTKTQKVYFGYVLAYAFQFLVLLSGLLAGAFLAVYQVTHGQATPGDFIMLLTYWAQLVSPLTFFAGLGKSISRDLLHAEQLLEIMQTKPSVLSEEGAPPLRFKGGEVRFGGVCFSYDKKKEILKDINFTATPGMTVAFVGATGAGKSTILKLLDRFYDVTKGSIEIDEQDIRKVD

SEQ ID NO: 42638 - DNA, 706 bp, Panicum virgatum
  misc_feature: Ceres CLONE 2012940
  misc_feature: Encodes the peptide sequence at SEQ ID NO. 42639
aagaaagcgcagacggcgtctactgcccctccgcttcgcctccagcgttccaactccggcgactccaccacccccgcacccaagcgaccaacccactccgaccatcgcgatgtcgaggcgcggcgactgggtctacgagaacaacggcgggacctgcgtggccatcgccggcgccgactactgcgtcatcgcagctgatacccgcctttccgtcggatacagcatcctcacgcgcgaccactccaagatctgcgagctggctgacaaatgtgtactagcatcttctggttttcaaggtgatattaaggctctgcacaagaacctagctgccagggaactgctctaccaacatcagcacaacaaaaggatgagctgccctgccatggcacagctcctctccaacaccctgtactacaagcgatttttcccatactatgctttcaatgtgcttggtggtcttgacagtgaagggaaaggatgcgttttcacatatgacgcagttggttcgtatgagagaactggttacagtacccagggaacagggtctactttgatcatgccagtcttggacaaccaactaaaatcacccagtcctctgttgctccctgcaagagatgctgtcacacctttgtcggagtctgaggccatcgatctagttaaggatgtgtttgcatctgcaactgagagggacatttacactggcgac

SEQ ID NO: 42639 - protein, 198 aa, Panicum virgatum
  misc_feature: Ceres CLONE 2012940
  misc_feature (10)..(198): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVIAADTRLSVGYSILTRDHSKICELADKCVLASSGFQGDIKALHKNLAARELLYQHQHNKRMSCPAMAQLLSNTLYYKRFFPYYAFNVLGGLDSEGKGCVFTYDAVGSYERTGYSTQGTGSTLIMPVLDNQLKSPSPLLLPARDAVTPLSESEAIDLVKDVFASATERDIYTG

SEQ ID NO: 42640 - DNA, 1649 bp, Panicum virgatum
  misc_feature: Ceres CLONE 2012949
  misc_feature: Encodes the peptide sequence at SEQ ID NO. 42641
acgaagccattggatgcgcacggatcgtgtagtagatcttttgtagttgtaaaaatcgcatcctcctttctgaaggattctgcgtcttcgtgcgacatcgtttcgaaagtctttgcaaattgggcaggcaatatgctatgcgacttacagatcttgtctccagagatgtcaatgcctctcagaagcctcaaccggtggatagaactgtgctcgatcggtcgaaacttgacgagtctgctgccagaagtgctcctccggaccatcagcaagaccatgctgcatctacatctactttacgcgccggtttaatttccttctcgcttgaccaaagcatcaatccaaggggcatcgctctttctgccggcccttcgacacatccgccgggctctgagagagcaactgttatgtctcagggtgtcaaagaagaagagcacgacctctctatgcctgccaatcctttgccatctggccagcattcccaacacaagctgacggaactgcctccgatctacgccgtccagttccagccgccggacgagcactcggagccaaatatatacgcaacgccggcggccagctacccaacaccggcggccccgaatcagttccagtatggtcattaccacatggatgctacgcaggacagggttggatcctggccctaccagccggtttacgaaacgtctgccgcattaacggccacggcggaaccttcgttcacgcctgcttggaacccgagccacaacaatatgcactggccaagtcctcagcggccagccagcgccgatccgctcgcttactcgtctcaacctctcgaccgcagccaatccagctcatcgcattccaatcacaaggctacagacaacaatcatctactgcctaaatccaaaccacgcaaggcatcatctgtcgatgacgaccgtggcggaggtcctagctcgtctgattccagccgcgccggtagcggcaaatacatctgtgaatattgtaataagcgtttctcaagaccaagcagtcttaagattcatgtacactcgcacacaggagagagaccttatgaatgtgctatttgtggtagaagtttcagtgtgcaaagtaatctcaagcgccacatgaaggttcacgacccgaacaaagctggttccggccgtcagtcaaattcagggcagcagccattgatgcacgaacatttcgtagcgccggtcgaccaaaaccatgaagtgctacatcatcgccgcctgccgccgaaccagcttccaaacccatatcaaatgaccaacccaatcccttcgggctcgatgacttatcaacagctcgcgccgtcgccgccgccgccacctccggtccggcattattactctaatccaaactccttcatgccccagaatcgaccattggctgaagatgaaccgcttcgtctgccgccgatgcagcagggacagctacatatacttccagaactccgaatgcccgattttgggcattacccagaagctgcgatgtctcattttcagcaagtgcatagacaggacgacaatgatcccacgtgaagaattagcatgtatctcggtttacattcaattgcatggatggatcaagtcaaggtcaaaagcaaagtgtaacaaaacatgcatattacagtgacatcg

SEQ ID NO: 42641 - protein, 470 aa, Panicum virgatum
  misc_feature: Ceres CLONE 2012949
  misc_feature (307)..(329): Pfam Name: zf-C2H2 Pfam Description: Zinc finger, C2H2 type
  misc_feature (279)..(301): Pfam Name: zf-C2H2 Pfam Description: Zinc finger, C2H2 type
MRLTDLVSRDVNASQKPQPVDRTVLDRSKLDESAARSAPPDHQQDHAASTSTLRAGLISFSLDQSINPRGIALSAGPSTHPPGSERATVMSQGVKEEEHDLSMPANPLPSGQHSQHKLTELPPIYAVQFQPPDEHSEPNIYATPAASYPTPAAPNQFQYGHYHMDATQDRVGSWPYQPVYETSAALTATAEPSFTPAWNPSHNNMHWPSPQRPASADPLAYSSQPLDRSQSSSSHSNHKATDNNHLLPKSKPRKASSVDDDRGGGPSSSDSSRAGSGKYICEYCNKRFSRPSSLKIHVHSHTGERPYECAICGRSFSVQSNLKRHMKVHDPNKAGSGRQSNSGQQPLMHEHFVAPVDQNHEVLHHRRLPPNQLPNPYQMTNPIPSGSMTYQQLAPSPPPPPPVRHYYSNPNSFMPQNRPLAEDEPLRLPPMQQGQLHILPELRMPDFGHYPEAAMSHFQQVHRQDDNDPT

SEQ ID NO: 42642 - DNA, 663 bp, Panicum virgatum
  misc_feature: Ceres CLONE 2012954
  misc_feature: Encodes the peptide sequence at SEQ ID NO. 42643
attcctctcctcctcccacttcccctcctcgccgctgaagagggaggttcccggctcccgggtgcgtgcgcgcgggatggaggcggcgacgatggcgtggacggcggcggtcgtcggggtcgggctggtgtactggttcgtctgggtgatgggcgcggcggaggtgaagggcaagcgcgcggtggatctcaagatgggatccatcacgcgggacaaggtgcaggacaagtacacgcagtactggtccttcttccgccgccccaaggagacggccaccaccgccgccgcggcggagaaggtgcccgacttcgtcgacaccttctacaacctcgtcaccgacatctacgagtggggctggggccagtccttccacttctcgccctccctcccgggccgctcccaccgaggaggcgaaatagggtaagactaggacactcgaccaccgcaagggggagaagaaataatctggcaggagcagcagaggtggtaattaaggagagccggctactcggagagcttcaggaatcagataatttgatctcttagagaggatactgctaggaaggaaccatgcttgttgttactcttttctttcgtagatttcagtttgtttttttttgtggaggattatccggttggagagagagagggagggagaggagg

SEQ ID NO: 42643 - protein, 115 aa, Panicum virgatum
  misc_feature: Ceres CLONE 2012954
  misc_feature: SWISSPROT Homolog: EC 2.1.1.143 24-methylenesterol C-methyltransferase
MEAATMAWTAAVVGVGLVYWFVWVMGAAEVKGKRAVDLKMGSITRDKVQDKYTQYWSFFRRPKETATTAAAAEKVPDFVDTFYNLVTDIYEWGWGQSFHFSPSLPGRSHRGGEIG

SEQ ID NO: 42644 - DNA, 774 bp, Panicum virgatum
  misc_feature: Ceres CLONE 2012978
  misc_feature: Encodes the peptide sequence at SEQ ID NO. 42645
gcactgcaatttggcgtttgtaggcaccgagctgtcctaatgaagtatttgtgtgaccgggcggatcctccgattccttgcgagcttgtgaggggccatcttgactacaccccccatgcttggaacgttgttcctgttaggaaagggaatggctgggtaaggatgattgttgatgcttgttaccccaccaacataaaggaagagacggatccagagtacttctgcaggtatgtaccgctcagtcgacttcagattgcacttgatgatgagggctatactcctcggtgttctttcccatctgtctcatcatgcaaagaaattgaagttacagcttcttgtactgtctatcactgtaaaattggtgctgttgatgctgcagcaaagataagatatcttgatactcgcagtgcctcaaatgatgaagttaaactttttgaatacaagcttctgggggaagtaagaatgctgggtgcattaaggaagcacaggtccatagtggacatatatggacatcaactttcatctaaatgggttcaagtcgatggtgataaagaataccggatattgcaatcaatagtattaatggagtatgtcaatggaggttctctcaagggctatttgacaaagctactgaaggagggcaagaagtatgtacccattgatctggcattttacattgctcgggaagtttcttgtgcattattggagatgcacaaaaagcttattattcaccgggacataaaaagtgagaatatttttggttgacctggaatc

SEQ ID NO: 42645 - protein, 254 aa, Panicum virgatum
  misc_feature: Ceres CLONE 2012978
  misc_feature: SWISSPROT Homolog: EC 2.7.11.1 Non-specific serine/threonine protein kinase
ALQFGVCRHRAVLMKYLCDRADPPIPCELVRGHLDYTPHAWNVVPVRKGNGWVRMIVDACYPTNIKEETDPEYFCRYVPLSRLQIALDDEGYTPRCSFPSVSSCKEIEVTASCTVYHCKIGAVDAAAKIRYLDTRSASNDEVKLFEYKLLGEVRMLGALRKHRSIVDIYGHQLSSKWVQVDGDKEYRILQSIVLMEYVNGGSLKGYLTKLLKEGKKYVPIDLAFYIAREVSCALLEMHKKLIIHRDIKSENIFG

SEQ ID NO: 42646 - DNA, 679 bp, Panicum virgatum
  misc_feature: Ceres CLONE 2012983
  misc_feature: Encodes the peptide sequence at SEQ ID NO. 42647
tcttccccccccccctcctcccgctccccctccactcccccgacgccggctagggttttgcctcctccccctccgccgccaccgctggcgctggagcgagcgagaccgagggggtagggagcgagcggagcgtaggcagccatgtcgctgcgcccgagcgagcgggtcgaggtgcggcggaaccgctacaaggtggcggtggacgcggaggaggggcggcggcggcgcgaggacaacatggtggagctccgcaagaaccgccgcgaggagagcctcctcaagaagcgccgcgaggggctccaggcccaggtccccgcccccgcctccggggtcgagaagaagcttgaaagcctcccagctatggttagtggggtttattcggacgacaacaaccttcagcttgaggccacaactcaattccgcaagttgctctccatagagaggagccccccgattgaggaagttattcagtcaggtgttgttcctagatttgtgcagttcctcaccagagaggatttccctcaactgcagtttgaagcagcatgggcacttacaaatattgcttctggcacttcggaaaatacgaaggttgtcattgatcatggggctgttccgatatttgtgaaacttcttcagtctgctagtgatgatgttcgtgagcaggctgtgtgggctttgg

SEQ ID NO: 42647 - protein, 179 aa, Panicum virgatum
  misc_feature: Ceres CLONE 2012983
  misc_feature (4)..(92): Pfam Name: IBB Pfam Description: Importin beta binding domain
  misc_feature (101)..(142): Pfam Name: Arm Pfam Description: Armadillo/beta-catenin-like repeat
  misc_feature (144)..(178): Pfam Name: Arm Pfam Description: Armadillo/beta-catenin-like repeat
MSLRPSERVEVRRNRYKVAVDAEEGRRRREDNMVELRKNRREESLLKKRREGLQAQVPAPASGVEKKLESLPAMVSGVYSDDNNLQLEATTQFRKLLSIERSPPIEEVIQSGVVPRFVQFLTREDFPQLQFEAAWALTNIASGTSENTKVVIDHGAVPIFVKLLQSASDDVREQAVWAL

SEQ ID NO: 42648 - DNA, 692 bp, Panicum virgatum
  misc_feature: Ceres CLONE 2012984
  misc_feature: Encodes the peptide sequence at SEQ ID NO. 42649
aaaacagcatcgacacccacccgccctcactcgccgctgcgccctgctgcttctcttcgtcctcgcccgtccggatctgaactggcctttcaataacaaggaaacaccttagggaatgcagaaagatgtgcttgcatgttaaagagctacctagtgagggacttggcagggtagccgcccatatttcttctttgccgcctcttgatgacattggggctcatcaacacgcacagctcctgctccttgtgcttctgcacaatggggttcaacgtggcagctcaaccatcttcttagagaaccaccttgggggagacggttgaagtcttcaataaacacttgcaggcttcttgttagtccgtttcaagtcttggatcagtgcggccttttgtgtacatatagtatacattcagcttgatggcggagcataaaggaaatgttttgatgcagaaatatgagatgggaaagatgcttggacaagggacctttgcaaaggtctaccatgcccgtaacatgaacactttagaaagtgtggcgataaaggtgattgacaaggagaaggttatgaaggttggcctcatcgatcagatcaagcgggaaatctctgtcatgaagctagtgaggcatcccaacattgtccaactatatgaggttatggctactaaaaccaagatatactttgtgttggagcatgt

SEQ ID NO: 42649 - protein, 92 aa, Panicum virgatum
  misc_feature: Ceres CLONE 2012984
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MAEHKGNVLMQKYEMGKMLGQGTFAKVYHARNMNTLESVAIKVIDKEKVMKVGLIDQIKREISVMKLVRHPNIVQLYEVMATKTKIYFVLEH

SEQ ID NO: 42650 - DNA, 1752 bp, Panicum virgatum
  misc_feature: Ceres CLONE 2012989
  misc_feature: Encodes the peptide sequence at SEQ ID NO. 42651
aactaacgctaaaaaagtaacagtttctgtactttattggtgtcgagctttttgtaaccatcgccatggactactcggacaagcagcgcctcagcttcgtgctgctcgtgaacatcatcggcggcctgctcgtgggctacatcatcggctacgtgcccgtgacgctgacgttccaggccgacctgtcgaactgcaccaagtacaccacctcggacgcgtgcaactcgcagcccaagctgtgcggctggcagggcggctacgtggatgcgcgcaacatcacgcgccagccccgctgcggcttcgttcacgagcctttccgtgggtgcgagattatcccgacgaaggacatctgcacggccagctcggactgcttctggcagtcgcaggacaacctgtgcgcacacaaccctgagtggagccaggtgctcacgggcgccttctcgggcatgatgatcatcggcggcatgatcggctccttccccgccggcatgctgctcgcgaagctcggccgcaagcgcatgatcagcctcaccggcgccatcggcgcggtcgcgaccgtgttctgcatcatcggctggtcgatcaacgacacggcgcacctgagcaactacggtatgatgatggtcggccgcctgctcgcgggcatcgccgtcggcctcgcgtgctgcgtgtgccccatgtactgcggcgagatggcgccgtcgcgctgggccagcgccgccgggtgctcgttccaggtgtcgctcacgttcggcatcttcttcgtcgcgctgctcgggtacatcatcgacgcaacgggcagctactcgcagaacatccaccagcagaaccgcttccagatcatcaacgcgctgcagctgctcttcggcgtgctgctgattccggtcggcttctacgtcgcggagccgtcggcggaggccacgggcaccgtcaaccaggacgaatccgctgggctcctcaagaatgaggacgtgccgctcagctcgctgaagacaaacttcatggctgccgtcgcgctggcggctgcgcagcagctcaccggcatcaacgccgtgatgaactacgccccgcagatcacgacgaacttcggtctgcccagcctgcgcggcaacgtggtggtgatggcgtggaacttcgtcacgaccatcgcgtccatcaagatcgcgacgctcttctcgacgggtatgatgtacgtcgggtcggcgacgatcgcgtcgctcgcgtgcctactgaccgccatccccatcttcccgtccgtcttcccgtcgggcgacaaggtcggctacggcctcacgggcgccggcgtgttcatcttcgttgccgccttcgagatgggcatgggccccgcgttctacgtgctcgcgcagtccatcttccccgcctcgcgccgcagcttcggctgctcgttcaccgtcgtcgtgcaattcatcttcaatttgatcatcaacttctgcttccccgtcgccgtgcagggcatctccggcggccccgacgaggaccagcgcaagggtatggccgttgtcttcgtgttcttcggcgtcgtcggtattgtgtgtactttcgcgctcttctggaacctgcggagccagacgaaggaggacgaggaggcgcaggacggcacctacgccaacgcggagtgagccgtgccggatccggagattccatgtaaacatgccatgtttccgacccgccctaatcagcacctgtcgatttccatcgcgtgctcagtacgtcgcactggctaatacccgg

SEQ ID NO: 42651 - protein, 524 aa, Panicum virgatum
  misc_feature: Ceres CLONE 2012989
  misc_feature (12)..(510): Pfam Name: Sugar_tr Pfam Description: Sugar (and other) transporter
MDYSDKQRLSFVLLVNIIGGLLVGYIIGYVPVTLTFQADLSNCTKYTTSDACNSQPKLCGWQGGYVDARNITRQPRCGFVHEPFRGCEIIPTKDICTASSDCFWQSQDNLCAHNPEWSQVLTGAFSGMMIIGGMIGSFPAGMLLAKLGRKRMISLTGAIGAVATVFCIIGWSINDTAHLSNYGMMMVGRLLAGIAVGLACCVCPMYCGEMAPSRWASAAGCSFQVSLTFGIFFVALLGYIIDATGSYSQNIHQQNRFQIINALQLLFGVLLIPVGFYVAEPSAEATGTVNQDESAGLLKNEDVPLSSLKTNFMAAVALAAAQQLTGINAVMNYAPQITTNFGLPSLRGNVVVMAWNFVTTIASIKIATLFSTGMMYVGSATIASLACLLTAIPIFPSVFPSGDKVGYGLTGAGVFIFVAAFEMGMGPAFYVLAQSIFPASRRSFGCSFTVVVQFIFNLIINFCFPVAVQGISGGPDEDQRKGMAVVFVFFGVVGIVCTFALFWNLRSQTKEDEEAQDGTYANAE

SEQ ID NO: 42652 - DNA, 736 bp, Panicum virgatum
  misc_feature: Ceres CLONE 2012997
  misc_feature: Encodes the peptide sequence at SEQ ID NO. 42653
taaggctttaaagcaacagaatgaagatgttaagagggagttcaatatgagacttacagatattgtgacacaattcaagatgcaaggagtgaatactgctttgtactacaagaacaaggagatggaagatacctttaacatagtgcctacaagtgctgtaagtggtgaaggcattcctgatttgctccttctgttggttcaatgggcacaaaagacgatggaagaaaagcttacttttgttaatgaagtccagtgtactgtactggaagtcaaggtcgtggaaggtcatggtactactgttgatgttgttttggtcaatggtatactgcatgaaggagatcaaatagttgtttgtggcatgcagggacccattgtgacaactgtcagagctttgttaacaccacacccaatgagagagcttcgggttaagggcaactacctacatcataaggagatcagagctgcacaaggagttaaaatatctgctcagggtctcgaacatgcaattgcagggacagctctttacgtgttaggacctgatgatgatctagacaaactgaaggatgctgttatggaagagatgacacgggttaggagtcggattgataaaagtggtgagggtgtctatgtacaggcatctacccttgggtctttggaagctctcacttgagttcttgaaaaaccctggctgtcaatattcccttctgtgattccagtttagggccagcccacaaga

SEQ ID NO: 42653 - protein, 222 aa, Panicum virgatum
  misc_feature: Ceres CLONE 2012997
  misc_feature (97)..(175): Pfam Name: GTP_EFTU_D2 Pfam Description: Elongation factor Tu domain 2
KALKQQNEDVKREFNMRLTDIVTQFKMQGVNTALYYKNKEMEDTFNIVPTSAVSGEGIPDLLLLLVQWAQKTMEEKLTFVNEVQCTVLEVKVVEGHGTTVDVVLVNGILHEGDQIVVCGMQGPIVTTVRALLTPHPMRELRVKGNYLHHKEIRAAQGVKISAQGLEHAIAGTALYVLGPDDDLDKLKDAVMEEMTRVRSRIDKSGEGVYVQASTLGSLEALT

SEQ ID NO: 42654 - DNA, 702 bp, Panicum virgatum
  misc_feature: Ceres CLONE 2013000
  misc_feature: Encodes the peptide sequence at SEQ ID NO. 42655
atagctacaactaccttagctttgtcacacgaaaccccacggagaagaacagatgcagggggcggcggcgaccaagcagtcacggaaggccgaccgcggcgcggcggggacggaggggagcaagggcgacggcgccaaggtcgcggcggcggacatggtgaggagcgacggcggcgacagggccggggacacgaagggcgacgcggccggcggcggagacaagggcgcgttccacggcatgtcggccgtggaggcgaaggactcgcagaccatcgtggcgctgcagtcgccggtgaccgtgatgcgccccgtccgcggcgacctggaggagcacgtccccaagccatatctggcgcgagccctggcggcgccggacatctaccacccggacggcacgacggacgggcacgggcaccaccacatgagcgtgctgcagcagcacgtcgccttcttcgaccgcaacgacgacggcatcatctacccctgggagacctaccagggatgccgcgcgctcgggttcaacctgctcatgtctctcctcatcgcgctcgtcgtcaacgggaccatgagctacgcgaccctgcccggctggctgccgtctcctctgttcccgatctacgtccacaacatccacaagaacaagcacggcagcgactccgggacctacgacaacgagggcaggttcatgccggtgaactttga

SEQ ID NO: 42655 - protein, 216 aa, Panicum virgatum
  misc_feature: Ceres CLONE 2013000
  misc_feature (119)..(216): Pfam Name: Caleosin Pfam Description: Caleosin related protein
MQGAAATKQSRKADRGAAGTEGSKGDGAKVAAADMVRSDGGDRAGDTKGDAAGGGDKGAFHGMSAVEAKDSQTIVALQSPVTVMRPVRGDLEEHVPKPYLARALAAPDIYHPDGTTDGHGHHHMSVLQQHVAFFDRNDDGIIYPWETYQGCRALGFNLLMSLLIALVVNGTMSYATLPGWLPSPLFPIYVHNIHKNKHGSDSGTYDNEGRFMPVNF

SEQ ID NO: 42656 - DNA, 680 bp, Panicum virgatum
  misc_feature: Ceres CLONE 2013011
  misc_feature: Encodes the peptide sequence at SEQ ID NO. 42657
agagtattgttactgctagtactcctactagtagtagcagtacagctcccttgtaaacgcatcccctcctccctcccctgccgccgcagacgctcgctgcagcatctcctcccctcgctgctgcagcagcggcagccggcggccggctgcggcggctgttcatcacctcccgtgttttacgccgatatcccaacgaattctgaggaaaaaagcaaaaaattttcgacttctgttcgcctgccaccggtggcgttctccggcggcgcttcggatcgccgctgcttcgcctccctctccctcttcctctcccgcggcggcgaagaggggagggagacggactcatgaagggcctagtagttgtcttggcattgctgctggccgccgcgctcggctcggcccgcggcgaactagaactgcggcggctgcgggaccaggcgccgccggggtcgcggccgcacagcgtcaccatcaccgagttcggcgcagtcggggacggcaagaccctcaacacggtgcccttccagaacgccgtcttctatgtccgctccttcgccgacaagggcggcgctcagctgtacgtgcccaagggccgctggctcaccggcagcttcaacctcaccagccacctcaccctctacctggagaaagacgccgtcatcgtcggctcaaaggaatcatca

SEQ ID NO: 42657 - protein, 112 aa, Panicum virgatum
  misc_feature: Ceres CLONE 2013011
  misc_feature: SWISSPROT Homolog: EC 3.2.1.82 Exo-poly-alpha-galacturonosidase
  misc_feature: Functional homolog of the protein sequence given in SEQ ID NO 51645
  misc_feature: Useful for making plants with altered cell wall content and/or composition
  misc_feature: Functional homolog of the protein sequence given in SEQ ID NO 50944
  misc_feature: Useful for making plants with altered carbohydrate content
MKGLVVVLALLLAAALGSARGELELRRLRDQAPPGSRPHSVTITEFGAVGDGKTLNTVPFQNAVFYVRSFADKGGAQLYVPKGRWLTGSFNLTSHLTLYLEKDAVIVGSKES

SEQ ID NO: 42658 - DNA, 1022 bp, Panicum virgatum
  misc_feature: Ceres CLONE 2013020
  misc_feature: Encodes the peptide sequence at SEQ ID NO. 42659
gtcagtgtgttgccgtgcgtcgagcagcctatcgtaaaagctctctcctttctcgcggcctctcccttgtctccactctccccgacggaggccggagccacgggcacaatgccgacgcgcctccactacctcctgctccccctcctcctcgccgccgccgctgccgtggcggcggacgcggacgcggacgcgctgctcgcggcgaaggcggcgctcgcggacccggccggcgcgctggcgtcctggacggcgagcgccaccccgtgcgcgtggtccggcgtgacgtgcaacgcgcgcgcggcggacatcgggctcgacctcgccggccgcaacctctcgggccccgtcccggcggcgctctcccgcctggcgcacctcgcgaggctcgacctcgccgcgaacgcgctctcgggccccatcccggcggcgctggcaaggctccagtccctcacccacctcaacctctccaacaacgtgctcaacggcaccttcccgccgccgctagcgtgcctgcgcgcgctccgggtgctcgacctctacaacaacaacctcaccggcccgctcccgctcgaggtcgcagcgctgccgctgctgcgccacctccacctcggcggcaacttcttctccggcgagatcccgcccgagtacggcctctggggcaggctgcagtacctcgccgtctccgggaacgagctgtccgggaagatcccgccggagctcggcaacctcaccagcctcaaggagctctacattggctacttcaacagctactccggggggataccgccggagctcggcaacatgacggagctcgtccgcctcgacgcggccaactgcgggctctccgggaagattccgccggagctcgggaacctcgcgaacctcgacacgctgttctttcaggtgaacgggctcgccggcggcatcccgccggagctggggcggctcaagagcctcagctcgctcgacctgtccaacaacgcgctcaccggcgagattccggcgaccttcgcggcgctcaa

SEQ ID NO: 42659 - protein, 304 aa, Panicum virgatum
  misc_feature: Ceres CLONE 2013020
  misc_feature (22)..(61): Pfam Name: LRRNT_2 Pfam Description: Leucine rich repeat N-terminal domain
  misc_feature: SWISSPROT Homolog: EC 2.7.11.1 Non-specific serine/threonine protein kinase
MPTRLHYLLLPLLLAAAAAVAADADADALLAAKAALADPAGALASWTASATPCAWSGVTCNARAADIGLDLAGRNLSGPVPAALSRLAHLARLDLAANALSGPIPAALARLQSLTHLNLSNNVLNGTFPPPLACLRALRVLDLYNNNLTGPLPLEVAALPLLRHLHLGGNFFSGEIPPEYGLWGRLQYLAVSGNELSGKIPPELGNLTSLKELYIGYFNSYSGGIPPELGNMTELVRLDAANCGLSGKIPPELGNLANLDTLFFQVNGLAGGIPPELGRLKSLSSLDLSNNALTGEIPATFAAL

SEQ ID NO: 42660 - DNA, 605 bp, Panicum virgatum
  misc_feature: Ceres CLONE 2013025
  misc_feature: Encodes the peptide sequence at SEQ ID NO. 42661
ggccagcgccgaccagacagagtcctcgtcacagacgcgctgcctccaccgccccccgcccccgccaccccacctccgtcgcgccgcgccgatccggcccggcgctcggccctcgcgccgggggacgcgcaatggccctcgacaccgccggcgcgccgccgccggggtccgacgccgcgcgcccgccgctcccctccgacgcggctccgcccggggagccggcggacgagctggacgccaggtacgcgccgtacgcgcgccgggacgcgtacggggtcttgggccgcggcccgctggcgccggcggaggcggcgcggctcgcgctcgcggccgccgtgctcctcccgctccgcctcgtcgcggggacgctcgtgctcctgctctactacctcgtctgccgcgctctcgcgggcaatgctcttcgtcttcggcttctactggatccgcgagaccgacaagaggctccccagtgccgagggtgtaaatcaaggccgttctgaagaattgggaagaccaggggcaattgtttctaatcatgtgtcttatgtggatattctttatcacatgtcagcttcttttccaagttttgttgctaaggagtcagt

SEQ ID NO: 42661 - protein, 63 aa, Panicum virgatum
  misc_feature: Ceres CLONE 2013025
  misc_feature: SWISSPROT Homolog: EC 2.3.1.51 1-acylglycerol-3-phosphate O-acyltransferase
MLFVFGFYWIRETDKRLPSAEGVNQGRSEELGRPGAIVSNHVSYVDILYHMSASFPSFVAKES

SEQ ID NO: 42662 - DNA, 442 bp, Panicum virgatum
  misc_feature: Ceres CLONE 2013033
  misc_feature: Encodes the peptide sequence at SEQ ID NO. 42663
gcgcaccccgtcccctcttcgcccttcgagagcgcgcgcactggcgaacctcctgatgttcgagatgaacgtgatccatcagatccagctggcctcgccggatggcctgacggtgttctcgttctagaacttcccgcccaagactgatgacggcgtcgacaacctctttgagcggatggaccgcttggtggcgcacagaccgtacttctgcgacctctcctgcggcgcccggggttcccccccccacctcaccctcgaaatccccaaccgcatgcaaaacgtgctgtgtgtggaacctctgatgcctctgacatgtacccgtatgccagttgagaagattcgaacgtgctttgcaaaccctcccatcccatgggattcgaaatgtttacggcacttagaggggatccccctcacggcgcaagacaaattattgcaacttgaa

SEQ ID NO: 42663 - protein, 88 aa, Panicum virgatum
  misc_feature: Ceres CLONE 2013033
  misc_feature: SWISSPROT Homolog: EC 1.5.1.20 Methylenetetrahydrofolate reductase (NAD(P)H)
MDRLVAHRPYFCDLSCGARGSPPHLTLEIPNRMQNVLCVEPLMPLTCTRMPVEKIRTCFANPPIPWDSKCLRHLEGIPLTAQDKLLQL

SEQ ID NO: 42664 - DNA, 1238 bp, Panicum virgatum
  misc_feature: Ceres CLONE 2013038
  misc_feature: Encodes the peptide sequence at SEQ ID NO. 42665
ggaaaatcgatggcgtaggcccagggcgatcctagttttgcatctctctgtctgtatcagagcctccgctccgctccgctcctctcctctccgcctccgcctccgcctccgcctccgcctccacccccccccccccccgccccccacctccaccccgcccccgccgccgcaggaaggaaggatggaggcccctggctccccctacgcctcctcgccggaatccgccccgaagcgcgccccacgctcccctccgcagcagcagcagcatcagcagcagccctccgaggaaggagatgacaaggagaagccaacacatttgaggttcctggtgtctaatactgcagcaggatgtattattggcaagggtggatcaaccatcaatgactttcagtcccagtctggggcccgaattcagttatcacgtagccatgagttcttccctggtacaaatgaccgtatcatcatggtttctggaatgtttgatgaagtaataaaggccatggagctcattcttgagaaacttttggctgagggtgaagaattcaatgaagctgaagctaggcctaaagttagacttgtagttcctaacagctcttgtggtgggataattggtaaaggtggatcaacaataaagtcatttattgaagaatcgcatgctggaatcaaaatttcgccacaggataacaactatgctggtttgcatgacaggcttgttactgtcacaggaacttttgataaccagatgaatgcaatagatttgatattgaagaagttatctgaggatgttcattaccctcctaacttgagttccccatttccatatgcaggtcttacttttccaagctatcctggtgttcctgttggttatatgattccacaggtgccatacaataatgctgtgaactatggacctaatgggtatggaggaaggtaccaaaacaacaagcccagcacacctatgagatcgcctgctaataatgatgcccaagaatctatcaccattggtgtagccgatgaacacataggtgctgttgtaggtcgtgctggaaggaacataacagaaatcattcaggctagtggtgctaggatcaagatatctgataggggtgacttcatgtctgggacaactgacaggaaagtgacaattactggaacatcggaagctatccgcactgcggagtccatgatcatgcagagggtgtcagccagttcggagaggtgatggggccctcttgaag

SEQ ID NO: 42665 - protein, 346 aa, Panicum virgatum
  misc_feature: Ceres CLONE 2013038
  misc_feature (45)..(110): Pfam Name: KH_1 Pfam Description: KH domain
  misc_feature (129)..(194): Pfam Name: KH_1 Pfam Description: KH domain
  misc_feature (271)..(336): Pfam Name: KH_1 Pfam Description: KH domain
MEAPGSPYASSPESAPKRAPRSPPQQQQHQQQPSEEGDDKEKPTHLRFLVSNTAAGCIIGKGGSTINDFQSQSGARIQLSRSHEFFPGTNDRIIMVSGMFDEVIKAMELILEKLLAEGEEFNEAEARPKVRLVVPNSSCGGIIGKGGSTIKSFIEESHAGIKISPQDNNYAGLHDRLVTVTGTFDNQMNAIDLILKKLSEDVHYPPNLSSPFPYAGLTFPSYPGVPVGYMIPQVPYNNAVNYGPNGYGGRYQNNKPSTPMRSPANNDAQESITIGVADEHIGAVVGRAGRNITEIIQASGARIKISDRGDFMSGTTDRKVTITGTSEAIRTAESMIMQRVSASSER

SEQ ID NO: 42666 - DNA, 653 bp, Panicum virgatum
  misc_feature: Ceres CLONE 2013041
  misc_feature: Encodes the peptide sequence at SEQ ID NO. 42667
gagagaaagaaaaccaggccgacagacaggagtccctcctcctccaacaaacatttggactccgaattttgcagagctagcctccctcctaccatcccccggagagacagagagagagagagagagagagagagaggcagggctttgattcgatcgatacgatggccacggacaagcagcgaggggacgaggaggacgcgtcccgggtggcgctgctgcacgcggacgtgaggaaggaggagcggcaggtggcggcggcgggcaccggcgatctcgggcggagggtgtgggaggagtcgaggaagctgtgggtcatcgtggcgccggccatcttcagccgcgtcgtcacctacagcatgaacgtcatcacgcaggccttcgcggggcacctcggcgacctcgagctcgccgccatctccatcgccaacaccgtcgtcgtcggcttcaacttcggcctcatgctgggcatggcgagcgcactggagacgctgtgcggccaggcgttcggcgcccgcaagttccacatgatgggcgtgtacatgcagcggtcctggctcgtgctcctcgtgtgcgcggtggtgctgctgcccatgtacttcttcgcggaggaggtgctgctcctgacggggcacccgccggagctgtcgggggat

SEQ ID NO: 42667 - protein, 163 aa, Panicum virgatum
  misc_feature: Ceres CLONE 2013041
  misc_feature (55)..(163): Pfam Name: MatE Pfam Description: MatE
MATDKQRGDEEDASRVALLHADVRKEERQVAAAGTGDLGRRVWEESRKLWVIVAPAIFSRVVTYSMNVITQAFAGHLGDLELAAISIANTVVVGFNFGLMLGMASALETLCGQAFGARKFHMMGVYMQRSWLVLLVCAVVLLPMYFFAEEVLLLTGHPPELSG

SEQ ID NO: 42668 - DNA, 627 bp, Panicum virgatum
  misc_feature: Ceres CLONE 2013044
  misc_feature: Encodes the peptide sequence at SEQ ID NO. 42669
tgcgcccggtaccggaggcggaggggacggactaccgggctgacaaggttgggccgccgttcaccggcccgtctacggtgcccggcgtggtagttcagccggagggcagagggttccacattgatggtcgcgttgtaagatgggcgacctgggagttccatgtgggtttcgacatgcgggctggcatggtcatctccctagcctcggtccacgacgccgacgcgggcaggtggcggcaggtgctctaccgcggcttcgtctccgagatcctcgtcccgtacatggaccccagcaacgagtggtacttccagaccttcaccgacgccggcgacttcggcctcggcgtctcggcgtccccgctccggcgcggcgcagactgcccggccaacgctgcctacctcgacggctactacgccgacgccgacggcgagcccgtcgaggccggggacgtggtgtgcgtgttcgagcgctactccggcgacatcgcgtggcgccacaccgaggccacgctgcaggtcacggaggtgaggccggatgtgaccttggtggtgaggatggtggtgaccgtcgggaactacgactacatcctggactgggagttcaaaaccagtggctccatcaagattg

SEQ ID NO: 42669 - protein, 208 aa, Panicum virgatum
  misc_feature: Ceres CLONE 2013044
  misc_feature (23)..(208): Pfam Name: Cu_amine_oxid Pfam Description: Copper amine oxidase, enzyme domain
  misc_feature: SWISSPROT Homolog: EC 1.4.3.6 Amine oxidase (copper-containing)
RPVPEAEGTDYRADKVGPPFTGPSTVPGVVVQPEGRGFHIDGRVVRWATWEFHVGFDMRAGMVISLASVHDADAGRWRQVLYRGFVSEILVPYMDPSNEWYFQTFTDAGDFGLGVSASPLRRGADCPANAAYLDGYYADADGEPVEAGDVVCVFERYSGDIAWRHTEATLQVTEVRPDVTLVVRMVVTVGNYDYILDWEFKTSGSIKI

SEQ ID NO: 42670 - DNA, 1705 bp, Panicum virgatum
  misc_feature: Ceres CLONE 2013073
  misc_feature: Encodes the peptide sequence at SEQ ID NO. 42671
acaaaaacccaaccccggcccatctcgtctccccctccccccccgtctcctccctccccgcgccgccacccccctcgaaaccctaaccctagccgcctcccgggaggcggagaggagagctcgcggcaccggtcatggcggagcacgacctcaccgcgctgctggcagcgcagatggaccgccacctggtcttcccgctgctggagttcctgcaggagcggcagctctactcggagccggagatcctcgaggccaagatccgcctcctcagcggcaccaacatggtcgactacgccatggacatccacaagtcgctccacggcaccgacgacgtccccgaggacatggtccgccgccgcaccgaggtcgtctccaggctcaggtcgctcgaggaggccgccgccccgctcgtcaccttcctccagaacccgcagctcgtgcaggagctcaggcccgacaagcagtacaacatccacatgctccaggatcgataccagattggtcctgatcagattgaagctctgtatcagtatgccaagtttcagtttgagtgtggtaactactcgggggctgctgactacctttaccagtatcgtgctctgtgcacaaacagtgagaggagtgtgagtgccctttggggaaagctggcggcagaaatcctgatgcagaactgggatgtagctttggaagaactcaaccgcttgaaggaaataattgattcaaagaatttctcatcaccccttaaccagctccagaacaggatatggctgatgcattgggctctcttcatcttttttaaccatgaaaatggtagaaatgggatcattgatctgttcttccaggacaggtacttgaatgctattcagacaaatgcacaccaccttctgagatacctagctactgcagtggttgtgaacaaaaggagaaggaatatgcttaaagagctgattaaagtcattcagcaggagcagcatagctacaaggatcctataactgaatttctggaatgcttatatgtcaactatgattttgatggtgctcaacagaaactcatggagtgcgagcaggttatattgaatgaccctttcctgggaaagcgcattgaaggaggaaattttgttactgtccctttgagagatgagttccttgaaaatgctcgtctgtttattttcgagacttactgccgtattcatcggtgcattgatatcagcatgcttgcgcagaagcttaacatgagctatgatgaggcagagttgtggataatgaacttggttaggagctcaaaactggatgccaggattgattcagtgtcaggaacccttatcatgacgaccaatcacgtcaatgtgcatgagcagattatcgagagcttgaagggccttaacatgcggacctacatgctagcaaagaacattgtggagccagctcaagcagcacagcaggcagctcggtgaggttagcggaatccacagttttgaggtgcccagggttagtgtagtagagacagctgtgaactttcggagctctatagccaggcagtgacttcgtcatcagtatttgaacacctggggtgctggtttgccgtttgcttcttatgctgacattttcagtattttgtactcggaatttcataacaggtgaaccttctctatgtattactacaatgaatgatgcaatcagattcatgtttcggcattaaggtgtt

SEQ ID NO: 42671 - protein, 439 aa, Panicum virgatum
  misc_feature: Ceres CLONE 2013073
  misc_feature (284)..(400): Pfam Name: PCI Pfam Description: PCI domain
MAEHDLTALLAAQMDRHLVFPLLEFLQERQLYSEPEILEAKIRLLSGTNMVDYAMDIHKSLHGTDDVPEDMVRRRTEVVSRLRSLEEAAAPLVTFLQNPQLVQELRPDKQYNIHMLQDRYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHSYKDPITEFLECLYVNYDFDGAQQKLMECEQVILNDPFLGKRIEGGNFVTVPLRDEFLENARLFIFETYCRIHRCIDISMLAQKLNMSYDEAELWIMNLVRSSKLDARIDSVSGTLIMTTNHVNVHEQIIESLKGLNMRTYMLAKNIVEPAQAAQQAAR

SEQ ID NO: 42672 - DNA, 1197 bp, Panicum virgatum
  misc_feature: Ceres CLONE 2013076
  misc_feature: Encodes the peptide sequence at SEQ ID NO. 42673
agcactcctatactgtactagacattgctgctggtggataaggaaaggataagagtataagacaatggaggaagcagcagccggtgaaaagctcgacgtggtgctgttcccgtggctggcgttcgggcacctgatcccgtacctggagctcgccaagcgcctcgcggcgaggggccacgccgtcacgttcgtctccacgccgaggaacgtcgccaggctcccgcccgtgccggcgcagctggcgccccgcctgcgcctcgtggcactgccgccgccggccgtggagggcctgcccgagggcgccgagtccacggccgacgtgccgccggagaagaacgagctcatcaagaaggcggtcgacggcctcgccgccccgttcgcggcgttcctcgcggacgccgtcgcccgcgggaggaggccggactggatcgtcatcgacttctgccacaactggctcccggctatcgccgacgagcacggggtgccgtgcgccgtgttccagatcgtgccggccgccatggtcgcgttttgcggctcgcggtcggcgaacgccgcgcacccgcgcacgacgccggaggacttcaccgtgccgcccaagtggtgcgcgtcgttcccttccgccattgcctaccgccgccacgaggccsactgggtcgccggcatgttcaaccccaacgcgtccggcgtgtccgacatggaccgcctgtgggggataacggagcgcacccgcttcaccatctaccgcaccaccgactagatcgaccccgccggccccggtgtgttcgccctcctcaccgatctctaccagaagccggcaatccccggcggggtcttgttccggccccaactccatgggcgcttccacaaccagtccagatcatgagcaccacccgacgtcctccgatggctggacacccacccacccaagtacctcatctacgtccccctccggagcgaggcgccgctgacccccaacgacttgcatgaactcccgctggggctggaggtctcccgcatccgcttcctgtgggctttccccaagccgagccgcatgtccgcgccccgcaccgacatccgccagctgctgccaacccgggtccacgaccggacacagggacacgacctcctgtgcactgtgtgggtcccgcaggagcagatgctcgctcactttgcggtggatgagttcctgactcactg

SEQ ID NO: 42673 - protein, 230 aa, Panicum virgatum
  misc_feature: Ceres CLONE 2013076
  misc_feature: SWISSPROT Homolog: EC 2.4.1.115 Anthocyanidin 3-O-glucosyltransferase
  misc_feature: Functional homolog of the protein sequence given in SEQ ID NO 51654
  misc_feature: Useful for making plants with altered carbohydrate content
  misc_feature (195)..(195): Xaa is any aa, unknown, or other
MEEAAAGEKLDVVLFPWLAFGHLIPYLELAKRLAARGHAVTFVSTPRNVARLPPVPAQLAPRLRLVALPPPAVEGLPEGAESTADVPPEKNELIKKAVDGLAAPFAAFLADAVARGRRPDWIVIDFCHNWLPAIADEHGVPCAVFQIVPAAMVAFCGSRSANAAHPRTTPEDFTVPPKWCASFPSAIAYRRHEAXWVAGMFNPNASGVSDMDRLWGITERTRFTIYRTTD

SEQ ID NO: 42674 - DNA, 682 bp, Panicum virgatum
  misc_feature: Ceres CLONE 2013076-R
  misc_feature: Encodes the peptide sequence at SEQ ID NO. 42675
ggtgggtcccccaggtgccgggtgctagcgcacggcgcggtgggtgcgttcctgactcactgcggctggggctccaccatcgagggcctcgtgtacgggcacccgctggtgatgctgccgttcgtcgtcgaccagggcctcatcgcgcgcgcgatggcggagcgccgcatcggcgtggaggtggcgagggatgagagcgacggttcgtttggcagggacgacgtggcggcggcggtgcgacgcgtcatggtagaggaagaagggaaggtgttttcaaccaatgccaaaaagttgaagcaagttcttggcgatcagcgacggcaggatcagtacatggacgagcttgaaggatacctcacacgctacaaggacaacaacagttcctaatggtgtcggcatggagtatgctgaaagcatggcagcaaaatgggagagacaaaaataaaatcgactttgatcagcaagttgcagagaaatgtactctggggatgaaaacggatcggatacggacgaatatcactgatatcgtatttgtttttatatttgtgttcgaatacggagttggatacggatagtgttaatttttatcggataagattgtaatggatatcgacattataaaaatgtaacttttgagtattcggatacggatcagttacgaatattacgtgaggtcatattc

SEQ ID NO: 42675 - protein, 128 aa, Panicum virgatum
  misc_feature: Ceres CLONE 2013076-R
  misc_feature: SWISSPROT Homolog: EC 2.4.1.236 Flavanone 7-O-glucoside 2''-O-beta-L-rhamnosyltransferase
  misc_feature: Functional homolog of the protein sequence given in SEQ ID NO 50279
  misc_feature: Useful for making plants with altered carbohydrate content
GGSPRCRVLAHGAVGAFLTHCGWGSTIEGLVYGHPLVMLPFVVDQGLIARAMAERRIGVEVARDESDGSFGRDDVAAAVRRVMVEEEGKVFSTNAKKLKQVLGDQRRQDQYMDELEGYLTRYKDNNSS

SEQ ID NO: 42676 - DNA, 1249 bp, Panicum virgatum
  misc_feature: Ceres CLONE 2013080
  misc_feature: Encodes the peptide sequence at SEQ ID NO. 42677
gggcaccgaggaggagcgaacaggcgaacgacgaaaccgagcccacgccaccgcacgcgctgagcgcaggcgcgtcccaccaccacctcctcctcgcccgatccgcccgccccgccgctcgccgcaccccgatgtcggccgccgacccatccgcggcgccgcccgcggccgccgccgacccggacggccccgacgccgtccgcctcacctggaacgcctggccgcgctccaaggtcgaggccagccgctgcgttgtgccgctcgccgccaccgtctcgcccgcccgcgtcccggacccctccgccgcgtccccgccgccgctcccctaccccccgctccgctgcaagccgccctgctcggcactcctcaaccccttcgcgcgcgtcgacttcgccgccaagatctggatctgcccgctctgcttctcccggaaccacttccctccgcactacgccgccatctccgagtccaacgtccccgccgagctcttcccgcagtgctccaccgtcgagtacatcgtcggtggcgcccctggcgctcccggggccgccggcgcccctccgccgcccgtattcctcttcgtcatcgacacatgcgtcattgaggaggagctggagtacgtcaagatggccatgcggaaggccgtcgcgctcctacccgagcacgcgctcgtcggcctcgttaccttcggcacgcaggtgcacctgcacgagcttggattctctgatctcagcaagatctacgtcttccggggtaccaaggagatctccaaggagcaaattttggatcagctggggctggctggtgccggccgtccgggcttccccaagatgccgcagcagccaggtgggccacaggtgaacgggatgcatccggcagcaacggccggggtgaataggttcctgctcccgatgtcggagtgcgagtgcacactcagcacgttgttggacgagttgcagcccgatcaatggccagtggaggctgggaaccgtgcaatccggtgcacgggtgttgccctgagcgtggccgctgggttgcttggtgcttgcatgcctgggacaggtgctaggatcattgcattgctcggtgggccatgtactgaaggccctggaatgattgtttccaaggatttgtcggagccagttagatcgcataaggatcttgacaaggatgcggctcctcacttccagaaagctgtcaaattttatgatggtcttgccaaacagttggtcagtccaggccatgtttt

SEQ ID NO: 42677 - protein, 372 aa, Panicum virgatum
  misc_feature: Ceres CLONE 2013080
  misc_feature (143)..(372): Pfam Name: Sec23_trunk Pfam Description: Sec23/Sec24 trunk domain
  misc_feature (67)..(107): Pfam Name: zf-Sec23_Sec24 Pfam Description: Sec23/Sec24 zinc finger
MSAADPSAAPPAAAADPDGPDAVRLTWNAWPRSKVEASRCVVPLAATVSPARVPDPSAASPPPLPYPPLRCKPPCSALLNPFARVDFAAKIWICPLCFSRNHFPPHYAAISESNVPAELFPQCSTVEYIVGGAPGAPGAAGAPPPPVFLFVIDTCVIEEELEYVKMAMRKAVALLPEHALVGLVTFGTQVHLHELGFSDLSKIYVFRGTKEISKEQILDQLGLAGAGRPGFPKMPQQPGGPQVNGMHPAATAGVNRFLLPMSECECTLSTLLDELQPDQWPVEAGNRAIRCTGVALSVAAGLLGACMPGTGARIIALLGGPCTEGPGMIVSKDLSEPVRSHKDLDKDAAPHFQKAVKFYDGLAKQLVSPGHV

SEQ ID NO: 42678 - DNA, 1785 bp, Panicum virgatum
  misc_feature: Ceres CLONE 2013081
  misc_feature: Encodes the peptide sequence at SEQ ID NO. 42679
aaaccgcgtgtggctctctgcgttccttcggataatctcgtgacggggagcaatgcgaagctaatcgcgagtttttgctcttgattccgaggcgtgctgttgtttctgctcccgtccccttggtcctggtccgacgcctgtgttgataccctgtgcagagaatggcgccgccgacgatgacggcagcggcgtgccggtgttcgccgagtacagcctcgacgagctccgggcggccaccgacggcttcgcgccggaccgcatcgtgtcggagcacggcgagaaggcgcccaacgtcgtctaccggggcacactcttcagctccggccgcaccgtcgccatcaagcgcttcggtcgctccgcctggcctgactcccgccagttcctggaggaggcgagggcagttgggcagctgcgcagtggccggctggccaacctgattggttgctgctacgagagcggggagcggctgcttgttgccgagttcatgccgcatgagaccttggcaaagcatctcttccactgggaaacgaaccccctgagctgggcaatgaggatgagggctgcgctttatgtggcacaggcattagaatactgcagtagcaaagggagagcactctaccatgacctgcatgcatacagggtcgtttttgatgtggatggtaacccaagactatcatgttttggtctgatgaagaacagcagggatggaaagagttacagtactaatttggcgttcacacctcctgaatacctgaagacaggtagagttagtccagagagtgtggtttacagttttggcaccatcttgcttgatctcctgagtggaaagcacattccaccaagtcatgcccttgatcttataaagggaaagaacttcctggtgctcatggattcttgcttggaaagtcatgtatccaactctgatggaactgacttgatgcgattagcatcccgctgcttgcagtatgaagcacgtgaccggccaaatctgaaagcagtggtgtctggtcttgcaagtctccataaagacgcttctattccttcgcacactttgctgggcatccaacaggataaaagaagctcagacaaagtccggttatctggtattggaaaagcttttgccagagcagacctgaacgaggttcatgagatattgctggatgatggctataatgaggacgacatggcaaatgctgaggtatctctccagtcatggaccggcgaattatctgagagcttcatcgtcaagaggcatgcagacaatgccttcaagtccaaggattttgcaactgccgtcgagtgttactcaaggttccttgactcaggtgcagcggtggctccaacaatgctggcgcgacgatgcttcgcatatgtagtggctggcaagttgcaggaaggcctagaggatgcaaagagggctgaggacattgcacctgggtggccaatgggacactatctgcaggcgttggcactccatagcctgggaagggaggcggaaagcaatgaagcactaaagaaaggcactgtgttggaagctgaaagaaatagtagagctacaactgtatagccgccctgaatgtgtgatgctctctctgcttgtacttaatatcgcctgcattttgggtgcccccctccaatgctttgccgccagtagggctgtttttggtattccctaacatgtatcggtatttccaatggttttacaagtcaaaaaactcctaggttggctgttattacacctccgatatattcatgaatacggaaatgggcaactagtatcgtgat

SEQ ID NO: 42679 - protein, 360 aa, Panicum virgatum
  misc_feature: Ceres CLONE 2013081
  misc_feature: SWISSPROT Homolog: EC 2.7.11.1 Non-specific serine/threonine protein kinase
MPHETLAKHLFHWETNPLSWAMRMRAALYVAQALEYCSSKGRALYHDLHAYRVVFDVDGNPRLSCFGLMKNSRDGKSYSTNLAFTPPEYLKTGRVSPESVVYSFGTILLDLLSGKHIPPSHALDLIKGKNFLVLMDSCLESHVSNSDGTDLMRLASRCLQYEARDRPNLKAVVSGLASLHKDASIPSHTLLGIQQDKRSSDKVRLSGIGKAFARADLNEVHEILLDDGYNEDDMANAEVSLQSWTGELSESFIVKRHADNAFKSKDFATAVECYSRFLDSGAAVAPTMLARRCFAYVVAGKLQEGLEDAKRAEDIAPGWPMGHYLQALALHSLGREAESNEALKKGTVLEAERNSRATTV

SEQ ID NO: 42680 - DNA, 668 bp, Panicum virgatum
  misc_feature: Ceres CLONE 2013091
  misc_feature: Encodes the peptide sequence at SEQ ID NO. 42681
agtcgacagattgtggtctcctcgagttttttctttttttttttttccgcagcacaaagaaagaccagaaacaaacaacaacatggagaatacggatcaacaaaagcgcacagtcatctgcagcgaccgtgttgtcatcgggaacgatctcgttcctgcaaccgttcactttgagaatggggtgattactaaagttgaaaacggtaaaatcacctctgcgcccgaaggagctgccttccacgattttggcaacctcgtcatcatgcccggcgtggtggatagtcacgtgcacatcaacgaccccggtcgcacggcttgggaaggtttcccgtcggccacgcaggctgccgctgccggaggcgttacgactgtggttgacatgcccctcaattgttctcctgtgacaacaaccctcgacgcgttgaagctcaagcaagaccacactgatggcaagctatgggcggacgtagctctgctgggtggcatcgttcccaacaatgcacacgagatcagcccgatggttcatgccggagttgtgggattcaaagcgttcatggtccactctgggatcgacgagtttccgcacgtagaagaggaacacattcgcgccgcgatgagcgagctcaagaagcttcaggaccaaggccgagacgtggtgttcatgttcc

SEQ ID NO: 42681 - protein, 195 aa, Panicum virgatum
  misc_feature: Ceres CLONE 2013091
  misc_feature: SWISSPROT Homolog: EC 3.5.2.5 Allantoinase
MENTDQQKRTVICSDRVVIGNDLVPATVHFENGVITKVENGKITSAPEGAAFHDFGNLVIMPGVVDSHVHINDPGRTAWEGFPSATQAAAAGGVTTVVDMPLNCSPVTTTLDALKLKQDHTDGKLWADVALLGGIVPNNAHEISPMVHAGVVGFKAFMVHSGIDEFPHVEEEHIRAAMSELKKLQDQGRDVVFMF

SEQ ID NO: 42682 - DNA, 1245 bp, Panicum virgatum
  misc_feature: Ceres CLONE 2013097
  misc_feature: Encodes the peptide sequence at SEQ ID NO. 42683
gacttccgagtgagagccccaccccctcgatctgcgcgaccccggcggcgacgagccctctccggcggccgccacgcccgcggctcgccggcgatgatggccggccgcgcccacggccaccggaaccggctccgccgcctcatcccgcgggtcctcctcatcgtcttcgccgtctacgccgtctccttcgcgatctacctcctccgccagccccaccgcccgccgccgcccgaccccaccctacgaaccgacgtccgcgacggcttccgggcgccgccgtcctcccagaagccctggccgcgcctcccctccttccttccctgggtcggcggccccgcgccgccgccgcacacctgcgaggcctacttcggcaacggcttctcccgccgcgtggaggtcctccccgcgcgcggcgggggcggcgggtggttccggtgccaccacagcgagacgctggggagctcgatctgcgagggcgcgcgggtgcggctcgacccggcgctcatcgcgatgtcgcgcggcggggagcccctcgagcaggtgatgggacgcgccgaggaggaggagctgcccaagtacgagcccggcgcgctgctggtggaggggccgtcggtggggaggacggcacccttggtggacacagggttcctcaacaactatgtgcccaccggcgggatcgggatgcacacgatgagggcgctcctcgagtcggcgcgcgttgtgccgcccggtgagctacactgctcccagtgggttgaagaaccaacgcttctggtcactcgttttgaatatgcaaaccttttccacacaattacagactggtacagtgcatatgttagttccagagtcacaaatttaccaaaccgtcctaatgttgttttcgtggatgggcattgcaaggcacaattggagcaaacatgggaagcacttttttcaagtgtgacatatgctaagaacttctctggtcctgtttgtttccgacgcgccattctttcaccattgggctatgagactgccatgtttaaggggcttagcgagagcttcagttgtgaaggtgcctccgctcagtccctacgaggaaaaccagattatgataaaacagcaagattatcagaatttggggagatgattgtagcttcttttggtcttccacaagatgacatcatgtcatccaaaaaatcaaatgggctcaatgttctctttgttcggagagaagactacttggcccacccacgccacagtggg

SEQ ID NO: 42683 - protein, 383 aa, Panicum virgatum
  misc_feature: Ceres CLONE 2013097
  misc_feature: SWISSPROT Homolog: EC 2.4.2.38 Glycoprotein 2-beta-D-xylosyltransferase
MMAGRAHGHRNRLRRLIPRVLLIVFAVYAVSFAIYLLRQPHRPPPPDPTLRTDVRDGFRAPPSSQKPWPRLPSFLPWVGGPAPPPHTCEAYFGNGFSRRVEVLPARGGGGGWFRCHHSETLGSSICEGARVRLDPALIAMSRGGEPLEQVMGRAEEEELPKYEPGALLVEGPSVGRTAPLVDTGFLNNYVPTGGIGMHTMRALLESARVVPPGELHCSQWVEEPTLLVTRFEYANLFHTITDWYSAYVSSRVTNLPNRPNVVFVDGHCKAQLEQTWEALFSSVTYAKNFSGPVCFRRAILSPLGYETAMFKGLSESFSCEGASAQSLRGKPDYDKTARLSEFGEMIVASFGLPQDDIMSSKKSNGLNVLFVRREDYLAHPRHS

SEQ ID NO: 42684 - DNA, 618 bp, Panicum virgatum
  misc_feature: Ceres CLONE 2013097-R
  misc_feature: Encodes the peptide sequence at SEQ ID NO. 42685
tggggcgggcctaacacacttagtttcagctactcctgataccaaggttctcgagatcatcagcagcatgtaccggcgcccacattttgctttgatctcacagtggaaggctttagagtaccatgccataaacctcccagggtcatacgcacggatcacagatgtcatcagtgagctgagtaatatactgacaggtcttggatgctgaaacagaggtgcttgccatgaacatcgccataggccatcaatggataccgtctctgcttcatacatactggccacgctaactgcacagctgaatacaattttaattgaaggggagtgttgcacagattatttccaccaatgtacctacacccgattcattcccatttatcagcagaagaattttacgctgctgaatgaagagccaagaatagaaccctctgtccggtatctgagagcaactgatgacatgcaatccaaccgaggttgcccactgcattgttcgcgcaagtatattaagaccacaggcttaaccaaattgtattctttcccggcttatagattcagcaaaacttttgtatgttgtgtattgagagctttcccattattcaggttttgataactgcctgttgg

SEQ ID NO: 42685 - protein, 68 aa, Panicum virgatum
  misc_feature: Ceres CLONE 2013097-R
  misc_feature: SWISSPROT Homolog: EC 2.4.2.38 Glycoprotein 2-beta-D-xylosyltransferase
GAGLTHLVSATPDTKVLEIISSMYRRPHFALISQWKALEYHAINLPGSYARITDVISELSNILTGLGC

SEQ ID NO: 42686 - DNA, 654 bp, Panicum virgatum
  misc_feature: Ceres CLONE 2013105
  misc_feature: Encodes the peptide sequence at SEQ ID NO. 42687
ggccgaggcagcgaccacggatgttgagctgctcaagcgggcgtggcgtaacgagaaggctgcgccagaaatcctccgcttcgactcaccccttgtctcccgcgtccgcgagcagatccagctccttgaggagacactggatgactttgctgacagcggtgtcgatgacctggtggtctctctctaccagatggacctcgatcgcacactcttccttctgcgctcctacctccgcctccgcctgcagaagattgagaagtacacgatgcacatctccaggtctgatgacctcctcagccgtctgtcaccgcaggagcgccgttttgccaagaggtaaattctgactgtgggactggcatttgccacaattatttgtgtcagcttgtcaaactagttggttctgatgggaaccaacttcttgtgtttcatctttcacaagttgtgcggagatcatggaaaagcatctggagcagtctgtgctgtcaaaactgccatatggttatgactcggttaccaggcagtcgttgtcgagcactgaagatgacatgggtatagatccttcacttgaccttccaaattatggagttccatgtcgtggtgtggtactgctttgatgcttgcagcttcagtcattgcatatttgcataggttgct

SEQ ID NO: 42687 - protein, 111 aa, Panicum virgatum
  misc_feature: Ceres CLONE 2013105
  misc_feature (3)..(111): Pfam Name: Sld5 Pfam Description: Synthetic lethal mutants of dpb11-1 five
AEAATTDVELLKRAWRNEKAAPEILRFDSPLVSRVREQIQLLEETLDDFADSGVDDLVVSLYQMDLDRTLFLLRSYLRLRLQKIEKYTMHISRSDDLLSRLSPQERRFAKR

SEQ ID NO: 42688 - DNA, 625 bp, Panicum virgatum
  misc_feature: Ceres CLONE 2013110
  misc_feature: Encodes the peptide sequence at SEQ ID NO. 42689
cagcgagactgtgaatgccatatgccaaatggccgcgagagccgccgccgccacgcccggcctcctcttgctcccgtttctccttctagctgctgcttccggcgccgccaacgatgcagccggcagcacgccgccgatcagccggaaaagcttccctgagggcttcatcttcgggacggcctcgtcggcctatcagtatgaaggcggtgctatggaggggggcagaggacccagcatctgggacaccttcacccaccagcacccagaaaaaatcagagacggaagcaacggggatgtagcagtggactcctaccatctttacaaggaagatgtgcgcctcatgaaggacatggggatggatgcatacaggttctccatttcatggagcagaattcttccaaatggcagtctgagcggtggaattaacagagaaggtgtcaattactacaataatctcattgatgagctcctatccaaaggagtgcaaccctatgggaccctttttcactgggatacacctcaggcattagaagataaatatgaaggatttcttagcccaaatattgtaaatgacttcaaggactatgctgacctctgcttcaaggagtttggtgatcgagtggaa

SEQ ID NO: 42689 - protein, 198 aa, Panicum virgatum
  misc_feature: Ceres CLONE 2013110
  misc_feature (38)..(198): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50483
  misc_feature: Useful for making plants with altered cell wall content and/or composition
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50615
  misc_feature: Useful for making plants with modulated biomass
  misc_feature: Functional homolog of the protein sequence given in SEQ ID NO 50360
  misc_feature: Useful for making plants with modulated flowering time
MAARAAAATPGLLLLPFLLLAAASGAANDAAGSTPPISRKSFPEGFIFGTASSAYQYEGGAMEGGRGPSIWDTFTHQHPEKIRDGSNGDVAVDSYHLYKEDVRLMKDMGMDAYRFSISWSRILPNGSLSGGINREGVNYYNNLIDELLSKGVQPYGTLFHWDTPQALEDKYEGFLSPNIVNDFKDYADLCFKEFGDRV

SEQ ID NO: 42690 - DNA, 639 bp, Panicum virgatum
  misc_feature: Ceres CLONE 2013120
  misc_feature: Encodes the peptide sequence at SEQ ID NO. 42691
atgtccagtctctgctcgccccctctccgcctccgccatggccaccgcctcgctctccccgccgccgcgatggccgccgccgcctctgggattactccctctcctagtcctcatcctcgcctgcctcgccgcgcaggccccaccgcgggcggcggaggcggcgggggtgctgaggcaggtggtggccggtggtggggacggcgacggcgggaccttcttcgagccgttcaacgtcacctacgaccaccgcgcggtgatcctcggtgggaagcgaaggatgctcgtctccgcggggctccactacccgcgcgccacgcccgagatgtggccgagcctgattgcaaagtgcaaggagggcggtgcggatgtgatcgagacatatatcttttggaatgggcatgagccagccaaaggccagtattactttgaaggaaggtttgatattgtcaagtttgcgaagctggttgctgctgaaggtctatttctttttctgcgtatcggcccatatgcttgtgctgaatggaatttcggtggtttcccagtttggctgcgtgacatccctgggatagaattccgtactgacaatgaaccctacaaggctgaaatgcagagttttgtgacaaaaatcgtaaatatcat

SEQ ID NO: 42691 - protein, 200 aa, Panicum virgatum
  misc_feature: Ceres CLONE 2013120
  misc_feature (72)..(200): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51319
  misc_feature: Useful for making plants with altered carbohydrate content
  misc_feature: Functional homolog of the protein sequence given in SEQ ID NO 51516
  misc_feature: Useful for making plants with altered cell wall content and/or composition
MATASLSPPPRWPPPPLGLLPLLVLILACLAAQAPPRAAEAAGVLRQVVAGGGDGDGGTFFEPFNVTYDHRAVILGGKRRMLVSAGLHYPRATPEMWPSLIAKCKEGGADVIETYIFWNGHEPAKGQYYFEGRFDIVKFAKLVAAEGLFLFLRIGPYACAEWNFGGFPVWLRDIPGIEFRTDNEPYKAEMQSFVTKIVNI

SEQ ID NO: 42692 - DNA, 682 bp, Panicum virgatum
  misc_feature: Ceres CLONE 2013121
  misc_feature: Encodes the peptide sequence at SEQ ID NO. 42693
acggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagccagtagccccagttccagtcaacggtcaccagtcagtcaccacgctgtcgcacagccacagccacaaacatggcgtggctcctttctcgcgtcgccggcgccgctctcctcctcgttctcgtcctcgtcctgacggtgaccacgagcactagcccggcggcggctcagagtaagaggttcccggcgagggcgcacccaacgaggtcgggctacctcaacgtcacctccaccaactccctctacttcgccttctacgaggccaccgacccggtcaccacaccgccgaccgccgcgccgctgctcgtatggctgcagggcgggcccgggtgctcctcgctcatcggcaacttcgccgagctcggcccctacctcctcaactccacggggctctcgcgcaaccggaaccgctggaaccgccgcttcggcgtcatcttcgtcgacaacccgctcggctccggcttcagcacgcccgcgtccaaagcggacatcccccaggacgaacccaccatcgcggcgcacctcct

SEQ ID NO: 42693 - protein, 151 aa, Panicum virgatum
  misc_feature: Ceres CLONE 2013121
  misc_feature: SWISSPROT Homolog: EC 3.4.16.6 Carboxypeptidase D
MAWLLSRVAGAALLLVLVLVLTVTTSTSPAAAQSKRFPARAHPTRSGYLNVTSTNSLYFAFYEATDPVTTPPTAAPLLVWLQGGPGCSSLIGNFAELGPYLLNSTGLSRNRNRWNRRFGVIFVDNPLGSGFSTPASKADIPQDEPTIAAHL

SEQ ID NO: 42694 - DNA, 652 bp, Panicum virgatum
  misc_feature: Ceres CLONE 2013124
  misc_feature: Encodes the peptide sequence at SEQ ID NO. 42695
gatgaatttctgtccctggcagctgaccaagaatttgatcttccagacaaggagaagacagatatatgcactataatgtatactagtggaactactggtgacccaaaaggggtactgatatccaatgcaagcattatttgtctcatcgcaggtgtggaccggctacttaaccgtgtaaacgagaagctggcagaaagcgatgtttacatgtcttaccttcctcttgcgcacatctttgatcgtgttgtggaggagctgtttattttccatggtgcctctattggattctggcgtggggatgttaagctgctagttgaagatattggtgtgctgaaaccaacaatcatgtgtgctgtcccacgtgttcttgatcggatattttctggactgcaagctaaaatttcctctggtggttttataaagagtacactattcaatcttgcttacaaattcaaaaagtttacaatgatgagaggagctaagcatgatgaagctgctgccatatgtgataaagtagtttttagtaaggtgaaagagggtctcggtggcaatgttagagttattttatctggagctgctccacttgctacccatgttgaagaatacttgcgaagggtgacgtgcgcacatgttttacaaggatacgggcctc

SEQ ID NO: 42695 - protein, 217 aa, Panicum virgatum
  misc_feature: Ceres CLONE 2013124
  misc_feature: SWISSPROT Homolog: EC 6.2.1.3 Long-chain-fatty-acid--CoA ligase
DEFLSLAADQEFDLPDKEKTDICTIMYTSGTTGDPKGVLISNASIICLIAGVDRLLNRVNEKLAESDVYMSYLPLAHIFDRVVEELFIFHGASIGFWRGDVKLLVEDIGVLKPTIMCAVPRVLDRIFSGLQAKISSGGFIKSTLFNLAYKFKKFTMMRGAKHDEAAAICDKVVFSKVKEGLGGNVRVILSGAAPLATHVEEYLRRVTCAHVLQGYGP

SEQ ID NO: 42696 - DNA, 626 bp, Panicum virgatum
  misc_feature: Ceres CLONE 2013126
  misc_feature: Encodes the peptide sequence at SEQ ID NO. 42697
aagcgcagcaaacaggagccacacagcccacctaccccctctcgggagtcaggcccgacgaagaagtccgccatggacctcgccctcctcgagaaggccctgctgggcctgttcgcggcggcggtgctggccatcgccgtggcgaagctgacgggcaagcggctccgcctgccccccggcccctccggcgcgcccgtggtgggcaactggctccaggtcggcgacgacctcaaccaccgcaacctgatggcgctcgcgaagcggttcggcgacatcttcctcctccggatgggcgtgcgcaacctggtggttgtgtccaccccggagctcgccaaggaggtcctccacacccagggcgtcgagttcggctcccgcacccgcaacgtcgtcttcgacatcttcaccggcaagggccaggacatggtcttcaccgtctacggcgaccactggcgcaagatgcgccgcatcatgaccgtccccttcttcaccaacaaggtggtggcgcagaaccgcgtgggttgggaggaggaggcccgcctcgtggtggaggacgtcaagaggaaccccaaggcggccaccgagggcgtcgtcatccgcaggcgcctgcagctcatgatgtacaacga

SEQ ID NO: 42697 - protein, 184 aa, Panicum virgatum
  misc_feature: Ceres CLONE 2013126
  misc_feature: SWISSPROT Homolog: EC 1.14.13.11 Trans-cinnamate 4-monooxygenase
  misc_feature: Functional homolog of the protein sequence given in SEQ ID NO 51193
  misc_feature: Useful for making plants with altered carbohydrate content
  misc_feature: Functional homolog of the protein sequence given in SEQ ID NO 51194
  misc_feature: Useful for making plants with altered lignin content
  misc_feature: Functional homolog of the protein sequence given in SEQ ID NO 51196
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: The sequence is a functional homolog of SEQ ID NO 8 in US patent 7148406
MDLALLEKALLGLFAAAVLAIAVAKLTGKRLRLPPGPSGAPVVGNWLQVGDDLNHRNLMALAKRFGDIFLLRMGVRNLVVVSTPELAKEVLHTQGVEFGSRTRNVVFDIFTGKGQDMVFTVYGDHWRKMRRIMTVPFFTNKVVAQNRVGWEEEARLVVEDVKRNPKAATEGVVIRRRLQLMMYN

SEQ ID NO: 42698 - DNA, 1396 bp, Panicum virgatum
  misc_feature: Ceres CLONE 2013131
  misc_feature: Encodes the peptide sequence at SEQ ID NO. 42699
gctaaaatccactctctcgctcactctatttccgctctcaagtctcaccctctccctccgctcgccactagccacccgccacactcgtttctctcccccctcccagctcggctccctctgctttcccctgcgccggggccgcaggagcggcgtcatcttccgatggggaacccgcccgagctgtaccacaagatcctcaacatccccaaggacacctcgccgcaggaaatccgcgccgcgtacaagaacctcgtcaagaaatggcaccccgacaagcacccgccgttgtccaagcccgaggccgaggcgcgcttcaaggccatcagcgaggcctacgaggcgctcctggaccagcaggagaacagggcggtgttcgggctgtgcaacgacggccgggccggcgagagggccggcggcggcggcgtcgggccgcgcatggagaggacgcgcagcgacgacttgtgcacgaggagcgcgcccggcacgccggcgagggagttcaagaaggtgtacagctccggcaactcgggcgggcggcgcgccttcgccgagttctccagctccatcatgcgcaaggcgccgccgctggagctcaagctcgagtgcaccctcgaggagctctgccgcggctgcaagaaggaggtcaagttcacccgcgacgtcgtcaccaggaacgggtacctgctttcctctgcttttcctctcccttctgacgcggctacacctaatccatgaaccaacaagagtttgattgaaaaccttgctagaaatccggcgagcaatcacttcacttggcagttgactacgcttcttcaaacgcacaaagagggaaatttaatcaaagcagagctgagcagtgtctatataattcagacttaacaatgaatctgtgcttggaaacttagggttaggcaagaattcagaggtcatcctgatggcgacagacattccactctgtgttgtgctccccaatgcgctcgctgctgcactgcactgtagggtatcgctcgatgaacagtgcaccagcacaatcgctttctgctttttttcctggatatggcgcgagcgattgtgtttttttacagtggggggtgggtgactgctttttacatcatgcacttgtcagtggaatatctagctagctttggaacgtaggcatgaaactttacacgagtggcctgggctttggtgtgaccctttcccccttccttctgggcatctattctattcttgcaagattatcctacctaactaacacaaggccacgataacaatgttttcgaacgcggttagtacagcgacggatcgtcctatcttgagaagataatcccaagatgccctctttgccacatatgtgtatgcatgtttgttggagccttttaatacccaattttgg

SEQ ID NO: 42699 - protein, 190 aa, Panicum virgatum
  misc_feature: Ceres CLONE 2013131
  misc_feature (7)..(72): Pfam Name: DnaJ Pfam Description: DnaJ domain
MGNPPELYHKILNIPKDTSPQEIRAAYKNLVKKWHPDKHPPLSKPEAEARFKAISEAYEALLDQQENRAVFGLCNDGRAGERAGGGGVGPRMERTRSDDLCTRSAPGTPAREFKKVYSSGNSGGRRAFAEFSSSIMRKAPPLELKLECTLEELCRGCKKEVKFTRDVVTRNGYLLSSAFPLPSDAATPNP

SEQ ID NO: 42700 - DNA, 618 bp, Panicum virgatum
  misc_feature: Ceres CLONE 2013131-R
ctgtcgttccggctcctgagcggcaagaaggtgagcctggcgttccaggacgaggtcatccgccccgggctcgagaaggtgatcaggggcgaaggcatgcccatccccgagcacaagggcggcgcgcggggcgacctcagggtgaagctcgaggtcgtcttccccaaggagctcaccggcgagcagcgcgccgggctcgccgagatcctcaaagggtactgctgctgatccggatcggtcgatcgaccgagcttgtggtggtgccgccgtgccggcgccgggaccgacgaccgtatcaagttttcttggccgtatgctagagaaactccaacggattgatctttctctttcctctttctcatcatatagggaaattcttttttctcaattttaacatatatggaagaagtgctccagcagattgattttctccactttctatatggaaagggagatgcgatgtctcccctttctattggggattggagagaaattattggagattgagaaaaaataaaggggaaagagaggtggaaaatcaatctgctggagtaggttttttcaacatcaatcccctatattgagaaaaagtggaaaagaaaaaagagaagattaatc

SEQ ID NO: 42701 - DNA, 1266 bp, Panicum virgatum
  misc_feature: Ceres CLONE 2013135
  misc_feature: Encodes the peptide sequence at SEQ ID NO. 42702
ctattctccctgcctgtcaagaatcctccctaccacctcctccacaccctcccgactcgagcctccatctcctgtctcccggttgctcctgagccgccgagcgtggagggaaggcgacggactaatgaggacggggagggcgcgggcgctgcccctggcgctcgccttgctcctcgcctgctcctacgtcgccgtcgtcgcggcgcagggcaccgagcggatccaaggaagtgctggtgatgtgctagaagatgatcctgttggaaggctcaaggtatatgtctatgagttgccgcccaagtacaacaagaatattttggcaaaagattcaagatgcctcaagcacatgtttgctacagagatcttcatacatcgcttcctactgtcgagtgcagtccggacactaaatccggaagaagccgattggttctatactccagtatacacaacatgcgaccttactccatggggccatcccttgaccaccaagtctccacgtatgatgagaagtgcgattcagtacatttccaagcgttgcccctactggaacaggacagagggagcagatcatttctttgtcacaccacatgactttggagcatgcttctatttccaggaagcaaaggctatcgagcgaggtgtccttccagtgctgtgccgtgccacgctggtccagacttttgggcagaagcatcatgtatgcctcaaggaaggctccatcaccatcccaccatatactcctcctcataagatgagaactcacctcgttccaccagagacccctcggtcaatctttgtctattttcgtggtttgttctatgatacttcaaatgatcctgagggtggttactatgcaaggggcgcccgtgcatcggtgtgggagaacttcaagagcaacccgatgttcgacatctcgacagaccacccaccaacctactatgaggacatgcagcgttctgtattctgcttgtgcccactgggctgggccccatggagcccccgtttggtggaggctgtggtgtttggctgcatccccgtgatcatcgccgacgacattgttcttccctttgcggacgcgatcccatgggaggagatcggtgtctttgtggctgaggatgacgtcacgaagctggacaccatcctgacctccataccaatggaggaaatccttcgaaagcagaggctgctcgcaaacccatccatgaagcaggccatgctcttcccacagccagctgaacccagggatgccttccaccagatcctgaa

SEQ ID NO: 42702 - protein, 380 aa, Panicum virgatum
  misc_feature: Ceres CLONE 2013135
  misc_feature (51)..(355): Pfam Name: Exostosin Pfam Description: Exostosin family
  misc_feature: Functional homolog of the protein sequence given in SEQ ID NO 50624
  misc_feature: Useful for making plants with altered carbohydrate content
  misc_feature: Functional homolog of the protein sequence given in SEQ ID NO 50625
  misc_feature: Useful for making plants with altered cell wall content and/or composition
MRTGRARALPLALALLLACSYVAVVAAQGTERIQGSAGDVLEDDPVGRLKVYVYELPPKYNKNILAKDSRCLKHMFATEIFIHRFLLSSAVRTLNPEEADWFYTPVYTTCDLTPWGHPLTTKSPRMMRSAIQYISKRCPYWNRTEGADHFFVTPHDFGACFYFQEAKAIERGVLPVLCRATLVQTFGQKHHVCLKEGSITIPPYTPPHKMRTHLVPPETPRSIFVYFRGLFYDTSNDPEGGYYARGARASVWENFKSNPMFDISTDHPPTYYEDMQRSVFCLCPLGWAPWSPRLVEAVVFGCIPVIIADDIVLPFADAIPWEEIGVFVAEDDVTKLDTILTSIPMEEILRKQRLLANPSMKQAMLFPQPAEPRDAFHQIL

SEQ ID NO: 42703 - DNA, 511 bp, Panicum virgatum
  misc_feature: Ceres CLONE 2013135-R
  misc_feature: Encodes the peptide sequence at SEQ ID NO. 42704
atcctgaatgggctcgcgcggaagctgccgcatggtaagggcgtgttcctgaagcccgggcagaaggtgctgaactggactgagggagacccggccgatctgaagccgtggtaggtataaacgtatagtggcatggcaccatcaccattcgccatggctggaattcttgtgcaaacgacacaaccatactagaggctgatcatacagttgacgatgatgctgatgagtgaaccgcaccattaaatgtaaagctccttcccttcctcctcctacctgcttctttttgaggcaatgtgcctgtcttgcctgtatggccatacccgttctgaccttttggtgtagtgttagcattttatagatgatagatggtggatcatgtaatgtatgaccgttgtattatattatacagttgccggtttacaatgggaaagtaactaactccaatccagaaaacctgctaaatgcttgtgcgtttcagaactgaatgctaaatgtaatgtgtgcttgactc

SEQ ID NO: 42704 - protein, 37 aa, Panicum virgatum
  misc_feature: Ceres CLONE 2013135-R
  misc_feature: Functional homolog of the protein sequence given in SEQ ID NO 50745
  misc_feature: Useful for making plants with altered carbohydrate content
  misc_feature: Functional homolog of the protein sequence given in SEQ ID NO 50682
  misc_feature: Useful for making plants with altered cell wall content and/or composition
ILNGLARKLPHGKGVFLKPGQKVLNWTEGDPADLKPW

SEQ ID NO: 42705 - DNA, 571 bp, Panicum virgatum
  misc_feature: Ceres CLONE 2013137
  misc_feature: Encodes the peptide sequence at SEQ ID NO. 42706
accgacaattccggctccgatccagttcttcggaaacgggtcctggaaccggaatggcgcggcgggtcctctccgcgctgcttctcgcagccctggctgttgcttgaaccatgcatgtatatatgtgtacaaggctacaagcatctgagcaagttggtgccttgcatttttgtttgcagtacgagggtgcctacaaggaaggaggcaaaggtcccagcgtgtgggacatcttcagtcacttaccaggtaaaatcaagaacaatgatactggcgatgtagcggatgacttctaccatcgatacaaggaggacgtgaagctcctcaaggacatgaacatggatgccttccggttctcaattgcctggaccaggatcctgccaactggctccctgagcggaggaatcaacaaggaaggggtggccttctacaacaacctcatcaacgaggtcatagcaaatgggctgaagccattcgtcaccatcttccactgggacacaccccaggccctcgagagcaagtacaagggcttcctcagcgagaacatcatccaggactacgtggacttcgcgga

SEQ ID NO: 42706 - protein, 153 aa, Panicum virgatum
  misc_feature: Ceres CLONE 2013137
  misc_feature (18)..(152): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50615
  misc_feature: Useful for making plants with modulated biomass
  misc_feature: Functional homolog of the protein sequence given in SEQ ID NO 51655
  misc_feature: Useful for making plants with altered cell wall content and/or composition
  misc_feature: Functional homolog of the protein sequence given in SEQ ID NO 50360
  misc_feature: Useful for making plants with modulated flowering time
MHVYMCTRLQASEQVGALHFCLQYEGAYKEGGKGPSVWDIFSHLPGKIKNNDTGDVADDFYHRYKEDVKLLKDMNMDAFRFSIAWTRILPTGSLSGGINKEGVAFYNNLINEVIANGLKPFVTIFHWDTPQALESKYKGFLSENIIQDYVDFA

SEQ ID NO: 42707 - DNA, 1349 bp, Panicum virgatum
  misc_feature: Ceres CLONE 2013150
  misc_feature: Encodes the peptide sequence at SEQ ID NO. 42708
ggagcaaaaccaacacgaacagagacgataagaaaagtacaatctgcgtcgtcagaattcgtcaggtttttattgcgctcgccgaaagacagccggctcgaacgatacgacgcgacacgacgaccttcgcttcctccgccaccgaatccaccacaaaaactaccatttcttggggttttgcctattcaccggaggacggcgccggccggccaagaagaacaagaaaaagggagaaaggagggattttgtgggcgagaaggcggcggttttgggatttttcctgctccctcagttctgcgtcggccggcggctccggctttcgtgaggctctgtgtggtggtgctctgacggagccgagatgtcgtcggtgatggtggagcgggcgacgagcgacatgctcatcggccccgactgggcgatgaacctggagatctgtgacatcctcaatcgcgaacccgggcaagcaaaagttgtggtgaagtccctcaagaaacgcattatacacaagaacccaaaggtccagcttcttgctctcacggtgctggagacgatgataaaaaattgtggggacattgtccatatgcatgttgctgagagagacatactccatgaaatggtcaagatagttaagaaaaggcatgactatcatgtaaaagagaggatactcacgctgatagacacttggcaagaagtttttggtggagaacgtgcaagatatccacaatactttgcagcatttcaggagctcttgcgtcttggagctgtatttcctcaaagatcaaatggttctgtgccaatcattactcctccacagactcagcctctacaaaattatccccctcctttacgcatttctcagcaggacgaacctgagttgtccattccggatttccctgcattaagccttacagaaattcagaatgcacgtggcatcatggatattctttcagagatgttggatgctttggatccgggtaacagagagggacttgggcaagatgtcattgttgaccttgtggatcaatgccgttcctacaagcaaagagtagaacagcttgtcaacagtacctcgaatgaggagttgctcggccagggtctttctttgaatgatgatatgcagcgtgtccttgcaaaacatgatgctattgcagcaggtatagcaattcgggtagaaaagccgaaatccctgcagtctcaaagtgagagttctgcaacaagaaagccagatactgcgaatgaaccagttcaaaggtctttggcgagtacaagcaccaccaatcagtctccctttgagattttagcacttcctgcacctccatcatccagtagctcaaaggctcgtgtgccac

SEQ ID NO: 42708 - protein, 330 aa, Panicum virgatum
  misc_feature: Ceres CLONE 2013150
  misc_feature (1)..(134): Pfam Name: VHS Pfam Description: VHS domain
  misc_feature (176)..(274): Pfam Name: GAT Pfam Description: GAT domain
MSSVMVERATSDMLIGPDWAMNLEICDILNREPGQAKVVVKSLKKRIIHKNPKVQLLALTVLETMIKNCGDIVHMHVAERDILHEMVKIVKKRHDYHVKERILTLIDTWQEVFGGERARYPQYFAAFQELLRLGAVFPQRSNGSVPIITPPQTQPLQNYPPPLRISQQDEPELSIPDFPALSLTEIQNARGIMDILSEMLDALDPGNREGLGQDVIVDLVDQCRSYKQRVEQLVNSTSNEELLGQGLSLNDDMQRVLAKHDAIAAGIAIRVEKPKSLQSQSESSATRKPDTANEPVQRSLASTSTTNQSPFEILALPAPPSSSSSKARVP

SEQ ID NO: 42709 - DNA, 629 bp, Panicum virgatum
  misc_feature: Ceres CLONE 2013150-R
tgcaaccggttggtggcacacagctggggcctccacagccacagcctatgcagttgaacatgcagtacggtctaatgcacccttctatgcaaatgaaccaaggaatggtcatgtatccccagcaggcatttggaggaggatattatgggatgaaccaacagcagctgtatggtgttcagatatctggtaatggatatggccaaccatctgggggctactatattccaaacgctgcatatgcatatgctagcgcaaatgagctttcccagaggatgaacagcctttcagttcaaaatggtggttcaaatggaacgacagcaaataagcagagcagaccggaagattcacttttcggtgatcttttgagcattgccaaaatgaagcagagcaaacctgcagctggtaaggttggcggctgataggggcaagtgagtggatacataggctcaccttatttgaaagcttcagaagcatttccttatagtacataattcttttgccactttttgagaaattgccagatagcttatcagtgtcatctcatctgagtaggaattcatattggaaattaaagattgtgctatttggtatacttatggcaatgcctcatagaaagagtgtttatatgg

SEQ ID NO: 42710 - DNA, 443 bp, Panicum virgatum
  misc_feature: Ceres CLONE 2013161
  misc_feature: Encodes the peptide sequence at SEQ ID NO. 42711
acggctcttttaggcggaccgtcaaccggcgcaacgggtcaaaacacacaccaaaacctaaggcggcgggggcggcggcgcggcagcaaggcggagcacgcacctaccccgcgccgcgtccaccccatggcggcgcatccagccacgtcctccgcgccgtcccggagcctctccggcgcgcggccgcgctgcgccgcgccccgcagccccagctcgctcgccgtcgcggcgcctccggccgggctccggccatgcagcagccgcgccctccgcgtccgcgctaaggttgccagtggcgtgcagggtgccagcgtggtggacgatggagtggagaggccgtggaaactgagagatgctcgccttgttctggaagatggttctgtctggaaggccaagtcttttggtgcttcagggacgcaagttggtgaagttgttttcaacac

SEQ ID NO: 42711 - protein, 105 aa, Panicum virgatum
  misc_feature: Ceres CLONE 2013161
  misc_feature: SWISSPROT Homolog: EC 6.3.5.5 Carbamoyl-phosphate synthase (glutamine-hydrolyzing)
MAAHPATSSAPSRSLSGARPRCAAPRSPSSLAVAAPPAGLRPCSSRALRVRAKVASGVQGASVVDDGVERPWKLRDARLVLEDGSVWKAKSFGASGTQVGEVVFN

SEQ ID NO: 42712 - DNA, 1808 bp, Panicum virgatum
  misc_feature: Ceres CLONE 2013165
  misc_feature: Encodes the peptide sequence at SEQ ID NO. 42713
aagcttcgatctttatagtatagattctttgtgctaaccttgatttggccttacaaaagcttcccaccgatttaccaaattctcagaaacaagcatctccggcgacggtcgagatgtcgcacaccggccgttagcgtcgcgcccctcgacaaccgcggtatggaggtggaggctggtggcgccgccggtgtccatgctcgaagtcgctcgtcagaggctgcagagccacccaagccgctggttgacgacgacggacggccgcggcgcaccggcacgctgtggacggccagcgcgcacatcatcacggcggtcatcggctccggggtgctctcgctggcgtggggcgtcgcgcagctgggctgggcggcaggccccgccgtgatggtgctcttcgccgccgtcatctgctacacctccaccctcctcgccgagtgctaccgctccggcgaccccgtgttcgggccgcgcaaccgctcctacatcgacgccgtgcgcgccacgctgggcgagtccaaggagaggctctgctgcgccatccagctctccaacctcttcggcatcggcatcggcgtctccatcgcggcgtccgtcagcatgcaggcgattaggagggcgggctgcttccactacagagggcacgatgacccgtgccacgcctccaccagcccgtacatcgccatcttcggcgtcatgcaggtcgtcttctcgcagatcccggacctagacaaggtatggtggctctcaattgtcgccgccatcatgtccttcagctactccaccatcggcgtctccctcggcgtcgcggagatcgtagcgaacagagagctaaggggcagcctcgccggcgtcatcagcaccggcgccaccggggtgaccctgatgcagaaggtctggcgcaacctgcaggcctttggaaacatcgcgttcgcttacggtttctctatcattctgctcgaaatccaggacacgataaagtcgccgccgccgtcggaggctgcggtgatgaagaaggcgacggcggtgagcgtggcggtgaccaccgtgatctacctgctgtgcgggtgcgtggggtacgcggccttcggcggcgcggccccggacaacatgctcacgggcttcggcttctacgagcccttctggctgctggacgcggcgaacgccttcgtcgtcgtgcacctggtgggcacctaccaggtcatgacccagccggtcttcgcctacgtcgagggccgggcgtccgccgcgtggcccggcggcgcgctggtccgcgagacggacgtcagggtcaggctgggccgccgggccatggcgttctccgtgagcccgatccggctggcctggcgcacggcgtacgtgtgcgtgaccacggcggtggcgatgctgctgcctttcttcggctccgtggtgggcttcatcggggccgtctccttctggccactcaccgtctacttccccgtggagatgtacatcgcgcaccgcggggtggcgcggggaagcacgcggtggctgctcctgcaagcgctcagtgctggctgcctcgtcgtgtccgtcgcggctgcggctgggtcgatcgccggcgtcgtggaagagctcaaggcgcacaacccgttctgctggtcgtgctgacccaacagctcaatgggcgatctgagtcctcaccgcgagaatatatatatcctagtatatgttttagccttctcgctaccggaaaccagcactttgccgagtgcttagtaggttgccgagtgttttttttcggactgcaaccttgcagccagtttcgacataaaaatattgtggttgagact

SEQ ID NO: 42713 - protein, 488 aa, Panicum virgatum
  misc_feature: Ceres CLONE 2013165
  misc_feature (36)..(476): Pfam Name: Aa_trans Pfam Description: Transmembrane amino acid transporter protein
MEVEAGGAAGVHARSRSSEAAEPPKPLVDDDGRPRRTGTLWTASAHIITAVIGSGVLSLAWGVAQLGWAAGPAVMVLFAAVICYTSTLLAECYRSGDPVFGPRNRSYIDAVRATLGESKERLCCAIQLSNLFGIGIGVSIAASVSMQAIRRAGCFHYRGHDDPCHASTSPYIAIFGVMQVVFSQIPDLDKVWWLSIVAAIMSFSYSTIGVSLGVAEIVANRELRGSLAGVISTGATGVTLMQKVWRNLQAFGNIAFAYGFSIILLEIQDTIKSPPPSEAAVMKKATAVSVAVTTVIYLLCGCVGYAAFGGAAPDNMLTGFGFYEPFWLLDAANAFVVVHLVGTYQVMTQPVFAYVEGRASAAWPGGALVRETDVRVRLGRRAMAFSVSPIRLAWRTAYVCVTTAVAMLLPFFGSVVGFIGAVSFWPLTVYFPVEMYIAHRGVARGSTRWLLLQALSAGCLVVSVAAAAGSIAGVVEELKAHNPFCWSC

SEQ ID NO: 42714 - DNA, 711 bp, Panicum virgatum
  misc_feature: Ceres CLONE 2013173
  misc_feature: Encodes the peptide sequence at SEQ ID NO. 42715
taaggaagattaccggaaaatggaggagctgaaaaaacaggcagaagcagccgatgttgctaaatctcagttccttgcaactgtttctcatgagatcagaacgcccatgaatggtgtcctaggaatgcttgacatgctgttagacacagacctgaagtcaacccagagggattatgcacaaaccgctcaagtctgtggaaaggctttaatctccctgatcaatgaagtgcttgacagagcgaaaattgaagctggaaagttggatcttgagtctgtaccatttgatctgagatccatccttgatgatgtcatttcgctattttcttcaaagtcaagagagaagggaattgagcttgctgtatatgtctcggaaagagttcctgaaatattgttgggtgatcctggaaggtttcgacagataatcacaaatctagtgggtaactcaattaagttcacagagcagggacatatttttgtacaagttcatctagcagatcactcaaatcttgcaacagaagccaaagttgaaccagttgcaaatgggatgaatgggcacaaaaatgagacgactgctgtagcaaccagtgtttcttgcaacacattaagtggttttgaagctgctgatagccgaaataattgggaaaacttcaagcttttgctttcttatgagaaaaatgagatgccgtatgaaagtgtatctgataaagtgac

SEQ ID NO: 42715 - protein, 236 aa, Panicum virgatum
  misc_feature: Ceres CLONE 2013173
  misc_feature (20)..(85): Pfam Name: HisKA Pfam Description: His Kinase A (phosphoacceptor) domain
  misc_feature: SWISSPROT Homolog: EC 2.7.13.3 Histidine kinase
  misc_feature: The sequence is a functional homolog of SEQ ID NO 5 in US patent 7026530
KEDYRKMEELKKQAEAADVAKSQFLATVSHEIRTPMNGVLGMLDMLLDTDLKSTQRDYAQTAQVCGKALISLINEVLDRAKIEAGKLDLESVPFDLRSILDDVISLFSSKSREKGIELAVYVSERVPEILLGDPGRFRQIITNLVGNSIKFTEQGHIFVQVHLADHSNLATEAKVEPVANGMNGHKNETTAVATSVSCNTLSGFEAADSRNNWENFKLLLSYEKNEMPYESVSDKV

SEQ ID NO: 42716 - DNA, 1385 bp, Panicum virgatum
  misc_feature: Ceres CLONE 2013201
  misc_feature: Encodes the peptide sequence at SEQ ID NO. 42717
atcatcattgttgaattggacctacccaaccaaacttcgcgtcgcttgacaaccatttgccctccccactgccataggcattagcgtcgtgggatttcgctttcctctttcgccctcaattccatatccatctttcacaactaacggaaccatggctactatcccgacaggccgcgtggggtcgtcctcgacaccaataccagccgactcgtcactgtgggatcgcatctcgacatgggtctccgagaacaaggctgtggtttataccgttgccggtgtcgcctttgtagtcacaactgccggtgctgtctactatgtccgcaacgcccctagccaggacacaacccccaagctcagcaagaaagagagacggaaacggaagcaggctggaaaggatgtcgatgtcgagaaggtcgcaaaggacgccacatctcccgcggccgctggcaaagctgcttctgttgaatccgccgacgagttacccgagatcgacgaggcctttgttctcggtctctccgacaccgagcgcgagcagtattctcaaaagttgaaggaggctggcaacagggcctacggcgccaaggatttcgaaaaggccattgggctttattcgaaggccatactctgcaagcccgacccggtctactactccaatcgagcggcctgctacaacgccctcagcgactgggacaaagtcgtcgaggacactaccgcggctatcaacctcaaccccgagtacatcaaggccctcaaccgccgtgctaatgcctacgaccacttgggtaggtacagcgaggcgcttctcgacttcaccgccagctgtatcatcgacggcttccggaacgaacagagcgcacaggccgtcgagcggctgctcaagaaattcgccgagacgaaagcaaaggaaattctcgagaccaagccgtcaaagctcccgagctctacctttgtcgggaactacctccaaagcttccgccaaaaaccccgtcctgacggcttggaagactcggaggagttggatgaggagtccggaccgggtcagctgcagaaagggttaaaggcgttggagagcaagactgggccgggttacgaagaggcttctgaggcgttcgacagggccttggagctcggcgacctcgatgaatatgaagcatacgcctacaacctccgcggaaccttccgttgtctgaagggcaagcacgaggaggcgctggcggatttgtccaagagcatcgagttggaccctgagatgacccagagctacatcaaacgggcgagcatgaacctggagcttggttcccccgagaaagctgaggaggattttgccgccgccctgtccaagaacccagaggaccctgacatctactaccaccgggctcagctgc

SEQ ID NO: 42717 - protein, 411 aa, Panicum virgatum
  misc_feature: Ceres CLONE 2013201
  misc_feature (163)..(196): Pfam Name: TPR_1 Pfam Description: Tetratricopeptide repeat
  misc_feature (334)..(367): Pfam Name: TPR_1 Pfam Description: Tetratricopeptide repeat
  misc_feature: SWISSPROT Homolog: EC 3.1.3.16 Phosphoprotein phosphatase
MATIPTGRVGSSSTPIPADSSLWDRISTWVSENKAVVYTVAGVAFVVTTAGAVYYVRNAPSQDTTPKLSKKERRKRKQAGKDVDVEKVAKDATSPAAAGKAASVESADELPEIDEAFVLGLSDTEREQYSQKLKEAGNRAYGAKDFEKAIGLYSKAILCKPDPVYYSNRAACYNALSDWDKVVEDTTAAINLNPEYIKALNRRANAYDHLGRYSEALLDFTASCIIDGFRNEQSAQAVERLLKKFAETKAKEILETKPSKLPSSTFVGNYLQSFRQKPRPDGLEDSEELDEESGPGQLQKGLKALESKTGPGYEEASEAFDRALELGDLDEYEAYAYNLRGTFRCLKGKHEEALADLSKSIELDPEMTQSYIKRASMNLELGSPEKAEEDFAAALSKNPEDPDIYYHRAQL

SEQ ID NO: 42718 - DNA, 652 bp, Panicum virgatum
  misc_feature: Ceres CLONE 2013201-R
ccccacatccaactcggcgtgactcagtacaagacgggctcgattgcctcatccatggccactttccgccgctgcatgaagaactttgagaagactcctgacgtctacaactactacggcgagctgctcctcgatcaagataagcaccacgaggccattgagaagtttgacatggccattgaactcgagcgcgagaccaagcccacgtgcatgaacgtgctaccgctcattaacaagtccctcgccgtgttccaatggaagcaggacttctccgaggctgagaagctctgcgagaaggctcttatcattgaccccgagtgcgatattgccgtcgccaccatggctcaactgctcctccagcagggcaaggtgaccgaggccctcaagtacttcgagcgtgccgccgagctggcccgcactgagggcgagctggtcaacgctctttcatatgccgaggctacccggacacagatccaggtccaggagaagtaccccaagctggctagcaagttgcagggtatgggtcagggccaggctatgatgcggtaaacatcgcgttcatgaatgaacttgacgacccgaggtgatcaaccacgcggtcagtccgtgcatcaagccggacttgctagcctaggatcagtttgggtcgtgt

SEQ ID NO: 42719 - DNA, 680 bp, Panicum virgatum
  misc_feature: Ceres CLONE 2013209
  misc_feature: Encodes the peptide sequence at SEQ ID NO. 42720
gaaaaaaaatcgaggctcggctcgattcctcccctgaccctaagcccccttcctccgcccccccccccccccgcccatctcgccgtggcttccagcgattggagacgaagacgcggccatggcggccctcctcaggcgcgtgtcgctgcggcgcgccttcgccgccgccgcttcttcttcttctcaccctgagagctacacgcaagggatctgtggctccacgtttcattacagagagttcacatctaaagccaaaaagaagtcaaagtcaagtggaactgactctggtgaggagaatatgtcgaagaaagacttggcattataccaggctatcgaccaaataacatcggcatttgggaagggggcaataatgtggcttgggcgttcacaaggccatagagatgtacctgtaatatccactgggtctttcgcattggatatggctctaggaactggtgggcttccaaaggggcgtgtcatagaggtttatggcccagaggcttcaggcaagacaactcttgctctacatgtcattgcacaagcacaaaagaatgggggttactgtgcctttgtagatgcagagcatgctttggatccagctcttgcggagtcaattggcgttgacactaacaatttacttctttctcagccagactgtgctgagcaggcactcagtcttg

SEQ ID NO: 42720 - protein, 187 aa, Panicum virgatum
  misc_feature: Ceres CLONE 2013209
  misc_feature (66)..(187): Pfam Name: RecA Pfam Description: recA bacterial DNA recombination protein
MAALLRRVSLRRAFAAAASSSSHPESYTQGICGSTFHYREFTSKAKKKSKSSGTDSGEENMSKKDLALYQAIDQITSAFGKGAIMWLGRSQGHRDVPVISTGSFALDMALGTGGLPKGRVIEVYGPEASGKTTLALHVIAQAQKNGGYCAFVDAEHALDPALAESIGVDTNNLLLSQPDCAEQALSL

SEQ ID NO: 42721 - DNA, 666 bp, Panicum virgatum
  misc_feature: Ceres CLONE 2013211
  misc_feature: Encodes the peptide sequence at SEQ ID NO. 42722
gatttcagaatacccttgagtggatccttcgacggtggagttccatttggagcgaaccaagatattggtgtatggccaggagatttggggcatttgaagaaacatgaaggatctaatgctcagccacaagaaactatacctgggggtacaggtttaagtggaaaacatatttcagggttctaccaggaattccaaattataaaatcagagtacactcagaactttgtaactgttactgtgaagagggataataaaacacataaaaggcttgtggaatttgacactgatattcctggagaagttatccttcattggggagtttgcagagataataacatgacatgggagatcccgccagaaccacatccaccgacaacgaaaatcttccgacagaaagctcttcagaccttgctacaggcaaaagctgatggaagaggcaattctctatcattcttactagatgcagagtattctggtctgttttttgtgctcaaacttgatgagtatacttggttgagaaatctggacaatggatccgatttcttcatttctcttacaagaatggaagaacgtggaagcatccaagatcttggtaaggttgagccacaaaaatttgatgagccttcacaaactgatggtataatcagtgatataagaaatctggtg

SEQ ID NO: 42722 - protein, 221 aa, Panicum virgatum
  misc_feature: Ceres CLONE 2013211
  misc_feature: SWISSPROT Homolog: EC 2.7.9.4 Alpha-glucan, water dikinase
DFRIPLSGSFDGGVPFGANQDIGVWPGDLGHLKKHEGSNAQPQETIPGGTGLSGKHISGFYQEFQIIKSEYTQNFVTVTVKRDNKTHKRLVEFDTDIPGEVILHWGVCRDNNMTWEIPPEPHPPTTKIFRQKALQTLLQAKADGRGNSLSFLLDAEYSGLFFVLKLDEYTWLRNLDNGSDFFISLTRMEERGSIQDLGKVEPQKFDEPSQTDGIISDIRNL

SEQ ID NO: 42723 - DNA, 1760 bp, Panicum virgatum
  misc_feature: Ceres CLONE 2013215
  misc_feature: Encodes the peptide sequence at SEQ ID NO. 42724
actggtatactgtatgtctggatcgttcctgccaccaaccactccttcccgagctgccatagcataccgcgcggagctcaggggcgctggcccccataaatcacggcatcacgctgcggattcttttttttttatgactatcacgctgcggattctttgccttgtgcttcgcagctgctagttcggagcacccgctgctgcaacgtcctcgccggctgacaggagcttaccggtggggcacacgggccggcgatggctccgatcaccgaggcgcgctggtcagcgcctcctcctcgcctccggctgccgccaccgacctgcgccgacggagtcgccgccgccgccgccgcctcctcctccttcagctgcagatatcgccgccgcctcgtcgccctcctccgccccccgatggccgccgccgacccgccgccgcgcgggggtgccgcggcccccgcgcccgtgctgcggcggagccccagcatcgagcgcatcccggaggacgcgcgccgcatcctgctccgcctggccggcgagctctggggcggcgacgtggacccgggcgcgctcgccgtgtcccagctcaagggcgccatgaccaacgaggtcttccggatcacctggcccggcggcgagggcgacccgcggaaggtgctcgtgcgcatctacggccagggcgtcgaggtcttcttcgaccgcgccgacgaggtccgcaccttcgagtgcatgtcgcgccacggccaggggccccgcctcctcggccgattcgccaacggccgcgtggaggagttcatcaacgccaggacgctgtctgcggcggatctgcgcgacccggagatatcagcgctgatagccaagaagctgagggagtttcacgatctcgacatgcctggacccaaggatgtctcgttgtggcataggctctggcatgcattttttatgccaccttctcttatcatggcgagaaatgtgagtgattgctgatcagaggctgatttacttgtttgaatcaggaggtggcttgagcaggctcgtgtcaggtgttccgaggaagagtccaaacaatttcagctgaataagcttggcgatgagattgcgttgctggagaaggtgctgtcagggttcaatcagtcagtaggattttgccataatgatctgcagtatgggaatattatgatatatgaagagaccagacaagtcaccctgattgactacgaatatgccagttttaaccctgttgcatttgacattgctaatcacttctgtgagatggctgctgattaccatacatcaacacctcatgtgctggactttgcaaaatatcctgacattgaggagcagcgaagatttgtttggacataccttagctcttcaggtgaaaatccattggatgaggaagttgaaaacttactaggcttgattgcaaagtatactcttgcaagccatctcttttggggcctttggggaataatctcggcgcacgtgaacaaaaacatcgacttcgagtacatggagtatgcaaggcaacgcttcgatcagtactggcagacaaagcctagaatacttggatccaactgatgattagccaattctttttgttgttttacgggctcttggctagctagtcgctagctagtcctgtgaattctattcttcagtagcgtctagttgctgcccgttctttgctgctgatttttcagctcgttctgtaagtttttaattataatgtatttaaccgataatgcaagcaatgcgattgacat

SEQ ID NO: 42724 - protein, 190 aa, Panicum virgatum
  misc_feature: Ceres CLONE 2013215
  misc_feature (77)..(187): Pfam Name: Choline_kinase Pfam Description: Choline/ethanolamine kinase
  misc_feature: SWISSPROT Homolog: EC 2.7.1.32 Choline kinase
MAAADPPPRGGAAAPAPVLRRSPSIERIPEDARRILLRLAGELWGGDVDPGALAVSQLKGAMTNEVFRITWPGGEGDPRKVLVRIYGQGVEVFFDRADEVRTFECMSRHGQGPRLLGRFANGRVEEFINARTLSAADLRDPEISALIAKKLREFHDLDMPGPKDVSLWHRLWHAFFMPPSLIMARNVSDC

SEQ ID NO: 42725 - DNA, 723 bp, Panicum virgatum
  misc_feature: Ceres CLONE 2013217
  misc_feature: Encodes the peptide sequence at SEQ ID NO. 42726
acagctgtcagctcttctccttctccaagccagcaccaatagcagcaaaagcacagcaccaatagcagcaaaagcccagagaagacaaccgttccccctcccctccggcggcgagagatcgacgagcgcgcgagatggtgctgtctcatggcgtcggcggctccgatgagtccgtgcactcgaccttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggagcccgagtgcgacaagctcatccaggcctccgtcaacaagaactacgtcgacatggacgagtaccccgtaaccaccgagctccagaaccggtgcgtgaacatgatcgctcatctgttcaacgcccccctcggggagtctgaaactgccgtcggagtcggcaccgtcggctcgtccgaggccatcatgctcgccgggctggcgttcaagaggcgttggcagaacaagatgaaggccgccggcaagccctgcgacaagcctaacatcgtcactggggccaatgtccaagtttgctgggagaagttcgcgcgctacttcgaggtggagctgaaggaagtgaagctgagtgacggctactacgtcatggacccgcagaaggccgtgg

SEQ ID NO: 42726 - protein, 196 aa, Panicum virgatum
  misc_feature: Ceres CLONE 2013217
  misc_feature (33)..(196): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Functional homolog of the protein sequence given in SEQ ID NO 50492
  misc_feature: Useful for making plants with modulated nitrogen use efficiency
MVLSHGVGGSDESVHSTFASRYVRASLPRFRMPEQSIPKEAAYQIINDELMLDGNPRLNLASFVTTWMEPECDKLIQASVNKNYVDMDEYPVTTELQNRCVNMIAHLFNAPLGESETAVGVGTVGSSEAIMLAGLAFKRRWQNKMKAAGKPCDKPNIVTGANVQVCWEKFARYFEVELKEVKLSDGYYVMDPQKAV

SEQ ID NO: 42727 - DNA, 666 bp, Panicum virgatum
  misc_feature: Ceres CLONE 2013223
  misc_feature: Encodes the peptide sequence at SEQ ID NO. 42728
gggcgcccccccaggtccgccaacaagggaaaccttgagttcaccccgacaaccttgacttcttccttcttctcttcttcggttaaacctggttactccgccaccaaaacccccgttcccttcgccaacggttggccccccccggccccagccacaacccgcgccgccgccccccaattcgccctgggcctctccgccgccgccgtcaaagcgagccccagggggggccgcctccgcgggctggcccgccccttcggggggtttcagcagcggccgccggggggggggcccgagtacttccccaaccgcttcgacaaccccaattacttccgcttcttcaacaccacgttcgggaacggcaagcagtcccccggggccaccttgaccagggccaagaagttcgtcggggcccgccagttcgcccgcttcggcgtcaacttcttcaaggccggtttcccggcctcttcccccaacaacttcaaggccgggcgctccttcgccttcaaggtcgggaacgcgcccgtcgggaaggacggccacttgcccttcttctgcggcttctcggggggcaacaggaaggacttcaacgccgcagggaaggccgtcaggaaggcgcgccggccgcgaattcacaccttcttcgccacaaggaagatcaacttgagg

SEQ ID NO: 42728 - protein, 221 aa, Panicum virgatum
  misc_feature: Ceres CLONE 2013223
  misc_feature: SWISSPROT Homolog: EC 2.3.3.13 2-isopropylmalate synthase
GRPPRSANKGNLEFTPTTLTSSFFSSSVKPGYSATKTPVPFANGWPPPAPATTRAAAPQFALGLSAAAVKASPRGGRLRGLARPFGGFQQRPPGGGPEYFPNRFDNPNYFRFFNTTFGNGKQSPGATLTRAKKFVGARQFARFGVNFFKAGFPASSPNNFKAGRSFAFKVGNAPVGKDGHLPFFCGFSGGNRKDFNAAGKAVRKARRPRIHTFFATRKINL

SEQ ID NO: 42729 - DNA, 727 bp, Panicum virgatum
  misc_feature: Ceres CLONE 2013227
  misc_feature: Encodes the peptide sequence at SEQ ID NO. 42730
aagcgctagttgcaacttgcaagagcagagcaagcgacccaaattccctgagattttgctagatctcgagttcgcctgctagtttcgattccttcttctcctcctcccgttcgagcaagcgattccggtggcaatggccaagggcgagggaccggcgatcgggatcgatctcggcaccacctactcgtgcgttggcgtgtggcagcacgaccgggtggagatcatcgccaacgaccaggggaaccgcaccacaccgtcctatgtcgcctttaccgacaccgagcggctcatcggcgacgccgctaagaaccaggtcgccatgaaccccaccaacaccgtcttcgacgcgaagcggttgattggcaggaggttctctgacccatcagtgcagagtgacatgaagctgtggccgttcaaggtcatccctggccctggtgacaagcccgtgattgttgtcaactacaagggcgaggagaagcagttcgccgccgaggagatctcctccatggtgctcatcaagatgagggagattgctgaagcctacctcggcaccacaatcaagaatgctgtggtgacagtgccggcctacttcaacgactcgcagaggcaggccaccaaggacgccggtgtcattgctggcctcaatgtcatgcgtatcatcaacgagcccacagctgctgctattgcctatggtcttgataagaaggccaccagtgctgggagagag

SEQ ID NO: 42730 - protein, 197 aa, Panicum virgatum
  misc_feature: Ceres CLONE 2013227
  misc_feature (8)..(197): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPGDKPVIVVNYKGEEKQFAAEEISSMVLIKMREIAEAYLGTTIKNAVVTVPAYFNDSQRQATKDAGVIAGLNVMRIINEPTAAAIAYGLDKKATSAGR

SEQ ID NO: 42731 - DNA, 633 bp, Panicum virgatum
  misc_feature: Ceres CLONE 2013236
  misc_feature: Encodes the peptide sequence at SEQ ID NO. 42732
gcaaggcacactcctctcctctcctgctgcagtcccactagccatggatccaaccaaggtacaagccatcctggcatgtttcttattagtattaactaattattaatctctagctagctagtagtagtatttcgtagctagaaatggaattgtatactagctaatcgatggttgcattgcatacggcggcatgcagttccggccgtcgagcgcgcacgacggcggcgtgacgacgacgaacgccggcgcgccggtgtggaacgacaacgaggccctgacggtgggcccgcgcgggccgatcctgctggaggactaccacctgatcgagaaggtggcccacttcgcccgcgagcgcatcccggagcgcgtggtccacgcgcgcggcgcctccgccaagggcttcttcgagtgcacccacgacgtgtcggacctcacctgcgccgacttcctccgcgcccccggcgcccgcacgccggtgatcgtccgcttctccacggtgatccacgagcgcggcagcccggagacgatccgcgacccgcgcgggttcgccgtcaagttctacacccgggagggcaactgggacctgctgggcaacaacttccccgtcttcttcatccgcgacggcatcaagtt

SEQ ID NO: 42732 - protein, 147 aa, Panicum virgatum
  misc_feature: Ceres CLONE 2013236
  misc_feature (15)..(147): Pfam Name: Catalase Pfam Description: Catalase
  misc_feature: SWISSPROT Homolog: EC 1.11.1.6 Catalase
MQFRPSSAHDGGVTTTNAGAPVWNDNEALTVGPRGPILLEDYHLIEKVAHFARERIPERVVHARGASAKGFFECTHDVSDLTCADFLRAPGARTPVIVRFSTVIHERGSPETIRDPRGFAVKFYTREGNWDLLGNNFPVFFIRDGIK

SEQ ID NO: 42733 - DNA, 634 bp, Panicum virgatum
  misc_feature: Ceres CLONE 2013240
  misc_feature: Encodes the peptide sequence at SEQ ID NO. 42734
actaggcactagcagctcaagctcagctgtgggcacggtcgcgcgcgtcttctgatcgaagaagcgcggcgcctccccccggccggtcgtctcgcgtctcttctactgcctcctccctccactttcacagtttcactccggcactccgcctttcccattcccgttgaaacgagccaaacagatcaaaagcagagcgagaaatacagaggaaaaaaaacaaattccgccgctcccgaggcacgtcgccggcgactgggcgagagggagacccctccggctctgctccgccgaggcgacgcccgtgcaccggccgcgcccgcggatgcgcggcgagggcccggcggtccacgctcgtagccagatctgagggaagggcgctgctgggaagcggcaggaggtggtggtgtgggattcattcagcccccggcggggatggggtggtccgtagggctgtgctggtggctcgtggcggcggcggcggcgtgggcggtggcggcggcgacgggggcagcggagggggaggtcggcgcggtggcgggggcggcggcgccgaggcggcacgcgtacgcggcgatgatgtacatgggcacgccccgggactacgagttctacgtcgccacgcgcgtcatgatgc

SEQ ID NO: 42734 - protein, 67 aa, Panicum virgatum
  misc_feature: Ceres CLONE 2013240
  misc_feature: Functional homolog of the protein sequence given in SEQ ID NO 51656
  misc_feature: Useful for making plants with altered carbohydrate content
MGWSVGLCWWLVAAAAAWAVAAATGAAEGEVGAVAGAAAPRRHAYAAMMYMGTPRDYEFYVATRVMM

SEQ ID NO: 42735 - DNA, 569 bp, Panicum virgatum
  misc_feature: Ceres CLONE 2013240-R
  misc_feature: Encodes the peptide sequence at SEQ ID NO. 42736
ctttggtgatgtctttcccttggtatctaaatggtgtcgtcagggccttggtggtgtttgcgtacgcattctgctgcgcacccttggtctgggcatctttggtcaagacaatgagcttcttacaggttctggttgagagggacgcattcaggcttggagaacctaaccagaacgccgagttcacgaagctgtactgaggtgggaagtgcagatacatatgattgatcacttcagttgtggttcagtttgaacagctaatctccattgacgttggcaattctgatggccaatttagttgtacaagtaaaactgcaggatgcgggaactagagttgttgtacctttggaaccacctggaaacctctggaacccgttattgttatcttgacatgtaggtgatatacaaggggggaaggaggggtagaggaactgcagaggaaatgaccgagggacaatttttggttatttgacttactgttcctctgaaaagccaacacaatttttggctttgctgtaattgatatgatcagttccataaccattaccaatcaagagaagggttcaaagttc

SEQ ID NO: 42736 - protein, 64 aa, Panicum virgatum
  misc_feature: Ceres CLONE 2013240-R
  misc_feature: Functional homolog of the protein sequence given in SEQ ID NO 51656
  misc_feature: Useful for making plants with altered carbohydrate content
  misc_feature: Functional homolog of the protein sequence given in SEQ ID NO 51657
  misc_feature: Useful for making plants with altered cell wall content and/or composition
LVMSFPWYLNGVVRALVVFAYAFCCAPLVWASLVKTMSFLQVLVERDAFRLGEPNQNAEFTKLY

SEQ ID NO: 42737 - DNA, 674 bp, Panicum virgatum
  misc_feature: Ceres CLONE 2013264
  misc_feature: Encodes the peptide sequence at SEQ ID NO. 42738
atccgtgctccgtctcctcccagctgcgccctgctgccatgcgcgtgccatggaaaggcgccgaggacccctcctcctgctaatactaccacgacgcagccaccattcttgcccttacaccccggagctagctagctactgccgaacgtctcactgtcgcgcgtctctcgctgtcgtatagcttgccccggcggcaagcgtacatggaccgggaggggctttacgggggccgcggcgagggcaggctcgagggccaagctgctgacttcgcacggccgcagcagcagcagcagcggcggcggcggcagatggagtgcttctctgacgaggcgaacagccgggacggcgaggaggaggaggccaacaacggcggcggcccgcaggcggtggcgaccccggtgggaggtggaggcgacggggccagcgtggagacggggaagcggaggcgggggcgcccgccggggtccaagaacaagccgaagccgccgccggtggtgacgcgggacgtggagcccgcggcggccatgcggccgcacgtgctcgaggtccccgccggcggggacgtcgcccgcgcgctcgcgggcttcgcgcgccgccgcggcctcgggatctgcgtgctcgcggggacgggcgccgtcgccgacgtgccgctccgccacccgtcgccgcccccc

SEQ ID NO: 42738 - protein, 156 aa, Panicum virgatum
  misc_feature: Ceres CLONE 2013264
  misc_feature: The sequence is a functional homolog of SEQ ID NO 1407 in the 10/374,780 US patent application
  misc_feature: The sequence is a functional homolog of SEQ ID NO 20 in the 10/669,824 US patent application
  misc_feature: The sequence is a functional homolog of SEQ ID NO 20 in the 10/870,198 US patent application
  misc_feature: The sequence is a functional homolog of SEQ ID NO 356 in the 11/435,388 US patent application
  misc_feature: The sequence is a functional homolog of SEQ ID NO 358 in the 10/714,887 US patent application
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
MDREGLYGGRGEGRLEGQAADFARPQQQQQRRRRQMECFSDEANSRDGEEEEANNGGGPQAVATPVGGGGDGASVETGKRRRGRPPGSKNKPKPPPVVTRDVEPAAAMRPHVLEVPAGGDVARALAGFARRRGLGICVLAGTGAVADVPLRHPSPP

SEQ ID NO: 42739 - DNA, 722 bp, Panicum virgatum
  misc_feature: Ceres CLONE 2013267
  misc_feature: Encodes the peptide sequence at SEQ ID NO. 42740
tcgctgctgttccttggttggtctccttggatctctgactccagccttttcccccacaatctctagttcatagttcttctgcttcgaaggggggatgggtagcttcgcgaagctggcgaggagggcggtggagacggacgcgccagtcatggtgaagatacaagaactgcttcgaggggccacggacgtgatgtcgcttgcccagggagttgtttactggcaacctcctgagtcagctatgaataagattgaaaaaatcatcagggaaccagcagtcagtagatatggttctgatgatggacttcctgaacttcgtgaagcacttctcgaaaagctacgcagagagaataagcttaccaagtcatcagttatggtcactgctggtgcaaatcaggcttttgtgaacttggtcctcactctttgtgatgctggtgattccgttgtcatgtttgcaccatattatttcaatgcctacatgtcattccagatgacaggtgttactgacatattagttggtgcttgcgaccccaagacacttcatcctgatgttgattggttggagaaggttctgaaagaaaatggacctatccctaaacttgttactgttgtgaatccggggaatccctctggagcttttattcccaggcctatgcttgagagaatttcagatctttgcaaaaatgctggtgcatggcttggtgttgacaatacctatgagtact

SEQ ID NO: 42740 - protein, 209 aa, Panicum virgatum
  misc_feature: Ceres CLONE 2013267
  misc_feature: SWISSPROT Homolog: EC 2.6.1.1 Aspartate transaminase
  misc_feature: Functional homolog of the protein sequence given in SEQ ID NO 50929
  misc_feature: Useful for making plants with modulated nitrogen use efficiency
MGSFAKLARRAVETDAPVMVKIQELLRGATDVMSLAQGVVYWQPPESAMNKIEKIIREPAVSRYGSDDGLPELREALLEKLRRENKLTKSSVMVTAGANQAFVNLVLTLCDAGDSVVMFAPYYFNAYMSFQMTGVTDILVGACDPKTLHPDVDWLEKVLKENGPIPKLVTVVNPGNPSGAFIPRPMLERISDLCKNAGAWLGVDNTYEY

SEQ ID NO: 42741 - DNA, 1702 bp, Panicum virgatum
  misc_feature: Ceres CLONE 2013275
  misc_feature: Encodes the peptide sequence at SEQ ID NO. 42742
gtttctgtctcgcgcacccaacagcgaacacttccccacgaaatcctgcaacagccggtacctctgttcacccccgtcaatctccggcgaagtactaaccacacctgcaatggcgggttaccaaactagccttgtggctgagccacagttgctgaacaacgagatcatcactcagaaggccactaataaatttgtttctgacaccgccacaaaagacaaatccattggctacttggatgtgtttgtacatcaggcacgcgatatccacaatgtttgtatctaccacaagcaggatgtgtatgcaaagctgtgccttacaagcaacccagatgtttcatgctcaaccaaggtaattaacagtgctgggtgcaacccagtattcgaagaaagcctacggcttgacgtgcagactgtggacgcttcactcaaatgtgagatatggatgttaagcagagtgaggaactaccttgaggaccagctccttggctttgcccttgttcctctggcagacatcgtaatgggtaatgggaagctggtccaggagttctccctgacatccactgagctgttccacacacctgctggttttgtgcagctgtccttgtcatatgctggttgttccccagatgtcatcctcatctcatcacccgataaatcagtgtcaagagtggccgattctggaaatgattgtgcagttccttctcagcttgaaaagatcgagttcccagacctaaatgttgtgaaggaggatgaggttatggtctccaagtatctcgagatggggtctttggattctgagaaccctataaaaactgagaatggcaagttgctgctttctggaaatgataacgatattccttctgaatttgggaaggtcgacttaccagactccgagaaccctgtaaaagccgagaatggcaagttactgcagttcggtgcagctgtgcctggtactgcaatgtgtggagataagctggaggaacatcaggatgaaagccctctaagttgtgtctcaaccacaggttcctccactgccctttctgcaacacgacaatcagtttctgagccaagttctgaaccttcagagaccactgttgaggcatctccaagacaaagacagaaggagaaaagccaagatgttactgatggtgaggctaattcttctgaagcaccacccagggatgaagttgtcaagcctatgatcagcattaatcttcagccagagcagtcagttgtccaacaggacatagttgacatgtacatgaagagcatgcaacagttcacagaatctcttgcaaaaatgaagcttccgttggatgttgagaatagtagtctctcaaatgatgtctctgactccagtacaattgagaagccatccccatccccatcatcatccgtgtcaaagggttctagggtcttttatggaagcagggccttcttttaagtttctggtgcaaagtagcgctagctcatctcctatatatatggttcaggtttgttaggtattggctagcatgtattgacatacttttctgtcgccgcaatatactgctaggactcactcttggtattgttcatagtgttgtgctttgttaaaaaagaacaataatttcagaataatgtcctctcagagttgtagattgatcctatgtactaatatgtgtcgatgaatatagtaatgataatgaaatcagttctgccc

SEQ ID NO: 42742 - protein, 444 aa, Panicum virgatum
  misc_feature: Ceres CLONE 2013275
  misc_feature (42)..(129): Pfam Name: C2 Pfam Description: C2 domain
  misc_feature: Functional homolog of the protein sequence given in SEQ ID NO 50930
  misc_feature: Useful for making plants with modulated biomass
MAGYQTSLVAEPQLLNNEIITQKATNKFVSDTATKDKSIGYLDVFVHQARDIHNVCIYHKQDVYAKLCLTSNPDVSCSTKVINSAGCNPVFEESLRLDVQTVDASLKCEIWMLSRVRNYLEDQLLGFALVPLADIVMGNGKLVQEFSLTSTELFHTPAGFVQLSLSYAGCSPDVILISSPDKSVSRVADSGNDCAVPSQLEKIEFPDLNVVKEDEVMVSKYLEMGSLDSENPIKTENGKLLLSGNDNDIPSEFGKVDLPDSENPVKAENGKLLQFGAAVPGTAMCGDKLEEHQDESPLSCVSTTGSSTALSATRQSVSEPSSEPSETTVEASPRQRQKEKSQDVTDGEANSSEAPPRDEVVKPMISINLQPEQSVVQQDIVDMYMKSMQQFTESLAKMKLPLDVENSSLSNDVSDSSTIEKPSPSPSSSVSKGSRVFYGSRAFF

SEQ ID NO: 42743 - DNA, 694 bp, Panicum virgatum
  misc_feature: Ceres CLONE 2013278
  misc_feature: Encodes the peptide sequence at SEQ ID NO. 42744
gagtttggctggcctcagctcagttcagctcccttgttgctactagcagctgctgctggtggtgctgcgtgcttcgatcggctgggctggcttcaaatcaggaacaacgacagatccgaggctttctcgaatcgggcaggtccatcaaatctcaagttagctgcggctagccatcaaatcacactcatcaaatcaaaggggaccaaaaggatatctctggctctcctgcctcctcgctctccccggcctagtcgtataaaatttccctttcggctctgccccccttctgcttcctccgtcccgccccccttcctcctccgatctctctctcgcagctcgctccgctacctgctgctgcttattgctttccccctgcgatccgttccttgccctagctagccgccggccggatcgagcgatcgaggctgtacgtactcgccgtccgtcctcgactactccgatcccccgtcgtcgatctcgacagcgccagcgcctcaggtgccggagctgcctcattcggtcgccgaaatctatcatgatgtcgtcctcgtcgtcggccgccttcccgctggaccacctcgcgccgtcccccaccgagcagctctgctacgtgcactgcaactgctgcgacaccatcctcgccgtcggcgtgccgtgcagcagcttgttcaagacggtgacggtgcgctgcggc

SEQ ID NO: 42744 - protein, 52 aa, Panicum virgatum
  misc_feature: Ceres CLONE 2013278
  misc_feature: Functional homolog of the protein sequence given in SEQ ID NO 51658
  misc_feature: Useful for biocontainment applications
  misc_feature: Useful for making plants with modulated biomass
  misc_feature: Useful for making plants with modulated flowering time
  misc_feature: Useful for making plants with modulated time to senescence
  misc_feature: The sequence is a functional homolog of SEQ ID NO 412 in the 10/666,642 US patent application
MMSSSSSAAFPLDHLAPSPTEQLCYVHCNCCDTILAVGVPCSSLFKTVTVRC

SEQ ID NO: 42745 - DNA, 690 bp, Panicum virgatum
  misc_feature: Ceres CLONE 2013280
  misc_feature: Encodes the peptide sequence at SEQ ID NO. 42746
aatggagtcgtcggctagcacggtcgctgcctcgtcgcggccacacgtcgtgctggttgccagccccggcgccggccacctcatcccgatggccgagctcgctcggcggttcgtcgcgcaccacggcctcgcggccacgctcgtcaccttcaccgacctgtcggcgcccaacgcaaactccgccatcctttcgtccctcagcgcctcccaagtctccaccgtcgctctccccgccgtctcgctcgacgacctcccctccgacgcccacatcggcaccgtgctgatggagctgatgggccgctccatcccgcacctccgggccctgctccgcgacatcagcgccgccgccccgctcgccgcgctggtggcggacttattcggctccacgatgctgtccctagccaccgagcccggcgtcccgagctacatcttctcccccatcaacctcaccgcgctcgccgtcgtgcacaacgctgtggagctcaacgacggcgccgcctccggcgagtaccgcgacctcccggatgttctccagcttcccgggggcgtgttgctgcgccgtgaggactacgcggacgagttcaagaacagcaaggaacccatctacgcgcacgtcatcgaggagggccgccggtatcgcgccgccgacggcttcatggtgaacaccttccacgagatggagcctggcaa

SEQ ID NO: 42746 - protein, 229 aa, Panicum virgatum
  misc_feature: Ceres CLONE 2013280
  misc_feature: SWISSPROT Homolog: EC 2.4.1.218 Hydroquinone glucosyltransferase
MESSASTVAASSRPHVVLVASPGAGHLIPMAELARRFVAHHGLAATLVTFTDLSAPNANSAILSSLSASQVSTVALPAVSLDDLPSDAHIGTVLMELMGRSIPHLRALLRDISAAAPLAALVADLFGSTMLSLATEPGVPSYIFSPINLTALAVVHNAVELNDGAASGEYRDLPDVLQLPGGVLLRREDYADEFKNSKEPIYAHVIEEGRRYRAADGFMVNTFHEMEPG

SEQ ID NO: 42747 - DNA, 489 bp, Panicum virgatum
  misc_feature: Ceres CLONE 2013282
  misc_feature: Encodes the peptide sequence at SEQ ID NO. 42748
acacagtcccggcagcacgcactgcactgtagttgtagcaacaaaagaaaatgccgcggcgaactcgagtgctgctcgttctcgccttcgctgccgcgttgctgctcgccagcggcggcgccgctccagaggccggaggactctcggctggccccgaggcgatgccggccctgcgcgcgagcagcttcgtgctggagggcgaggaggaggtggcgtacccgcggaggagggcgctgtacagcggcgggttcatcgactacggcgctcttaccgcgagcaaggccgcctgctatggcccgtgccccgcccgcgggcagccctacagcagcggctgccaggccatataccagtgccgcggttaagcagcgctgcagtcagtcgatttgtacgtttcttgcgtatgttgaggcgcggttatttgatctaggtgtcagcctcttatgttccttttccatttaatattgttgtgaaaagagttcactactcagt

SEQ ID NO: 42748 - protein, 103 aa, Panicum virgatum
  misc_feature: Ceres CLONE 2013282
  misc_feature (48)..(103): Pfam Name: RALF Pfam Description: Rapid ALkalinization Factor (RALF)
MPRRTRVLLVLAFAAALLLASGGAAPEAGGLSAGPEAMPALRASSFVLEGEEEVAYPRRRALYSGGFIDYGALTASKAACYGPCPARGQPYSSGCQAIYQCRG

SEQ ID NO: 42749 - DNA, 711 bp, Panicum virgatum
  misc_feature: Ceres CLONE 2013283
  misc_feature: Encodes the peptide sequence at SEQ ID NO. 42750
cccgagccccgcaaaacccctaaaccctaagcccccttcctccgccccccgcccttctcgccgcggcttccagcgattggaggcgaagacgcggccatggcggccctcctcaggcgcgtgtcgctgcggcgcgccttcgccgccgccgcttcttcttctcaccctgagagctacacgcaagggatctgtggctccacgtttcattacagagagttcgcatctaaagccaaaaagaagtcaaagtcaagtggaactgactctggtgaggagaatatgtcgaagaaagacttggcattacaccaggctatcgaccaaataacatcggcatttgggaagggggcaataatgtggcttgggcgttcacaaggccatagagatgtacctgtaatatccactgggtctttcgcattggatatggctctaggaactggtgggcttccaaaggggcgtgtcatagaggtttatggcccagaggcttcaggcaagacaactcttgctctacatgtcattgcacaagcacaaaagaatgggggttactgtgcctttgtagatgcagagcatgctttggatccagctcttgcggagtcaattggcgttgacactaacaatttacttctttctcagccagactgtgctgagcaggcactcagtcttgtggacacactgattcgaagtggatctgttgatgttgttgtagtagacagtgtagca

SEQ ID NO: 42750 - protein, 204 aa, Panicum virgatum
  misc_feature: Ceres CLONE 2013283
  misc_feature (65)..(204): Pfam Name: RecA Pfam Description: recA bacterial DNA recombination protein
MAALLRRVSLRRAFAAAASSSHPESYTQGICGSTFHYREFASKAKKKSKSSGTDSGEENMSKKDLALHQAIDQITSAFGKGAIMWLGRSQGHRDVPVISTGSFALDMALGTGGLPKGRVIEVYGPEASGKTTLALHVIAQAQKNGGYCAFVDAEHALDPALAESIGVDTNNLLLSQPDCAEQALSLVDTLIRSGSVDVVVVDSV

SEQ ID NO: 42751 - DNA, 638 bp, Panicum virgatum
  misc_feature: Ceres CLONE 2013296
  misc_feature: Encodes the peptide sequence at SEQ ID NO. 42752
aactaacgctagaaaagtaacagtttctgtactttattgggtgaccttgcacagcatggctgactctgctgcccctgctcccgcgacgactgaagcgccgcgcggtcgtggcttcggccgcggcggccgtggtggccgtggcggtggccgtggccgcggcggtgccgagtcgaaggagtgggtgccgtgcaccaagctgggccgtctcgtcaaggacaagaagatcagctcgctggaggagatctacctctactccatcccgatcaaggagcaccaggtcgtcgacgcgttcctcggcgagggcacgctcaaggatgaggtgatgaagatcttccccgtccagaaggtgacgtccgccggccagcgcacgcgcttcaaggcgtacaccgtcgtcgatgactccaacggtcacgtcggcgtcggcagccgcgtcggcaaggaggtcgcgatctgcatccgctcgtcgctcatcgccgccaagctgaacctcatcccggtccgccgtggctactggggtaacaagctcggccagccgcacaccgtgccgatgaaggtgaccggcaagtccggctccgtctgggtgcgcctcgtcccggcgccgcgcggcacgggcatcgtcgcccgccccggtccgacaa

SEQ ID NO: 42752 - protein, 194 aa, Panicum virgatum
  misc_feature: Ceres CLONE 2013296
  misc_feature (84)..(150): Pfam Name: Ribosomal_S5 Pfam Description: Ribosomal protein S5, N-terminal domain
MADSAAPAPATTEAPRGRGFGRGGRGGRGGGRGRGGAESKEWVPCTKLGRLVKDKKISSLEEIYLYSIPIKEHQVVDAFLGEGTLKDEVMKIFPVQKVTSAGQRTRFKAYTVVDDSNGHVGVGSRVGKEVAICIRSSLIAAKLNLIPVRRGYWGNKLGQPHTVPMKVTGKSGSVWVRLVPAPRGTGIVARPGPT

SEQ ID NO: 42753 - DNA, 1313 bp, Panicum virgatum
  misc_feature: Ceres CLONE 2013310
  misc_feature: Encodes the peptide sequence at SEQ ID NO. 42754
gtccttcatctcttggaggcagctttcccctccatcctcgcctcgcgtcgcgtccatatcttcttattcccctccctccccggcgatcctcgatcgcattgtctgtcctcgcctgccaaacatttgggtagaggtctgtctttcttgtgctgctttcttccttgatccatcctgtcgctggcctgcttcaatccatcgcattgctcgtctgctgctgctgatggcttccttgttggatatatcagggccgcaaattaaaagcaggcgcgcagcttcatgatcagcagaggctagcttctcaggttccaatttcttgattcatctcgcatcgcagccatggatcccgagttcggagtaggcacggcgccccgaaagagggagtcatggcggacgacgctgctgctggcgtaccagagcctcggcgtggtgtacggcgacctcagcatctcgccactctacgtgtacaagagcaccttcgccgaggacatcaagcactcggacaccaacgaggagatcttcggcgccctctccttcgtcttctggacgctcaccctcatccccctcatcaagtacgtcaccgtcgtcctgcgcgccgacgacaacggcgatggaggcactttcgcgctctactccctcatctgccgccacgccaatgtcagcctcctccccaaccgccaggtcgccgacgaggagctctccacctacaagctcgagtacccgcccgaggtcgcccagaggtcacgcgtcaaggactggctggagaagcacaagaagctgcacaccgcgctgctcgtcatggtcatgatcggaacatgcatgatcatcggggacggcgtcctcacgccggcgatctcggtgttctcggctgtttcagggctcgagctctccttgtccaaagatcaacatgaatacgcgatcattcccataacctgtgccatattagtattcctgttcgctctgcagcattatggcacccaccgtgtaggattcctcttcgcgccgatcgttctgtcctggctgctctgcatgagcggtatcggcttgtacaacatcatccactggaaccctcatgtttaccgggcgctcaatccctcctacatgatcacattcctgaagaagaccaggaagtctggctggatgtcgctgggaggaattttgctatgcatgacaggatcggaagcaatgtttgcggatcttggccacttctcctacagcgcaatccagcttgctttcacttctttagtgtacccttcactgatattgggatacatgggtcaagctgcctatttgtccaaacaccataaccttgacgc

SEQ ID NO: 42754 - protein, 325 aa, Panicum virgatum
  misc_feature: Ceres CLONE 2013310
  misc_feature (22)..(325): Pfam Name: K_trans Pfam Description: K+ potassium transporter
  misc_feature: Functional homolog of the protein sequence given in SEQ ID NO 50430
  misc_feature: Useful for making plants with modulated biomass
MDPEFGVGTAPRKRESWRTTLLLAYQSLGVVYGDLSISPLYVYKSTFAEDIKHSDTNEEIFGALSFVFWTLTLIPLIKYVTVVLRADDNGDGGTFALYSLICRHANVSLLPNRQVADEELSTYKLEYPPEVAQRSRVKDWLEKHKKLHTALLVMVMIGTCMIIGDGVLTPAISVFSAVSGLELSLSKDQHEYAIIPITCAILVFLFALQHYGTHRVGFLFAPIVLSWLLCMSGIGLYNIIHWNPHVYRALNPSYMITFLKKTRKSGWMSLGGILLCMTGSEAMFADLGHFSYSAIQLAFTSLVYPSLILGYMGQAAYLSKHHNLD

SEQ ID NO: 42755 - DNA, 676 bp, Panicum virgatum
  misc_feature: Ceres CLONE 2013310-R
gcagcgacgccggcggggaggcgcgggacagcagctgcggctacgaaaacgagcgcgagaacgcgctcccggtcatcgggagcaacccgctgcggcgccatctgcagctggggtacgacgactcccacgacggcgtgtcgtcggcccacgagacgggcgtggacgggatcgagctcgcggcggcggcgccggtgatcaagaagcaggtgaggttcgcggcgaccccctgcaggagccccggcgtggacgagcgcgtgctggaggagctgcacgagctgtgcgaggcgcgggaggccggcacggcgttcatcctggggcactcgcacgtgcagaccaagcccgggtcgtcgctgctcaagaagctggccgtcagcgtcgggtacaacttcctgcggcggaactgccgcggcccggatgtggcgctgcgcgtgccgccggcgtcgctgctcgaggtcggcatggtctacgtgctgtgaggaacgtgacggcgatccatccgcgattgcgatctgtgcgtccggctttcagcgcgtctctctgccattgtattgtattgtgcacatctcgacttgctgatgtgaattgtagcgccatgcgatgcgatgccatgacatttttttctcgaatacgcaagagagttgcgcatctttgtagtattaagaagaaaaaagtttac

SEQ ID NO: 42756 - DNA, 1153 bp, Panicum virgatum
  misc_feature: Ceres CLONE 2013314
  misc_feature: Encodes the peptide sequence at SEQ ID NO. 42757
accacgccatcccctcccaacacccacccctccaaatcccaaatcccaccaccggccaccaccgcaccgccgccgccgcgccctccgcgcccagatcgcgccgcccgcccaatggccgccccgccgccgccgcgcgccgcggcgctcccgggggccctcctcgccctcctgctcgccgccgcggcgctggttgcccccgcggcggccgagatccgggagaccctgatccggtccgacccgcggagcatcatcccgctggacgagttcggcttctcccactcgggcgtgctggagctcaacgtctccggcatcgccttcgacccgccggcctccgccgagctcgacctcacccagctcggcttcttcctctccacgctcgacgcctgggtccacgtcctccgccagctccaggacctcgacgtcacctgcgcgctccagtccgagctcgtcaagctcgccttctccttcgaccgcctccgcccgccctccaaccccgcgggggtcgaggtcgcgcgctcctcctccttctccaccgcctttcgcgtctccgagcccggccagtacacgctcgtcttcgccaactgcctcggcggggggctcaaggtcgacatggacgtccgctccgccatgtacaacgtcgacccggccaccggggaacgccagtacctctccgcgggggcctcctcgctcccctccgtctacttcctcttctgcctcgcctacgcaggcctcgccgccgcctgggtcgccatcctgctgcgcaagcgcgccgcggtcttccggatccactacttcatgctcgccgtcctcgtgctcaaggcgctcaacctcctcgccgaggccgaggacaagtcgtgcatcgagcgcaccggcaccgcccacggctgggacgtgctcttctacatcttcagcttcctcaaggggatctcgctcttcaccctcatagtgctcatcggcaccggctggtccttcctcaagccctacctggccgacaaggagaagaaggtgctcatggtggtcatccccctgcaagtcctggccaacattgcgcaggtggtgatcgacgaatctggaccctatgctcgggactgggtcacctggaagcaaattttcttgctggtcgatgtggtctgctgctgtgccgtgctcttcc

SEQ ID NO: 42757 - protein, 347 aa, Panicum virgatum
  misc_feature: Ceres CLONE 2013314
  misc_feature (145)..(346): Pfam Name: Lung_7-TM_R Pfam Description: Lung seven transmembrane receptor
MAAPPPPRAAALPGALLALLLAAAALVAPAAAEIRETLIRSDPRSIIPLDEFGFSHSGVLELNVSGIAFDPPASAELDLTQLGFFLSTLDAWVHVLRQLQDLDVTCALQSELVKLAFSFDRLRPPSNPAGVEVARSSSFSTAFRVSEPGQYTLVFANCLGGGLKVDMDVRSAMYNVDPATGERQYLSAGASSLPSVYFLFCLAYAGLAAAWVAILLRKRAAVFRIHYFMLAVLVLKALNLLAEAEDKSCIERTGTAHGWDVLFYIFSFLKGISLFTLIVLIGTGWSFLKPYLADKEKKVLMVVIPLQVLANIAQVVIDESGPYARDWVTWKQIFLLVDVVCCCAVLF

SEQ ID NO: 42758 - DNA, 628 bp, Panicum virgatum
  misc_feature: Ceres CLONE 2013314-R
tggtccattaagaactccggggaggctgctcgctcggacgggaaggcggctgtgaacctcatgaagctgactctcttccgccagtattacgtggtcgtcatttgctacatttacttcacccgtgtcgtggtgtatgcgctacagaccatcacctcataccggtatctgtggaccagcgtcgtggctgccgagcttgcaacgctcgcgttctatgtgttcactgggtacaagttccggcctgaggtgcataacccatacttcgcgattgatgatgaggaagaagaagctgcagcagaggcactcaagctggatgatgaattcgagctataagggtttagcaattggcatacctccatgccagtggtgatattggtgttgtatgatgggccaccacaggaaaaatgccatagactggtaccatagttcacatccttttgcttttttttcttcttctttcgagttggttacattttgtcttactgtaattgggtattgacaaccctgtgtgtgtgcacgcctgtgtgtgtgtgtgtgtgttaagcaatgcagcttgcctttgccttaatttttatccatgatcattaagatgagctgtttttatcctagatgattactttgtttacatagc

SEQ ID NO: 42759 - DNA, 1274 bp, Panicum virgatum
  misc_feature: Ceres CLONE 2013324
  misc_feature: Encodes the peptide sequence at SEQ ID NO. 42760
acggtagtcaggaaggagcctctcgctagctgttggtttctccagagggttgagcggcaggtgcaggcgccccggtagtagtggtggtggtagctcgtcgtcgtgagcttgactagtgttgcgtagggcagatcgatcgaggcggctcgctcggcatggcctcctccttcaacgacaacaggcactggcccagcatgttcaggtccaacaagcacgccgccgagccgtcgccgttcctctccggcggcggcggcggcaacgccaccagcgccgccgctagcggcctcaagcacccctcctcgggcttcgcaggcggcgaggagcggaccccggatccgaagccgcggtggaacccgaggccggagcagatccggatcctggaggccatcttcaactccggcatggtcaacccgccgcgcgacgagatcccgcgcatccgcatgcgcctgcaggagtacggccaggtcggcgacgccmacgtcttctactggttccagaaccgcaagtcccgctccaaaacaagctgcgcgccgcgggcaccgcgcgcgcgccggcccgcggggcagccgctgcgccgccgcccctcgccacgccgcccgcgctccaggcggccccgcagccgcagctcctgacccagcagcaggtccagctgcttccgtcgccagcgcagcaggcgcccacttcctcgtcctcgtcctcctccgaccgctcctcggggtccagcaggccggccgcgaagcgggcggcgcaggagatgtccccggcggcggccatggacctgctcgggccgctcgccgcggcgtgcccccagatgtactaccagggccagcccgtggcggctccgacctcgccgcccgcgcacaaggtgcaggacctcgtgtcctccgacgagcccatcttccagccgtggcagcagggctactgcctgtcggccgccgaggtcgccgccattctcgcggggcagtacatgccggtgcccgtgcaacagcacccgccggcgtcgttgcccgcgggtgcattcttggggcggtgcaacgaggtgactggcccagccatcgccggccaaagaacctgcgcctggggcgcggggctcgggcagtactgtccagggggcggcggcgctgatcatcatcagctcgagctcagcaagaacaccaccgcagcggcaccgacgaacgccgtggccagggaggtggcgcacgaggactccacaaagctggggttgctgccgtactgcttcggcgattgcacggctgtgggacgcggcctccatc

SEQ ID NO: 42760 - protein, 158 aa, Panicum virgatum
  misc_feature: Ceres CLONE 2013324
  misc_feature (61)..(122): Pfam Name: Homeobox Pfam Description: Homeobox domain
  misc_feature: The sequence is a functional homolog of SEQ ID NO 2664 in the 10/374,780 US patent application
  misc_feature: The sequence is a functional homolog of SEQ ID NO 330 in the 10/225,066 US patent application
  misc_feature: The sequence is a functional homolog of SEQ ID NO 258 in the 10/666,642 US patent application
  misc_feature (108)..(108): Xaa is any aa, unknown, or other
MASSFNDNRHWPSMFRSNKHAAEPSPFLSGGGGGNATSAAASGLKHPSSGFAGGEERTPDPKPRWNPRPEQIRILEAIFNSGMVNPPRDEIPRIRMRLQEYGQVGDAXVFYWFQNRKSRSKTSCAPRAPRARRPAGQPLRRRPSPRRPRSRRPRSRSS

SEQ ID NO: 42761 - DNA, 391 bp, Panicum virgatum
  misc_feature: Ceres CLONE 2013324-R
cgccggcgagcgcggcctcgacatcgagcaggtccccgtcgacgcgtcgggccgcaccgtccacccgctccagcacggcgccttctactacgtgctggtataaaaataataacagacgtggcgcgtgccgaagctagcgttcccggccgtgtgccgcgcatgcaagaggcctactattactatcgactagtacgtgccagcaagtggtttattagggtatcgatcgtgtagtgcgtgcatgtgtgcaccgatttatctagcaaggctaatcctttgtctcagatgttgtgttgcgtgcaccgcagcgcactaacgtatagtacaccagtaaaattgtggctttgatcgtatgttggtgtactctgttttctgcaggtataattagtagcat

SEQ ID NO: 42762 - DNA, 624 bp, Panicum virgatum
  misc_feature: Ceres CLONE 2013326
  misc_feature: Encodes the peptide sequence at SEQ ID NO. 42763
atctctctgctccacctccgctgctctcgcgtctcgtccagtggtggccgtggtggtagtggagtgcgggcagatccgcccgctcgcccgtacgcggattgcctttcgtcttcgcccattgctgttggttggagattgctgtggatttgcgagctgcttgtatccatggtttgattagtttcttcttcctcttctcacggcgcccctccgcctcagcctcccgcgccacctcccgcggcccaccccgctgcgcctccccgccgcgctccctctccgccctcccctcccgcccctccgcgcctccgccgccgcggcagcggccgcgtccccggcgccgggggacgacgcgtcctcgcccaagttcctcggcgtcgagacgaagacgctgaagaagatcgtgcccctggggctcatgttcttctgcatcctcttcaactacaccatcctgcgggacaccaaggacgtgctcgtcgtcaccgccaagggcagcagcgccgagatcatccccttcctcaagacgtgggtcaacctgcccatggccgtcggcttcatgctcctctacaccaagctcgccgacgtcctctccaaggaggcgctcttctacgccgtcatcttccccttcat

SEQ ID NO: 42763 - protein, 70 aa, Panicum virgatum
  misc_feature: Ceres CLONE 2013326
  misc_feature: Functional homolog of the protein sequence given in SEQ ID NO 51659
  misc_feature: Useful for making plants with atered amino acid content
MFFCILFNYTILRDTKDVLVVTAKGSSAEIIPFLKTWVNLPMAVGFMLLYTKLADVLSKEALFYAVIFPF

SEQ ID NO: 42764 - DNA, 1293 bp, Panicum virgatum
  misc_feature: Ceres CLONE 2013337
  misc_feature: Encodes the peptide sequence at SEQ ID NO. 42765
acccttcttccctttcctttcctttccccgcccactctctcgccagctttgcggggaacgagagacgccagcagacaaacccctctctccgcctcgctcccccgcctcccctcccccacaaaaccctaacctctccccctcctcgtcccccgatggcgtcgccgccgccgccgcccgccggagccgccgcgcccggatcgccgccgccggcgcaagtggtgggcaacgcgttcgtgaaccagtactacaacatcctgcaccagtcgccggagctcgtccaccgcttttaccaggacgccagccgcctcggccggcccgccggcgccggcgccgacggcatggacaccgtcaccaccatggacgcgattagcgacaatatcgtgtccatgggcatcacgcgcgcggacatcaaggcggtggacgcgcaggagtcgctctgcggcggcgtcaccgtgctcgtcatgggccacctcacggggaggaccggcgtcggccgcgagttcgtccagtccttcttcctcgcgccgcaggagaagggctacttcgtgctcaacgacattctgcgctacgtcggggacggggagggggccgggcacctgccgccggcgccggaggccgccgcggacgcggaggctgcctctgctcctgtcctggccaacggcactgtcggggcagacaacgagaccgtgcctcgcgaacaggatgcttcgctgcagcccgagcagcatgcagctgagcccgcacctcctactcaggaggtggaagatctcaacggggaggaggtttacaacccgcctaatgatgtggagaagcctgttgttaaagaaacgctggttaccgaggtcataaatgaagtctcgaataatgtagcagtggctgcgccgagttcgtctccccctgtaccgatcgaggaggccccaaagaagtcatatgcttcaattgtaaaagtcatgaaagaatatcgacccccaaaaccagctttggcacccccaaaaccagagaaacaagcccctcctgcacccccaaaaccagagaaacaagcccctcctgcacccactttggtcgctgatgctccagctttcactcctaacgctcagggtggcagctttcaagatccagaagttgatgcacatgccatatatgtgcggaatctgccattaagtgccacaccacaacaattagaagaagaattcaagcgatttggcactattaagaacgaaggcatccaagttagaagcaacaagatccaagggttttgttatggctttatagaattggaggatgccagtgctg

SEQ ID NO: 42765 - protein, 380 aa, Panicum virgatum
  misc_feature: Ceres CLONE 2013337
  misc_feature (23)..(139): Pfam Name: NTF2 Pfam Description: Nuclear transport factor 2 (NTF2) domain
MASPPPPPAGAAAPGSPPPAQVVGNAFVNQYYNILHQSPELVHRFYQDASRLGRPAGAGADGMDTVTTMDAISDNIVSMGITRADIKAVDAQESLCGGVTVLVMGHLTGRTGVGREFVQSFFLAPQEKGYFVLNDILRYVGDGEGAGHLPPAPEAAADAEAASAPVLANGTVGADNETVPREQDASLQPEQHAAEPAPPTQEVEDLNGEEVYNPPNDVEKPVVKETLVTEVINEVSNNVAVAAPSSSPPVPIEEAPKKSYASIVKVMKEYRPPKPALAPPKPEKQAPPAPPKPEKQAPPAPTLVADAPAFTPNAQGGSFQDPEVDAHAIYVRNLPLSATPQQLEEEFKRFGTIKNEGIQVRSNKIQGFCYGFIELEDASA

SEQ ID NO: 42766 - DNA, 683 bp, Panicum virgatum
  misc_feature: Ceres CLONE 2013337-R
aggatgccagtgctgtccaaactgcaatagaggcttctcctgtcatgattggtgaacggcaatgttatgttgaagagaaaagaactactggttctcgtggcggtagcagaggaggaaggtttgcaccaggtagaggtggtaacttccgaggcgaaggccttagaggccgtggtacttacaatggaggcagaggctacggaaggggcgagttaaattatcgatccgattatggcggccggggtgggggcaggggtggctcatcacgtggagatgttggctaccagcgggtcgaccactctgttaccgttggtggtcgtggtgcccgggcgacatccgctgctaccgcggctgcaaagtgagttcttggtagctgtcctgtccgtcagtaatagttcagagttctatggtcaccatcatggttgaccaaaagagtggcaggtgtggtggatttgggttcatgtgaggtttatcagcaaaagtcgggtcataaattgatgcgtatccttgttttgtggcaaggtaaagcagtggttatatcggggttactaattgtagaatgtacgtctattgagtgagatgtagtccctagtatgtttttcttcgtcgatcagctgactcgtgttttcccgttcttttttacttgttcccaaattagaggggttgatttgaggtgccagtgattc

SEQ ID NO: 42767 - DNA, 582 bp, Panicum virgatum
  misc_feature: Ceres CLONE 2013356
  misc_feature: Encodes the peptide sequence at SEQ ID NO. 42768
aactaacgctaaaaaagtaacagtttctgtactttattgacaaactatctattgaccgctccccgagcgagcttcacatttatcaacacactcgtcctcacagcaacaatggctcgaatcgtccgcgtgaccctatttgccgtggccgtggcccttgctgcgagtctggcagacgccgaacaagcgaagcacgcgaacatcgcctcgcgcaaccgtttccgcgcacagcaggcgtacggctccgagccgagtgaagtgaccaccgctgcgccgtattcttcgcagcctgcggaagtgactacagcggccccgtattcctcccaaccggccgaggtgacaacggcagcgccttacgagacgcccgctccgtattctagcgaaccggcggaggtgacgactgctgcgccctacgaaactccggcgccgtattcgagcgaaccggccgaggtgaccaccgccgcaccttacgagacgcctgcaccgtattcgagcgaaccggcggaggtgacaactgcggctccgtacgagacgcccgccccgtactcatcgcagccgggcgaagtgacaactgctgcgccctac

SEQ ID NO: 42768 - protein, 157 aa, Panicum virgatum
  misc_feature: Ceres CLONE 2013356
  misc_feature: SWISSPROT Homolog: EC 3.2.1.4 Cellulase
MARIVRVTLFAVAVALAASLADAEQAKHANIASRNRFRAQQAYGSEPSEVTTAAPYSSQPAEVTTAAPYSSQPAEVTTAAPYETPAPYSSEPAEVTTAAPYETPAPYSSEPAEVTTAAPYETPAPYSSEPAEVTTAAPYETPAPYSSQPGEVTTAAP

SEQ ID NO: 42769 - DNA, 699 bp, Panicum virgatum
  misc_feature: Ceres CLONE 2013356-R
gcctcaacggcgcgctcgtgaccgatcttgcttcgctcctcggtcgcgcgccgggtgacgtcaacatcgcgtccgtcgctgtcggtgccaactcactcacggtcgtcttcacggcgcgctcgaacgctctcgcggaggcggcgcgcatcgcagcgctgattcgcgacgacatccccgcctccgcgccgatgccgttcaccaccaacgactacgcctccgtcggtcagtccgccgctgatgtcagcgtcgcgtcgcacaccgctacgtctcgcgacgccttcgacggcagctcgtgctcgtcacagcccgctgaagtgacgaccgctgccccttacggctctcagcccgccgaggtgacgaccgctgccccttacggctctcagcccgccgaggtgacgaccgctgccccttacggctctcagcccgccgaggtgacgactgccgccccgtacggttcccagcccgctgaggtgacgacgatggcgccgagctcgtacaacccgccggcgcccggctggtcgaacggctactacagcccggctggcgcgcaggctgcgatgatgccgtggctcgcggcggcagccgctgtggtggcggccgcggttatggttcgttagcgtgaccgcacgcgtgttatttgtttcgatctcttcacggcttccgcgccgcgttttcccctcatcctcgtgttcaatccag

SEQ ID NO: 42770 - DNA, 619 bp, Panicum virgatum
  misc_feature: Ceres CLONE 2013373
  misc_feature: Encodes the peptide sequence at SEQ ID NO. 42771
gaccgcttcgtcctctccaacggacacggctgcatgcttcagtatgctcttctccaccttttcggctacgatctcagcatcgatgacctgaaggctttccgatctgtcgacagccgtactccgggtcaccccgaggctcacgacactcccggtgttgaggtcaccactggccctctcggccagggtatctccaacgctgttggtctggccattgcccaggctcataccggagctgtcttcaacaaggacggtttccctcttgtcaataactacacttacactttcctcggcgatggctgcttgatggagggtgtctccagcgaggcctcctctctggctggtcacctccagcttggtaacctcattgccatctgggacgacaacaagatcaccattgacggtgacactgctgtggccttcactgaggatgtccctaagcgatacgaggcctacggctggcacgtcgtcaaggtcgacgacggtgaccacgatcttgccggcatcgaggctgccatcaaggaggctcaatctgtcactgacaagcctaccctcattcagctccgaaccaccattggtttcggttccaagaaccagggcacccacggtgtccatggctcgc

SEQ ID NO: 42771 - protein, 206 aa, Panicum virgatum
  misc_feature: Ceres CLONE 2013373
  misc_feature (1)..(206): Pfam Name: Transketolase_N Pfam Description: Transketolase, thiamine diphosphate binding domain
  misc_feature: SWISSPROT Homolog: EC 2.2.1.1 Transketolase
  misc_feature: Functional homolog of the protein sequence given in SEQ ID NO 50504
  misc_feature: Useful for making plants with modulated biomass
DRFVLSNGHGCMLQYALLHLFGYDLSIDDLKAFRSVDSRTPGHPEAHDTPGVEVTTGPLGQGISNAVGLAIAQAHTGAVFNKDGFPLVNNYTYTFLGDGCLMEGVSSEASSLAGHLQLGNLIAIWDDNKITIDGDTAVAFTEDVPKRYEAYGWHVVKVDDGDHDLAGIEAAIKEAQSVTDKPTLIQLRTTIGFGSKNQGTHGVHGS

SEQ ID NO: 42772 - DNA, 726 bp, Panicum virgatum
  misc_feature: Ceres CLONE 2013377
  misc_feature: Encodes the peptide sequence at SEQ ID NO. 42773
aatcaagcaagtagctgaaacaagctaaggatcggaggctcctgctatatatgcgattattgcttcgatcagttgatcgatatttatatcatggacgacgatcacggtacaacaacaacaagaagaacaattgtgcatacatggctcgtgttcaccatcattttccctatcaccatcgtaatagccaccatgatcgcacgagcaagaaccatacctcccaagcgcaagaggaggccacatgataagctgctgcagccaccacccgtgtctgagggagctcccatcgtcggagttctgcctgccatcctcaccacgagcggaggcttgcaagccgtgatccgcgaccagtacctgaagctcggcagcgtcttcacgctgagctccttgggaatcaaggtgaccttcctggtcggcccaaaggtttccgcccatttcttccacggcaccgaatcggagatcagcatcagcgacgtctacaagatgaccgtcccaatcttcggcaaaggcgtcggctatgacgtcgacaacgatacccggaacgagcagcacaggttcttcgccgagaccttgaggccggccaagctgaggagccatgtcggtctcatggttgctgaggtgcaggaatacttcgcgagatgggggcagtgcggcacggtcgatctgaaacaggagatcgacagtgtgctgctgctcatcgccagccggtgcctgctggggaaggaggtc

SEQ ID NO: 42773 - protein, 211 aa, Panicum virgatum
  misc_feature: Ceres CLONE 2013377
  misc_feature: SWISSPROT Homolog: EC 1.14.13.70 Sterol 14-demethylase
MDDDHGTTTTRRTIVHTWLVFTIIFPITIVIATMIARARTIPPKRKRRPHDKLLQPPPVSEGAPIVGVLPAILTTSGGLQAVIRDQYLKLGSVFTLSSLGIKVTFLVGPKVSAHFFHGTESEISISDVYKMTVPIFGKGVGYDVDNDTRNEQHRFFAETLRPAKLRSHVGLMVAEVQEYFARWGQCGTVDLKQEIDSVLLLIASRCLLGKE

SEQ ID NO: 42774 - DNA, 1135 bp, Panicum virgatum
  misc_feature: Ceres CLONE 2013384
  misc_feature: Encodes the peptide sequence at SEQ ID NO. 42775
aattaatttagttttaaaattagcaacgcttcagcaagaccaaaaaagaaccttgtcctttccaaaaactatacaagatcatgaaaccattcaaactttgctacaataacgagatccacagagtctccaagcttccttctgacttcaaatctcttgaagaaatcgtctcccaagccttcaagagcattcttcccaccaaatgggctcttcagtacgaagacaacgatggtgaccgcattatgctcaccagcgatgaagattacagagccatgttggagtgcgaagctgaaagcgactcaaaatccatcaagatctacttgatgtccatcgaagagcgcggcggcatggattccagcagattacacctttgtgacatctccaagactgaatccatcatccaaggagcttccactgagattctcatcaaagaagaagagaagccagaagaacctgaggtcaaaatctctgaagaacctatgattgaatctcaacctgagatccttctgaaagttgaagaggaacctgtgattgaagaaatcgccccagtcaagcctgaggtcgaaactgtcatccttgctcaaaaccactctgatacctccacttttgctgacatcgctattgactatattcctcaacaaattcaacccgctgttgttgaaattgtccaagtcaaggaagaggtcgctgcccctcctgttgttgaagaaaagaaaagaggaggcagatgcggtggtcgtggaagagtgggccaaaagcttagacaagccagaaaagaaagaatggctcctattgtcaatgagctcatctacgaaaatcttcccaagattgctgaaatcatgaagaattacattgctgacccctcttcagtcaacttcgaagaactcatcaacaaggtcaaagttgttgaagaagcccccaagaagaaagtctctgaagccaatgtcgttgttcacaacagagttatctgtgacggatgcaaagttgctcctattgttggtgtgagatacaagtgcacagtctgtgaagacttcgattactgtgaaaagtgcgaacaatccttcgagcattctcatcctttcttgaagatcaaggaccccaatcacagtcccaaggctatccttcatcgtcctcgaag

SEQ ID NO: 42775 - protein, 351 aa, Panicum virgatum
  misc_feature: Ceres CLONE 2013384
  misc_feature (290)..(333): Pfam Name: ZZ Pfam Description: Zinc finger, ZZ type
  misc_feature (1)..(83): Pfam Name: PB1 Pfam Description: PB1 domain
MKPFKLCYNNEIHRVSKLPSDFKSLEEIVSQAFKSILPTKWALQYEDNDGDRIMLTSDEDYRAMLECEAESDSKSIKIYLMSIEERGGMDSSRLHLCDISKTESIIQGASTEILIKEEEKPEEPEVKISEEPMIESQPEILLKVEEEPVIEEIAPVKPEVETVILAQNHSDTSTFADIAIDYIPQQIQPAVVEIVQVKEEVAAPPVVEEKKRGGRCGGRGRVGQKLRQARKERMAPIVNELIYENLPKIAEIMKNYIADPSSVNFEELINKVKVVEEAPKKKVSEANVVVHNRVICDGCKVAPIVGVRYKCTVCEDFDYCEKCEQSFEHSHPFLKIKDPNHSPKAILHRPR

SEQ ID NO: 42776 - DNA, 611 bp, Panicum virgatum
  misc_feature: Ceres CLONE 2013402
  misc_feature: Encodes the peptide sequence at SEQ ID NO. 42777
gcggcggccgatcgagccggagtacggcgacagcacggacatcgtgggctggatcagggagcggctgcgcaccaacagcggcgtggaggagctgctcgacgccggcgtcggcggccgcgtcgaccacgtccgggaggagatgctgctggtgctgcgcatcgcggtgctgtgcacggccaagtcccccaaggaccggcccactatgcgggacgtggtgaccatgctcggcgaggccaagccgcgccgcaagagcagcagcgccaccgtggccgccaccgtcgtggacaaggacaagccggtgttcacgacgtcgccggactccggttacctataggctggggatgaggcgggtgaccaaaaggcgactctgtacgttctgtatgtagttcatgccatgtacaatcttttacatagttttgatttgattcatatatacttttgttaagttcagagggaaaaggagattaacgtaaccaatgtttagacgtttacaacattaggatgtaatgtaaagcaattggtccctttgaataataataataatagaaaaaccatttttagactatacaagccggtgatagtgctgcgatctgttgccgttggtttggaac

SEQ ID NO: 42777 - protein, 110 aa, Panicum virgatum
  misc_feature: Ceres CLONE 2013402
  misc_feature: SWISSPROT Homolog: EC 2.7.11.1 Non-specific serine/threonine protein kinase
RRPIEPEYGDSTDIVGWIRERLRTNSGVEELLDAGVGGRVDHVREEMLLVLRIAVLCTAKSPKDRPTMRDVVTMLGEAKPRRKSSSATVAATVVDKDKPVFTTSPDSGYL

SEQ ID NO: 42778 - DNA, 595 bp, Panicum virgatum
  misc_feature: Ceres CLONE 2013404
  misc_feature: Encodes the peptide sequence at SEQ ID NO. 42779
agtgcagctggttctctcatgcattgagtgttgttagtagatacatggctaatcctagtaaacaacattggaatgtagttcattggattttcagatacctgcgaggtacttctagtgcttgtttgcagtttgggaaatctagagatggacttgttgattatgttgattctgattatgctggtgatttggataagaggaggtctctcacgggttatgatttcaccattggtggttttgctgttagttggaaagcaagtttgcaggttattgttgctttgtccactactgaagttaaatatatggctatttctgaagcttgtaaagaagctattaggttgagaggtttatactctgaactttgcggggtttcttctttcattactattcattgtgatagtcaaagtgctatttatcttactaaagatcatatgtttcatgaaagaacaaagcacattgatgtgagatatcacttcattcgaggcgttgttgctaaaggtgatattaaagtatgcaagataagtactcatgacaatcctgctgatatgattactaagcctgtccctgtagctaagtttgagctatgctcaagctgggt

SEQ ID NO: 42779 - protein, 197 aa, Panicum virgatum
  misc_feature: Ceres CLONE 2013404
  misc_feature: SWISSPROT Homolog: EC 2.7.7.49 RNA-directed DNA polymerase
CSWFSHALSVVSRYMANPSKQHWNVVHWIFRYLRGTSSACLQFGKSRDGLVDYVDSDYAGDLDKRRSLTGYDFTIGGFAVSWKASLQVIVALSTTEVKYMAISEACKEAIRLRGLYSELCGVSSFITIHCDSQSAIYLTKDHMFHERTKHIDVRYHFIRGVVAKGDIKVCKISTHDNPADMITKPVPVAKFELCSSW

SEQ ID NO: 42780 - DNA, 698 bp, Panicum virgatum
  misc_feature: Ceres CLONE 2013437
  misc_feature: Encodes the peptide sequence at SEQ ID NO. 42781
agagattgagtctgcttcccaactgaaatctcaactttggagcaggaaagcaaacattttccaaagttttatggataatcaaaaaatgtccattaaggacataaggttatcatctcagtccattaagcaggaaatgtttacccttcaaatgaaatggaaggacgaaatatgtaacattggacatgatctaaaaggtttagtagatgctgccgataattaccataaggttcttgcagaaaatcagaagttgtttaacgaagtacaggaactaaaaggaaatatccgagtctattgccgtgtcagaccatttcttcctggtcaagatgggaaagcaactacagttgattatattggtgaaaatggtgagatcttcatcacaaaccccttcaaacaagggaaggatgggtgtcgaatgttcaagtttaataaggtgtttaaaacgcatgcttctcaagctgaagtgttctctgacatccagccattgatcagatcagttcttgatgggtttaatgtatgcatttttgcatatggtcaaactggttcaggaaaaacttacacaatgagtggaccaggcacatctaaagaagattggggtgtgaactatcgagccttaaatgacttgttcgacatctctctaagtagaagaaatgctttctcatatgaggtggaagtgcaaatggttgagatttacaacgaac

SEQ ID NO: 42781 - protein, 232 aa, Panicum virgatum
  misc_feature: Ceres CLONE 2013437
  misc_feature (99)..(232): Pfam Name: Kinesin Pfam Description: Kinesin motor domain
EIESASQLKSQLWSRKANIFQSFMDNQKMSIKDIRLSSQSIKQEMFTLQMKWKDEICNIGHDLKGLVDAADNYHKVLAENQKLFNEVQELKGNIRVYCRVRPFLPGQDGKATTVDYIGENGEIFITNPFKQGKDGCRMFKFNKVFKTHASQAEVFSDIQPLIRSVLDGFNVCIFAYGQTGSGKTYTMSGPGTSKEDWGVNYRALNDLFDISLSRRNAFSYEVEVQMVEIYNE

SEQ ID NO: 42782 - DNA, 712 bp, Panicum virgatum
  misc_feature: Ceres CLONE 2013457
  misc_feature: Encodes the peptide sequence at SEQ ID NO. 42783
caaatttcttcgatcgaatcatcccccaggccccagttccacctaacggctagaccccgcgatgctttacgccctcctctgcctcctcgccctcgccggcgccgcagcggcggcggcggcgccgaacgcgcgcccgtgcgcgtcggcggactcggcgagcgcctacccgttctgcgacgcctcgctctccatcccggcccgcgcgcgcgcgctcgtctcgctcctcaccctcgacgagaagatcgcgcagctgtccaacacggcgggcggggtcccgcgcctcggcgtcccgccctaccagtggtggtccgagtccctccacgggctcgccgacaacgggcccggggtcaacttctcctcgggccccgtccgcgccgccaccgccttcccgcaggtcatcctctccaccgccgccttcaaccgctcgctgtggcgcgccgtggccggggccgttgccacggaggccctcggcatgcacagcaccggccaggcagggctcacatactgggcgcccaacatcaacatcttccgcgacccgcgctggggccgcggccaggagacgtccggggaggaccccgccgtcgccgccgcgtactccctcgagtacgtcaaggggttccagggggactacggggaggaaggcaggattaggctctcggcctgctgccagcactatacagcgtatgacatggagaagtggaagggcttctcg

SEQ ID NO: 42783 - protein, 216 aa, Panicum virgatum
  misc_feature: Ceres CLONE 2013457
  misc_feature (68)..(213): Pfam Name: Glyco_hydro_3 Pfam Description: Glycosyl hydrolase family 3 N terminal domain
  misc_feature: SWISSPROT Homolog: EC 3.2.1.21 Beta-glucosidase
MLYALLCLLALAGAAAAAAAPNARPCASADSASAYPFCDASLSIPARARALVSLLTLDEKIAQLSNTAGGVPRLGVPPYQWWSESLHGLADNGPGVNFSSGPVRAATAFPQVILSTAAFNRSLWRAVAGAVATEALGMHSTGQAGLTYWAPNINIFRDPRWGRGQETSGEDPAVAAAYSLEYVKGFQGDYGEEGRIRLSACCQHYTAYDMEKWKGF

SEQ ID NO: 42784 - DNA, 1386 bp, Panicum virgatum
  misc_feature: Ceres CLONE 2013458
  misc_feature: Encodes the peptide sequence at SEQ ID NO. 42785
gcgtgaaaggtgaaaccccccctcctcgctttcgcgctgcgtccgcggtggcatcattggataacctggactggtccgggctgggtggccttcttcccggctgctgatttcgcgagctcggcggcttcgtctctctgctgctgctgctgctgctgctcctggcggaggcggagcggaattgtggttcagccgtgggctgccctgctcttcctcttcttcagatcattgtttgccgaattgaatctgcggggctgtgcaggcgatgtgggtgccggtggcgccgatgtggatgcggtggtgggtggtggctgctggcctgctcgccgtgatcctgccgccgtccaccgccacactctccccggccggcatcaactacgaagtggtggctctgatggccatcaagacggagctggaggacccccacaacgtgctggacaactgggacatcaactccgtcgacccctgcagctggaggatggtcacctgcttctccgacggctacgtctccgccttaggattgcccagtcagagcttgtccgggaaattgtcacccggcattggcaacctcaccaggctacaatctgtgctgttacagmacaatgcgatttctggccccattcccagtaccataggaaggttggggatgctaaagactcttgacatgtcagataaccagctcacggggagcatcccaagttcacttgggaatctcaagaacctcaactatctgaaattgaacaataatagcttgtctggagttctgcctgattcacttgaatccattgatggccttgctcttgtagatctttcatttaacaatcttagcggtccattgcccaagatttctgcaagaactttcattattgctggaaatccaatgatttgtggtgataagacaggagataactgctcttcagtgtcacttgacccactctcttacccaccagatgatctgaagactcagccacaacaaaccattggaaaaggccgccgtattgctacaatatgtggagcaactgtagggtcagtagcttttgccgctattgtagttggcatgcttctttggtggcgtcataggcgaaatcagcaaatcttctttgatgtaaatgaccaatatgatccagaagtttgtttgggtcatctgaaacggtatgccttcaaggagcttcgtgcagctactaacaactttaactcaaagaacatcttaggtgaaggtggatacggcatagtctacaagggttatttgcgtgatggctctgtcgttgctgttaaaaggctgaaggattataacgctgttggtggggaggttcaattccaaactgaggttgaagtcataagcttggctgttcatcggaatcttctccgtcttattggattctgcactac

SEQ ID NO: 42785 - protein, 374 aa, Panicum virgatum
  misc_feature: Ceres CLONE 2013458
  misc_feature (36)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Functional homolog of the protein sequence given in SEQ ID NO 50524
  misc_feature: Useful for making plants with modulated nitrogen use efficiency
  misc_feature (112)..(112): Xaa is any aa, unknown, or other
MWVPVAPMWMRWWVVAAGLLAVILPPSTATLSPAGINYEVVALMAIKTELEDPHNVLDNWDINSVDPCSWRMVTCFSDGYVSALGLPSQSLSGKLSPGIGNLTRLQSVLLQXNAISGPIPSTIGRLGMLKTLDMSDNQLTGSIPSSLGNLKNLNYLKLNNNSLSGVLPDSLESIDGLALVDLSFNNLSGPLPKISARTFIIAGNPMICGDKTGDNCSSVSLDPLSYPPDDLKTQPQQTIGKGRRIATICGATVGSVAFAAIVVGMLLWWRHRRNQQIFFDVNDQYDPEVCLGHLKRYAFKELRAATNNFNSKNILGEGGYGIVYKGYLRDGSVVAVKRLKDYNAVGGEVQFQTEVEVISLAVHRNLLRLIGFCT

SEQ ID NO: 42786 - DNA, 715 bp, Panicum virgatum
  misc_feature: Ceres CLONE 2013476
  misc_feature: Encodes the peptide sequence at SEQ ID NO. 42787
caaatctattgacctttgtttcgctccttggggtgtcatcatttcagtcagctagtgaattgagcaaacagattcacggtctcatcatcagatcaggaacttcagtagacctgtacgtggggagtgctctaattgatgcctattctaaatgttccctagtggatgatgccaaggctgtgtttcttatgatgcaaaacagggacatagccatatggaatgccatgatatttggccacacccagaatgagcaaggcgaagaggcagtaaaactcttcaaccagcttcgtatctctggggtaacacctaatgagttcacatttgtagcactagtaactgcggcaagcaacttggcaaccatgttccatgggcagcagtttcatgcccagatcattatagcaggtgctgacatggatcctcatgtttcaaatgctcttatagacatgtatgcaaagtgtggctttattaaagaaggatggttgttgtttgagtcaacatgtgggaaggatgtcatttgttggaactcaatgatttcgacatatgcacagcatggtcatgctgaagaagcccttagagttttccagctgatgagagaggccagattagaaccaaactatgtcacttttgttggtgtgctaacagcatgtgctcatgcaggtcttgtggatgaaggtttacaccattttaactctatgaaaacaaaatatggtattgaaac

SEQ ID NO: 42787 - protein, 237 aa, Panicum virgatum
  misc_feature: Ceres CLONE 2013476
  misc_feature (170)..(204): Pfam Name: PPR Pfam Description: PPR repeat
  misc_feature (69)..(103): Pfam Name: PPR Pfam Description: PPR repeat
NLLTFVSLLGVSSFQSASELSKQIHGLIIRSGTSVDLYVGSALIDAYSKCSLVDDAKAVFLMMQNRDIAIWNAMIFGHTQNEQGEEAVKLFNQLRISGVTPNEFTFVALVTAASNLATMFHGQQFHAQIIIAGADMDPHVSNALIDMYAKCGFIKEGWLLFESTCGKDVICWNSMISTYAQHGHAEEALRVFQLMREARLEPNYVTFVGVLTACAHAGLVDEGLHHFNSMKTKYGIE

SEQ ID NO: 42788 - DNA, 1334 bp, Panicum virgatum
  misc_feature: Ceres CLONE 2013478
  misc_feature: Encodes the peptide sequence at SEQ ID NO. 42789
acagtcacagcactgccctgcgctgctcaggtcagaacacgcagaggcgcggcaacagagaggtaagctcgtgccgagcaagaagacacgaaggagctgaaaggagaacgagttcgagagggagccggccgggcaacaatggctctgctcccgctcttcctctcgctcctcctcgtgtcctgcgcggcgcagtcgccggcctcgtcgccgtccgcgtccaaggctcctccggtcagcgccttggcgccgcaggcctccgtcgcgccaccgacaacggcagcctcggcgccgcagttctcgatcgcgccaccgacaaaggcagcctccgcgccgcgggcctctgccgcaccaccgacaacggcagcatcagcgccaaaggcctctgcgcagccaccagcaacagtatccgcgtcggcgccgcaggcatcggcgcagccaccaacaacggtagccgtgtcggctccggaggcctctgccgcgccgccaaccacagcggcctcagcgccgcaggtgtctgccacggcgccaaccacagccgcctccccgccgccgaccaccgctgccttgccgcctcaggtctccgccgcacctaccaccgccacctcgccgccactagcctccgccgcaccgccgaccacggccgcctcgccgcagctggctgccacgtcacctcccgttgcctctccgccactactagccgccgccgcgcctcctgtctctgcgacccctccagccaccttacctccgctcgcatcgccacctgcggccacgccgcctaccgtggccgcgccagcacccgcgacgccggctccagtggcctccccgcccctgacaatgccaccggcggcgcttcctccgtccaccctccctccagcaatggcgccgacgcctcttctcgctgccccgataatgccgcccaccgccacgcccgtcacggctcccgctccaacccccgtgtcgccggctccgagcgtcgccccgacaccgtcgcccacagaggccccgaccccatcgccggctctggcgccggagctggcgcccgcgctagcaccttcgctggcgccgctcagctcggtgtcggtgagcccgtcgctggcgccgggtcccgcgctcgctacggaggacgagtcggcggggccgagcgcgcgcaccgttggcggcgccgcgctggcggccttggcggccgccgggctcgtggtcttgttctaagtagagctacgtttaccgttgcttccgtactgctcgtcgcacgatctcgttctcttgttcgcgttttatggttgcatgtatgattcttgctgtaaaacacattgataatttatttctatttacgc

SEQ ID NO: 42789 - protein, 356 aa, Panicum virgatum
  misc_feature: Ceres CLONE 2013478
  misc_feature: Functional homolog of the protein sequence given in SEQ ID NO 50194
  misc_feature: Useful for making plants with altered cell wall content and/or composition
MALLPLFLSLLLVSCAAQSPASSPSASKAPPVSALAPQASVAPPTTAASAPQFSIAPPTKAASAPRASAAPPTTAASAPKASAQPPATVSASAPQASAQPPTTVAVSAPEASAAPPTTAASAPQVSATAPTTAASPPPTTAALPPQVSAAPTTATSPPLASAAPPTTAASPQLAATSPPVASPPLLAAAAPPVSATPPATLPPLASPPAATPPTVAAPAPATPAPVASPPLTMPPAALPPSTLPPAMAPTPLLAAPIMPPTATPVTAPAPTPVSPAPSVAPTPSPTEAPTPSPALAPELAPALAPSLAPLSSVSVSPSLAPGPALATEDESAGPSARTVGGAALAALAAAGLVVLF

SEQ ID NO: 42790 - DNA, 1244 bp, Panicum virgatum
  misc_feature: Ceres CLONE 2013491
  misc_feature: Encodes the peptide sequence at SEQ ID NO. 42791
  misc_feature (1098)..(1098): n is a, c, t, g, unknown, or other
  misc_feature (1112)..(1112): n is a, c, t, g, unknown, or other
attcttatccagttcacgcgaacagtaggtgaccaaaaccaaggagggccgccatgcacccagcactgttcatggagacgctccaagtccaagcagctcatgctgagctctttgcacgcgccttcctcgccctcgtcgccaccgttgccgtcctctacctcacgcggctgctgctcgcgccgctcaagaggcgcgccgccgccagcgccgccagctcgccttccctcccgcgcccgaggggcctccccctcatcggcaacctccaccagctcggcgcggtcccgcacgactccctcgccgcgctggccgccaggcacgacgcgccgctcatgctgctccgcctgggctccgtgcccacgctcgtcgtctccaccgccgacgcgctgcgcgccgcgttccagcccaacgaccgcgccatgtcggggcgcccggcgctgaccgcggccgccaggatcacctacggcctgcaggacatcgccttctcgccgccggacggcgccttctggcgcgccgcgcgccgcgcgtccctgtcggagctcctgggcgccccgcgcgtgcgcgccttccgcgacgtccgcgagggcgaggccgccgcgctcgtcgccaccgtcgcggccgcgtccgcggccggctcccccgtgaacctcagcgagatgctcatggcgacgagcaacaggatcctgcgccgcgtcgcgttcggtgacggcggggacgacgggagcatcgagttcggcgccgtcctcgacgagacgcagaagctcctgggcgctttcttcgtggccgactacatgccgtggctggggtgggtggacgcgctccggggcctgcggcggcggctggagcgcaacttccatgagctcgacgcgttctacgagaaggtgatcgacgaccacctcaacaagcgcgcggattccaaaggcgaggacttggtcgatgtgctcctccgcctgcacggccatccggcttaccggagcacgttcagcagccgtaaccggatcaaaggcatcctcacggacatgttcatcgctgggacagacaccaccgcggcgacggtggagtggacgatgacggagctgctccggcacccggacatcctcngcaaggctcagcangaggtgcgcggcggcggcggggacatcgtcctcgagtccgacctcccgcgcctcaagtacctgaagcaggtcatccgggagtcgatgcgggtgcacccgccagtgccgctactggtgccccgggagaacatc

SEQ ID NO: 42791 - protein, 396 aa, Panicum virgatum
  misc_feature: Ceres CLONE 2013491
  misc_feature (58)..(396): Pfam Name: p450 Pfam Description: Cytochrome P450
  misc_feature: SWISSPROT Homolog: EC 1.14.13.68 4-hydroxyphenylacetaldehyde oxime monooxygenase
  misc_feature (349)..(349): Xaa is any aa, unknown, or other
  misc_feature (353)..(353): Xaa is any aa, unknown, or other
MHPALFMETLQVQAAHAELFARAFLALVATVAVLYLTRLLLAPLKRRAAASAASSPSLPRPRGLPLIGNLHQLGAVPHDSLAALAARHDAPLMLLRLGSVPTLVVSTADALRAAFQPNDRAMSGRPALTAAARITYGLQDIAFSPPDGAFWRAARRASLSELLGAPRVRAFRDVREGEAAALVATVAAASAAGSPVNLSEMLMATSNRILRRVAFGDGGDDGSIEFGAVLDETQKLLGAFFVADYMPWLGWVDALRGLRRRLERNFHELDAFYEKVIDDHLNKRADSKGEDLVDVLLRLHGHPAYRSTFSSRNRIKGILTDMFIAGTDTTAATVEWTMTELLRHPDILXKAQXEVRGGGGDIVLESDLPRLKYLKQVIRESMRVHPPVPLLVPREN

SEQ ID NO: 42792 - DNA, 606 bp, Panicum virgatum
  misc_feature: Ceres CLONE 2013491-R
  misc_feature: Encodes the peptide sequence at SEQ ID NO. 42793
tgcgcggtgtacggctgcgagatcccggccgggacgcgggtgctcgtgaacgccagggccatcggccaggaccccggcgcgtggggccccgacgcggcgcggttcgtgccggagcggcacgcggaggtcgccgacctcagcgaccacaagccgtggcacgacagcttctcgctcgtgccattcggggtcggccggagaagctgccccggcgtgcacttcgccacctccgccgttgagctgcagctggccaacctgctcttctgcttcgactggcgcgcgcccaacggcgaggccgtggacctggagcaggagaccgggatgaccgtgcacaggaagaaccctctcgtgcttgtagcggaaaggagacgcgtgcagtgagatcacctcgttggcgtccttaagacgacgacgagtacgctttcgtgtagtattccgttgctgtatttcagtacgtaggaacctagcttgctatacatgtcgtcacgtatatccaatccctttattttttttagaatggatgctcgtatatcttcccttggaacgatttgttgttgcattattttgctacttcctcagttccaaattacaattcgttttagcttttct

SEQ ID NO: 42793 - protein, 125 aa, Panicum virgatum
  misc_feature: Ceres CLONE 2013491-R
  misc_feature: SWISSPROT Homolog: EC 1.14.13.68 4-hydroxyphenylacetaldehyde oxime monooxygenase
CAVYGCEIPAGTRVLVNARAIGQDPGAWGPDAARFVPERHAEVADLSDHKPWHDSFSLVPFGVGRRSCPGVHFATSAVELQLANLLFCFDWRAPNGEAVDLEQETGMTVHRKNPLVLVAERRRVQ

SEQ ID NO: 42794 - DNA, 665 bp, Panicum virgatum
  misc_feature: Ceres CLONE 2013497
  misc_feature: Encodes the peptide sequence at SEQ ID NO. 42795
gaacttgtcccaccagctagcagtcagtagcggtgttcttgcagaggcggccggccggctcgacgtgcgtcgacgatggggctccgccgcgactccgccgccgcgctggtggctctggtgctcgcggtcacctgctgctccgttgcaggttcttttgtgtagtgtcatcaattcattccttcatttgatccatgcatgctgattatttcatctgcttgcattgggttccttcttattgatcgttgcgttcatcgatcgatcgatcggtcagtagtggcctacgatcccctggacccgaacggcaacatcaccatcaagtgggacgtcatctcctggacgcccgacggctacgtggcgatggtgacgatgagcaactaccagatgtaccggcacatcatggcgcccgggtggacggtggggtggtcgtgggccaagaaggaggtgatctggtccatcgtgggcgcgcaggccacggagcagggcgactgctccaagttcaaggccggcatcccgcactgctgcaagcgcacccccgccgtggtggacctcctcccgggcgtaccctacaaccagcagatcgccaactgctgcaagggcggcgtcgtcgccgcctacggccaggaccccaccgccgccgtctccgccttccaggtctccgtcggcct

SEQ ID NO: 42795 - protein, 156 aa, Panicum virgatum
  misc_feature: Ceres CLONE 2013497
  misc_feature (52)..(156): Pfam Name: Phytochel_synth Pfam Description: Phytochelatin synthetase-like conserved region
  misc_feature: Functional homolog of the protein sequence given in SEQ ID NO 50600
  misc_feature: Useful for making plants with altered carbohydrate content
  misc_feature: Functional homolog of the protein sequence given in SEQ ID NO 50601
  misc_feature: Useful for making plants with altered cell wall content and/or composition
  misc_feature: The sequence is a functional homolog of SEQ ID NO 4 in US patent 7109001
  misc_feature: Functional homolog of the protein sequence given in SEQ ID NO 50602
  misc_feature: Useful for making plants with altered lignin content
MLIISSACIGFLLIDRCVHRSIDRSVVAYDPLDPNGNITIKWDVISWTPDGYVAMVTMSNYQMYRHIMAPGWTVGWSWAKKEVIWSIVGAQATEQGDCSKFKAGIPHCCKRTPAVVDLLPGVPYNQQIANCCKGGVVAAYGQDPTAAVSAFQVSVG

SEQ ID NO: 42796 - DNA, 692 bp, Panicum virgatum
  misc_feature: Ceres CLONE 2013501-R
  misc_feature: Encodes the peptide sequence at SEQ ID NO. 42797
ttgcagctggaagcagatcgcaaagccggtgatgtgcctctacagggagacgacggacggttcgaccatcgaggacagggagacgatcctcgtctggaactacgaggacgcggaccctgactttggctcgtgccaggccaaggagctcgtcgaccacctcgagagcgtgctcgcgaacgaacccgtgtccgtgaagaccacccctcactctgtcgaagtgaaaccgcagggcgtgagcaagggcctggtggcgcggcgcatgctggcgtcgatgcaggagcgcggccagtgcccggacttcgtgctgtgcatcggcgacgacaagtccgatgaggacatgttccagctgctcgccacggccccctgcggggcgtcgctggcgtccaaggcggaggtgttcgcgtgcaccgtcggccgcaagcccagcaaggccaagtactacctggacgacgcggcggaggtggtgaggctgatgctggggctctcctacgtctccgaggagctggccctggccaaccaccgggatgaagacgacgactcttctctggacgtgtgggaatagcagactagttgtaacgatcaattgggattgcttgcgttggcccacttggaggctggagctttcgccgagtagttagatgtgtaaatgaggtatggttttcagtataatgcactgtcagtgagtgagtctc

SEQ ID NO: 42797 - protein, 186 aa, Panicum virgatum
  misc_feature: Ceres CLONE 2013501-R
  misc_feature (1)..(152): Pfam Name: Trehalose_PPase Pfam Description: Trehalose-phosphatase
  misc_feature: SWISSPROT Homolog: EC 3.1.3.12 Trehalose-phosphatase
  misc_feature: Functional homolog of the protein sequence given in SEQ ID NO 50801
  misc_feature: Useful for making plants with altered carbohydrate content
CSWKQIAKPVMCLYRETTDGSTIEDRETILVWNYEDADPDFGSCQAKELVDHLESVLANEPVSVKTTPHSVEVKPQGVSKGLVARRMLASMQERGQCPDFVLCIGDDKSDEDMFQLLATAPCGASLASKAEVFACTVGRKPSKAKYYLDDAAEVVRLMLGLSYVSEELALANHRDEDDDSSLDVWE

SEQ ID NO: 42798 - DNA, 1136 bp, Panicum virgatum
  misc_feature: Ceres CLONE 2013501
tgagaaacccattcttttcttccgctcccgtttcttgtactttccttgatccgtctcccacaaggcgagggagattatcgcagtccctgtcactcctcgccgcctcgtcatggcgtcctatgcgactcgtttgtccccgtcgtctgattgattaatccgagggcatgggcgccggggataccaggtgagctcggaagatcggtcttgcgtaggaattgcggctataaagctctgttcccctcccctccacttcctcctcatgcaagatgagcagctcttgatcgcgtaggggttgaggagcagggcctctcgggtgcggctcggagattcttccggggttctctttctctgatctttttcctgcactttcctcgtctgatatttatcagcttcttttactccacttgagttgcttgctggcttcaaagcggtaggatttttactgcaaatagccagccagccagtctctgagccgacctttttccaccactccgctgtactcaggcgagaacaacaacgtcagtttgcagcagaagaaaaggtcctcccttgtattgaaagcacacaattcccccctctctcttcccaattgactctgtgggctgtggctgccctcgctcccaccactcgtagggtgagcatagtgatacaggtgtctgcttgttgaatccagtgtgcgccacttctcccacaagctctgcgagcttggtgctatcctggaactgcgtgccaaagctccggcaccaatcttggattctgcttcaaggacggtgcttcttgtagcaagaagcccaaacatttgatccaggcagctgctcggatccttgcgagaatcaggcggccggccatggtgtcccgctcctacaccaacctcctcgacctggccaccggcgcggcggaccaggcgccggcggcggccgcgctgggcgcgctccggcggcggctcccgcgcgcggtcaccaactcggggctcatcgacgacaccccggcgtcgccgtccgtcccgccgcggccgcgcaccatcgtggtggccaaccagctccccatccggtcccaccgcccggcgtcgccggaggagccctggaccttcgactgggacgaggacgccctcctccgtcacctccaccacacgtcgc

SEQ ID NO: 42799 - DNA, 293 bp, Panicum virgatum
  misc_feature: Ceres CLONE 2013526
  misc_feature: Encodes the peptide sequence at SEQ ID NO. 42800
aatggctcacaggtaaaaggctcccttcgcttcgcataccactctctcctcgtttctccggttcttcggggggggcaaaggcttccaggaaggagtcggacccgtgaccctagcgctgtcggggcagcctccggcgatggccgcggcggcgatcctgccggagctggcgacgcacgtgctcatcccggacgcggcggccgtaggcctcgcgttcccggtgctgcagtgggcgctcgtctccaaggggaggctcacccccgagcgccgcgccgacggcggtcttatttctaaaa

SEQ ID NO: 42800 - protein, 52 aa, Panicum virgatum
  misc_feature: Ceres CLONE 2013526
  misc_feature: SWISSPROT Homolog: EC 3.6.1.1 Inorganic diphosphatase
MAAAAILPELATHVLIPDAAAVGLAFPVLQWALVSKGRLTPERRADGGLISK

SEQ ID NO: 42801 - DNA, 609 bp, Panicum virgatum
  misc_feature: Ceres CLONE 2013540
  misc_feature: Encodes the peptide sequence at SEQ ID NO. 42802
ataaacttcttgtgcaaaagagcaaagcgacaagacaattagtagcaatccagtacacagattcacagaatggctagcgttcatggcagcaacgacttccatgtccgagtcgtgagccggcgcctcgtgaaggcctccgactcctccatcaagccgcacgtcatggccgtctccaacctcgacctcatcccacagaccatacagacatccatgttctgcatctacccccgaccgcccaccggcgacttcaacgccgccgtcgcagccttcgaggcaggcttgccttctttcctcaaccatttcttcccgttcgccggccgcatcgccaccaacccgagctccggccttcccgagttccactgcaacaaccaaggcgcggagctcttggtcggggaggccggcgtggccctggcgagcctggactacggcacgatgaccgcatcggtgcggcgggtccagcagccgtacggcggggacatggcgctgtcggtgcagctggtgtcgttcgcgtgcggcggcttcgccgtggcgtggtgcaccaaccatgtcctcgtggacgggagcgccctgagcatgctcgtcagcgcctggtccgagctcgcgaggtca

SEQ ID NO: 42802 - protein, 179 aa, Panicum virgatum
  misc_feature: Ceres CLONE 2013540
  misc_feature: SWISSPROT Homolog: EC 2.3.1.160 Vinorine synthase
MASVHGSNDFHVRVVSRRLVKASDSSIKPHVMAVSNLDLIPQTIQTSMFCIYPRPPTGDFNAAVAAFEAGLPSFLNHFFPFAGRIATNPSSGLPEFHCNNQGAELLVGEAGVALASLDYGTMTASVRRVQQPYGGDMALSVQLVSFACGGFAVAWCTNHVLVDGSALSMLVSAWSELAR

SEQ ID NO: 42803 - DNA, 1478 bp, Panicum virgatum
  misc_feature: Ceres CLONE 2013541
  misc_feature: Encodes the peptide sequence at SEQ ID NO. 42804
ccccaacgcaattccatcttctccaaatccaccccaaacttccaacatcccaacggagtcccctgttctcggcgcgatccgcccctccctccccttgctcgaggccggctgccctgaatcgaccgagaacgccgagttccgcagccgggatcgcccaaaggcacctgctttccgccgaatccgccgccgctgccgccatcgttgatgcgccggggccgggccgtcgagattccggcgtgaggtgcggttcctgacttcccgtgcgcgcggagaggagcgcccgccttccggccccgtcggccatggcgtgccggggattcttcgagtgcgtcctcaagctgctcaacctcgtcgtcatggcggtcgggctggccatggtgggctacggcgcctacctgctcgtgatgtggctgcaggtggtgccgccgccggcgccgccgctgccgccttctccgtcgccagcggcggtggctgccagcggcgagctggtgcggctcgggaggccgctgctgctcctggtcgaggcggccgccctgtcggacgggaccgcgaagaggctctccagtgcctggtttatttttgcggtcattggtgttggtgttgtgctcttcatcacatcgatctttggttgtgccggagctaggaatggatgctgcttgtctatttattcattcctcattattttgttcatactggtagagcttgctgcgggaggcttcattttcttcaaccataattggaaagaggtggtcccagttgacaaaactggtaactttgacatgatgtacaactttctgaaagagaattggagaattgcaaaatgggttgcacttggagctgttatatttgaggcattgctattcactgtggctatcatagtacagtcaggcaatcaagctgattatgacagtgatgatgaatacattggcccgaggtctggaataagacagccattggtaaatcagcatcagcaagctgctgctgatcctagggtgcccaatctcgactaccgcccaatccggaatgatgcatggagccaaaggatgagagaaaagtatggggtggatagcttcgatccaaacaggtttcaacaggccaccatatctcctgcagagcaaagaaaccgatgtacaattctctgaggcttggttgatatcaggcactagtgattccatgtttatatgcaactgtgcaattacatcgactcctggataatgcacgcctggtttatccgatgttgccatattgtgtagaatatggagagttttgcctttgcctgcctgtggccgttggtttgcagggtcagagctccatacttccactggtataggcactgaatctgtcagggttttgtgttaagtactgaacctagtttgtgtttcagttaatgtttcaatgtgcataaaacttctgtcttctgtctgtgaagtgattttcactatatgcaccatgtttaagccagacatgtttgttacgct

SEQ ID NO: 42804 - protein, 279 aa, Panicum virgatum
  misc_feature: Ceres CLONE 2013541
  misc_feature (6)..(183): Pfam Name: Tetraspannin Pfam Description: Tetraspanin family
MACRGFFECVLKLLNLVVMAVGLAMVGYGAYLLVMWLQVVPPPAPPLPPSPSPAAVAASGELVRLGRPLLLLVEAAALSDGTAKRLSSAWFIFAVIGVGVVLFITSIFGCAGARNGCCLSIYSFLIILFILVELAAGGFIFFNHNWKEVVPVDKTGNFDMMYNFLKENWRIAKWVALGAVIFEALLFTVAIIVQSGNQADYDSDDEYIGPRSGIRQPLVNQHQQAAADPRVPNLDYRPIRNDAWSQRMREKYGVDSFDPNRFQQATISPAEQRNRCTIL

SEQ ID NO: 42805 - DNA, 1293 bp, Panicum virgatum
  misc_feature: Ceres CLONE 2013546
  misc_feature: Encodes the peptide sequence at SEQ ID NO. 42806
acaaattttccaattttccaccctcccctcccccctccgtcgtcgtctgagttgccgtgacgagagtgggcagtggagcaggggggaggaaggagattccatagacaaaataggacacgtcttcctccgcgaagtgcgccctcctcctcgcttggcctccctcctcctcgcttggccgtaacccctcgcttctcgcgctgttcctttcctggttccaacaactcgtaaggccgccgttcgtctccgtctcgggggaagatggtgatcgcgcggcgcctgctccgatcaaatgcctccgcccaggcaagcagcttggtgaagtatgtaaccagcacagcaactttgcaagggcaagcagaatgtttgtcggatacatcaatcagacattttagttcagcgtcatctgcccaatctgactcaactgaagaaaatggatttaaggggcatggcatgttggcaccctttacagctggctggcagagcaatgacttgcatccactgattatcgagagatctgagggttcctatgtttatgacataaatggaaataagtacctagattctcttgcaggactatggtgtacagctttaggtggtagcgagcctcgattagtcaaagcagcaactgatcaattaaacaagttacccttctatcattccttttggaaccgcacaaccagaccttcattggatcttgcgcaggaaattcttagcatgttcactgcacgggaaatgggaaaagtgttcttcacaaatagtggttcagaagcaaatgactctcaggtcaaactggtatggtattataacaatgcattggggaggccaaacaagaagaaatttattgcacggacaaaagcataccatgggtctacattgatatcagcgagcttaactggtcttcctgccctgcaccagaagtttgatctgccagcaccttttgttctgcacactgactgccctcactactggcgttatcatctacctggtgagacagaagaagaatttgctactagacttgccacaaatttagagaatcttattctcaaagaaggaccagaaacaattgctgctttcattgctgaacctgtgatgggtgctggtggtgtcatccctcctccaaagacctattttgacaagattcaagcagtggtcaagaagtatgacattcttttcatagcagatgaggtcatcactgcatttggaagattgggaaccatgtttggatctgattattataacatcaaaccggatcttgtttcactagctaaagctctttcaaatgcctatgtaccc

SEQ ID NO: 42806 - protein, 344 aa, Panicum virgatum
  misc_feature: Ceres CLONE 2013546
  misc_feature (82)..(343): Pfam Name: Aminotran_3 Pfam Description: Aminotransferase class-III
  misc_feature: SWISSPROT Homolog: EC 2.6.1.62 Adenosylmethionine--8-amino-7-oxononanoate transaminase
MVIARRLLRSNASAQASSLVKYVTSTATLQGQAECLSDTSIRHFSSASSAQSDSTEENGFKGHGMLAPFTAGWQSNDLHPLIIERSEGSYVYDINGNKYLDSLAGLWCTALGGSEPRLVKAATDQLNKLPFYHSFWNRTTRPSLDLAQEILSMFTAREMGKVFFTNSGSEANDSQVKLVWYYNNALGRPNKKKFIARTKAYHGSTLISASLTGLPALHQKFDLPAPFVLHTDCPHYWRYHLPGETEEEFATRLATNLENLILKEGPETIAAFIAEPVMGAGGVIPPPKTYFDKIQAVVKKYDILFIADEVITAFGRLGTMFGSDYYNIKPDLVSLAKALSNAYV

SEQ ID NO: 42807 - DNA, 692 bp, Panicum virgatum
  misc_feature: Ceres CLONE 2013546-R
  misc_feature: Encodes the peptide sequence at SEQ ID NO. 42808
aaaagggatatcccgggccatgtcaggcagattgctccaaagtttcaggatggaattagggcatttgcagacagtccaattatcggggagatacgtggcttagggatgataatgggaactgaattcaccaataacaagtccccaactgatgtattccctgctgaatggggcgttggtgcgatctttgggcaggagtgccagaagcgcggcatgctggtgagggttgccggcgacgctatcatgatgtcgccgacactgatcatgacacctggggaagtcgacgagctggtgagcatctacggggaagcccttaaggccacggaggcgagggtggcggagctgaaatccaagaggagttagccaagcacgacgacaacgacgataaacgtcaggctgcgacgaacacagcggatgtacagaagaataagtttggggctgggagatggcaataatgctgcaacgggcactgttctttgatgggtaacaactgtgcaaggtagcagctgctctatcacttagcaacggtgaccagtaatatgaaggacatagatgtttttaaaccttattgatgagaacaaatatctcaaaagtgtgctgccctgttattcctgaagataatgtatttcataatccttattggtagaatattccgatacattttcaaaaaaaactccaatacataccttgtaatg

SEQ ID NO: 42808 - protein, 119 aa, Panicum virgatum
  misc_feature: Ceres CLONE 2013546-R
  misc_feature: SWISSPROT Homolog: EC 2.6.1.62 Adenosylmethionine--8-amino-7-oxononanoate transaminase
KRDIPGHVRQIAPKFQDGIRAFADSPIIGEIRGLGMIMGTEFTNNKSPTDVFPAEWGVGAIFGQECQKRGMLVRVAGDAIMMSPTLIMTPGEVDELVSIYGEALKATEARVAELKSKRS

SEQ ID NO: 42809 - DNA, 606 bp, Panicum virgatum
  misc_feature: Ceres CLONE 2013556-R
  misc_feature: Encodes the peptide sequence at SEQ ID NO. 42810
cgcaaatgggagacaaagtgtatatccagggattgggaggaggaactgtggctactgttattgaaactcttggagaagatgggagctgcatcgttcaatatggaaagataaaggttcaagtcaagagaagtaagatgaaattggttcaacgaggtacaaatgaaacagcaacttcctcttctgtaaaaccaaagggccgaacgccgaagcagcgatctgcagcagcggagacgaaccagagccaagatgggagcgtctctttcggccccgttgtgcagacgtccaagaacacggtggatctgcgcgggaagcgggtgagcgaggcgtcttatgagctccagatggccatcgacgcgtgcaggccttaccaggtactcttcgtggtccatggcatgggcaccggagccgtgaaggactgcgccattgatgttctccggaaccaccctcgagtggccaagttcgaagacgagagccccctcaactacggctgcactgtcgcctatattcagtaaacagacattcttacaagcagcactcgcctatatatacagcctgtatgacagggtttccttggaactctgaagccatggcctggtctgatttgtg

SEQ ID NO: 42810 - protein, 169 aa, Panicum virgatum
  misc_feature: Ceres CLONE 2013556-R
  misc_feature (98)..(169): Pfam Name: Smr Pfam Description: Smr domain
QMGDKVYIQGLGGGTVATVIETLGEDGSCIVQYGKIKVQVKRSKMKLVQRGTNETATSSSVKPKGRTPKQRSAAAETNQSQDGSVSFGPVVQTSKNTVDLRGKRVSEASYELQMAIDACRPYQVLFVVHGMGTGAVKDCAIDVLRNHPRVAKFEDESPLNYGCTVAYIQ

SEQ ID NO: 42811 - DNA, 1460 bp, Panicum virgatum
  misc_feature: Ceres CLONE 2013556
tcccgccatccatcatccatggccatggcagccaccgcgaagcttacccttctcctcccaaccaccctcacctctactgtctccttccccacccgcgtcgtactgaagccattccctccgctgcaacgcctcgtagttgccgccgccgccgccgcctcgtcctcccaaaccttgtcatcgtcccactcgtttgaaacaccggaggccaggcagatacgtctagagacggagtccgccctggaatggggcagcgtatgcgcgcggctggccgacttcgccgccaccgccgccggccgcgccgcatgcgtggaaggtcgggtcgccgtcgggcggagccgggaggagagcgagaggctgatcgagcagacggccgcggcggtgcttttgtcggcgccactggacttcggtggcgtggaggacgtgtccgcggtagtcgccgcggcgaccggtgggcggttgctcgccgtgcgagagatttgtggagtcgggcgcagcatccgggccgcccgcggagtgttcgatcaattgcagagcctcgcccaggaaacgcaagacgggaggttctctcctcttctggatgtactgcaaggttgtgatttcttgacggaacttgtgcaatggatagagttttgccttgattccactctttctctggtcctggatcgcgccagcaagaagctagaaacaattcgcagagaaaggaggaggaacatcgagatgttagaatctctgttgaaagatacagcttcaaagattttccaagctggtgggattgatagtcctgtggtcactaagcgccgttctaggatgtgtgttggtgtgaaagcttcacagaagaatttggtgcctggtggaatcattctaagttccagtggctctggtgcaacgtactttatggagccaagggaagctgttgagcttaacaacagggaagttaaactctcaggtgatgagagagcagaggaattagtaatattgggcttgctaacttcaagtatcgcagactcccaactgaagatcagaaatttgatggacaagattttggagttggaccttgcatgtgctagagggtcgtatgcactatggacaaatggtgtcaaaccaagcttcagtgacagttatagcagcagccagtcggatcagagcagcgactattcagtttatattgagggcattcggcatcctttgctacttgaacagtctcttatggcagaagattcaaatatagaagcatctgaaatgcctgttccattggacatgtgggtgaaaaaggatgcaaggattgttgtgatctctggacccaacactggaggcaaaactgccactatgaagaccttggggctgtcctcacttatgtcaaaagctggaattttcttcccagccaaaggaaggcctaggattccatggttcgatcaggttcttgcagacattggtgatcaccaggtagtctctgtcctttg

SEQ ID NO: 42812 - DNA, 759 bp, Panicum virgatum
  misc_feature: Ceres CLONE 2013575
  misc_feature: Encodes the peptide sequence at SEQ ID NO. 42813
cttcgaacacacaacacaaaccctcccctcgcctccgccgccccgccgccgccgaggaggaggaggaggaagaagcacaagcgccggccaagatgaagaccattctggcgtcggagacgatggacatcccggaggaggtgacggtgaaggtggccgccaaggtggtgacggtggagggcccccgcgggaagctcacccgcaacttcaagcacctcaacctcgacttccagctgcaggagggcggccgcaagctcaaggtcgacgcctggttcggcacccgccgcaccatggccgccatccgcacagccatctcccacgtccagaacctcatcaccggcgtcaccaagggataccgctacaagatgaggttcgtctacgcccacttccccatcaacgcctccatcaccaacgccaacaccgccatcgagatcaggaacttcctgggagagaagaaggtccggaaggtggacatgcttgagggtgtgaccatcttgcgctccgagaaggtcaaggatgagctcatcctcgacggcaacgacatcgagctcgtctcccgctctgccgccctcatcaaccagaaatgccatgtgaagaacaaggatatcagaaagttcttggatggcatctacgtcagtgacaagggtgcccattatgaggagcagtgagcttcattatctgcctagtcattagttaaaatgcctggagacggtcctcaagtgctgtttctgtatgctgtgtttctatcatcctttggggtgg

SEQ ID NO: 42813 - protein, 190 aa, Panicum virgatum
  misc_feature: Ceres CLONE 2013575
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MKTILASETMDIPEEVTVKVAAKVVTVEGPRGKLTRNFKHLNLDFQLQEGGRKLKVDAWFGTRRTMAAIRTAISHVQNLITGVTKGYRYKMRFVYAHFPINASITNANTAIEIRNFLGEKKVRKVDMLEGVTILRSEKVKDELILDGNDIELVSRSAALINQKCHVKNKDIRKFLDGIYVSDKGAHYEEQ

SEQ ID NO: 42814 - DNA, 684 bp, Panicum virgatum
  misc_feature: Ceres CLONE 2013600
  misc_feature: Encodes the peptide sequence at SEQ ID NO. 42815
aaccatcacctccccataacacaaggttaaccaaaaggctttgcaaggaaggttgtgtagtagcttggaagccatggggaagcacctctccatggcggcatccattttcttcatggccattgtcgccctgaccgccattggcgaggcagccatcgtcgagcacacctttgttgtccatgagatgaacatgactcacctgtgcaacacgaccaaggtgtacgtggtgaacgggcagctccctggcccgcagctcgacgtcaccgacggcgacacggtgatcgtccacctcgtcaaccagctgccgcacggcgtcaccatccactggcacggcatccggcagctccgcagctgctgggccgacggcgccggctacgtcaccgagtgccccgtccctcccggcggcaaccgcacctaccgcttcgacgtcgccggccaggtcggcacgctctggtggcacgcccacgtcacctgcctccgcgcctccatccatggcgccatcgtcgtccgccccaaggacggccggtacccgttcccgaccccggccagggacgtgcccatcgtcatcggcgagtggtggacgctcgacctcgtcgagctcgaccggcggaacctcgacggcaacttcgaggacgacccgctgtcggccaccatcaacggcaagctcggcgacctcaccaactgctc

SEQ ID NO: 42815 - protein, 203 aa, Panicum virgatum
  misc_feature: Ceres CLONE 2013600
  misc_feature (33)..(149): Pfam Name: Cu-oxidase_3 Pfam Description: Multicopper oxidase
  misc_feature: SWISSPROT Homolog: EC 1.10.3.2 Laccase
MGKHLSMAASIFFMAIVALTAIGEAAIVEHTFVVHEMNMTHLCNTTKVYVVNGQLPGPQLDVTDGDTVIVHLVNQLPHGVTIHWHGIRQLRSCWADGAGYVTECPVPPGGNRTYRFDVAGQVGTLWWHAHVTCLRASIHGAIVVRPKDGRYPFPTPARDVPIVIGEWWTLDLVELDRRNLDGNFEDDPLSATINGKLGDLTNC

SEQ ID NO: 42816 - DNA, 588 bp, Panicum virgatum
  misc_feature: Ceres CLONE 2013616
  misc_feature: Encodes the peptide sequence at SEQ ID NO. 42817
accaggcagcaggggattgcgcaggtctctatcgcccccttcacagcctcccagctcccaggcaccacccgcgtccaccgccgcctaaaccctctgctctcctcaggagctgcgagggtagggcgacgacgaggaggaggaggaggtcgggatggcggacgccaagcagcagcaggcggtggcgccaagcgccgcgtggatgacggtgaagcccttcgtcaatggcggcgcctctggcatgctcgccacctgcgtcatccagccaatcgacatggtcaaggtcaaaatccaactgggagagggctctgcagctaccgtcaccaagaagatgcttgctaatgagggaatcggttccttttacaagggattatcagctggtttgctaaggcaagccacgtacacaactgctcgtcttggatccttcagggttctaacaaataaagcggttgaagcaaatgagggaaagccactaccgctactgcaaaaagctgttattggtctcactgctggagcaattggagcatctgttggtagtcctgcagatttggcactcattaggatgcaggccgattcaaccctgccggctgc

SEQ ID NO: 42817 - protein, 145 aa, Panicum virgatum
  misc_feature: Ceres CLONE 2013616
  misc_feature (21)..(98): Pfam Name: Mito_carr Pfam Description: Mitochondrial carrier protein
  misc_feature: Functional homolog of the protein sequence given in SEQ ID NO 51083
  misc_feature: Useful for making plants with modulated biomass
MADAKQQQAVAPSAAWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPA

SEQ ID NO: 42818 - DNA, 695 bp, Panicum virgatum
  misc_feature: Ceres CLONE 2013620
  misc_feature: Encodes the peptide sequence at SEQ ID NO. 42819
attccgagactcgtgttcatcagcctggccatccgacggcatcctaaattctgaaatttctatcgtcgacaggggagtggcgccgcccttgccggttcttcgtcgggagcttcgccggcgacaagagaatctcggtggttctagctgaactcgcgcccctgctatgcacccagtttcagtctccttgcagcctttccctgcaactccggcaagcatacttgtcccaaggagcgcagctgggaggaattccatcgattttgccgagttgcggagagctggaaggtctagtggaaaccttgctatgaattccatacagaatcctgcccgtgggtcagaaacgtctgggagtgaggatttcaatgtgggggataaggatgccgtggtcattgtcgaccatgggtcacggcgccaagaatccaatctcgtgctgaatgactttgtcgagatgttcagggcacgaactggttataagatcgttgagcctgctcatatggagctggctgagcctactattaaggatgcttttggaaaatgtgtgcaacaaggggcatcccgtgttattgttagtccatatttcctttcccctggacgacattggaaacaagatatccctgctttagcagcagaagcatccaaggagctctcaaatataccctatattgtcactgcccctcttggactgcatgagcttatgg

SEQ ID NO: 42819 - protein, 177 aa, Panicum virgatum
  misc_feature: Ceres CLONE 2013620
  misc_feature (78)..(177): Pfam Name: CbiX Pfam Description: CbiX
  misc_feature: SWISSPROT Homolog: EC 4.99.1.3 Sirohydrochlorin cobaltochelatase
MHPVSVSLQPFPATPASILVPRSAAGRNSIDFAELRRAGRSSGNLAMNSIQNPARGSETSGSEDFNVGDKDAVVIVDHGSRRQESNLVLNDFVEMFRARTGYKIVEPAHMELAEPTIKDAFGKCVQQGASRVIVSPYFLSPGRHWKQDIPALAAEASKELSNIPYIVTAPLGLHELM

SEQ ID NO: 42820 - DNA, 1170 bp, Panicum virgatum
  misc_feature: Ceres CLONE 2013632
  misc_feature: Encodes the peptide sequence at SEQ ID NO. 42821
gcaccacctccaacgcgcgtagtattaaccagagtggagaaaaatggaggttgtggtgaaaaggtcaccgtcaacggtggtgaggccagcggagccggagccggcggcggcgacgaacggcggcggcggcaccataaagctctcgcccttcgacacggtttgcgccatgacgccgatcacggcgttgctcgtgttcgagcacccgatccgcgaggccgccgagaccttgaagggagcgctttcccgagcgttggtcccctactaccctctttcaggtcgcttggttgcagggcccgacgaggtccacatggaccacatccggtgcagcggcgagggcgcggaattcgtcgccgcctccgcgaaccgtgccttgaaggacgtcgaattcttcgcacggtcgcctggcacgaccacgccgcagctggtggaggagctcatcgccatcttccacccggccgagcgctgcggccccgccgacccgttgctgctgatgcaggtgacggagttctcctgcggcgggttcgtcgtggccgtgacctggaaccatggcgtcgccgacggcgtcgggatggcccagttcctgcaggccgtcggcgagctcgcgcgcggatcgccgtcgccatcccttgctccggtcagatgggacgaatcgcycctcagcctccctcctcccaccgtccagagcaacaagccgttgggcctcgtctgcctcgacgtcaccgtcccctcgagcacgatcgagcgcctcagagctgagttccacgagcgcgccaactccaatggccgccaccggacttgcaccgagttcgaggcggtcgccaccgtgctatggcagtgccgcactcgcgcgatcgcctccaacccggatttcccggctctgctcaccttcacagctgacgtgcgcaggcatgtgaaggctaaggatggctactacggcaactgcatcgtgacgcagcgagtcatggcgacagccggcacggtggcgaaggcggacgtcaccgacctgatcgagatgatcaagcgtgccaaggatgaggtgcctgaccagctgctcgcgaagaacgacgacggctgcaatggcgacgaccatcagccagccatggatgagaagctgctcgacgagctccggtacaacctgcaccaactgtccacgtggcggaacatcggctt

SEQ ID NO: 42821 - protein, 375 aa, Panicum virgatum
  misc_feature: Ceres CLONE 2013632
  misc_feature (3)..(375): Pfam Name: Transferase Pfam Description: Transferase family
  misc_feature: SWISSPROT Homolog: EC 2.3.1.167 10-deacetylbaccatin III 10-O-acetyltransferase
  misc_feature (204)..(204): Xaa is any aa, unknown, or other
MEVVVKRSPSTVVRPAEPEPAAATNGGGGTIKLSPFDTVCAMTPITALLVFEHPIREAAETLKGALSRALVPYYPLSGRLVAGPDEVHMDHIRCSGEGAEFVAASANRALKDVEFFARSPGTTTPQLVEELIAIFHPAERCGPADPLLLMQVTEFSCGGFVVAVTWNHGVADGVGMAQFLQAVGELARGSPSPSLAPVRWDESXLSLPPPTVQSNKPLGLVCLDVTVPSSTIERLRAEFHERANSNGRHRTCTEFEAVATVLWQCRTRAIASNPDFPALLTFTADVRRHVKAKDGYYGNCIVTQRVMATAGTVAKADVTDLIEMIKRAKDEVPDQLLAKNDDGCNGDDHQPAMDEKLLDELRYNLHQLSTWRNIG

SEQ ID NO: 42822 - DNA, 1659 bp, Panicum virgatum
  misc_feature: Ceres CLONE 2013635
  misc_feature: Encodes the peptide sequence at SEQ ID NO. 42823
aagaaaaggtggaaagagacgagggagtcggagctcgcaggctctgctccgctgccctcaccgtcccttggctatttttcctcgccgccgccgccgccgcctacatttctccatcgccaccacacgcattcctgcaccaccgccgcccacccgaacctacccttctcctcgcaatacaactacataaaactaaccgccgccactctgcacctaggccgaagccgcaatcccccgagcgagctagctccaatggcggccgcctcgtcgttgcgcgccgcgcctttcgcagccgcagcgccggtggggcccgctggtctcggatctgcctgaggcaaggctagcgcactcggagctttgctggcattggagcggcttgccgtttcggcagcggcggggggatagctcgttgctgcggcgggacgaccaggggaatttggcttcgcggcgggcggcggtatccaagcacagcagataagaccgttattgtcacagtgcagaatatggctatcaagattcagcacttgtccttcattgccattacagttttcgcttcactccatccttgtgtgtccattgagttccgccatgagctctccagctggaccactggcatcgctacgtggtatggtgatcctaatggcgctggaagtgaaggtggtgcatgtgggtaccagtatgctgttgaccaaccaccattctcgtccttgattgctgctggcagccctttcatctacgactctggaaatgggtgtggttcttgctaccaggtggtatgctctgggaatcaaccttgctctggataccctgtgactgttgtcatcaccgatcagggccctggtggtggtccgtgcctgagccaagcaagtgatggcatgtgcctaaatgagggagcccacttcgacatgagtgggacggcgtttggtgccatggcaaagcctggaatggccgatcagctccgtggtgctggcatcctacaaatccaatacactcgggtgcagtgcgaatggcctggagtggatgtaaccttctcagtggactccggttcgaacccaaactatctggccgtggtcattgagtatgaggacagtgatagtgacctatcagctgtggacatcatgcagagctcgacggggcagtgggttccgatgcagcattcgtggggtgcagtgtggaggcttgactctggctccacccttcagggcccgttccatatccgcctgacattcaactcaggcagggtgctcattgccagcaacgccacacctgcagggtggaatgccggcgtgtcataccggtcaggaggcgtagcagtgaccagggccaggcccaggagtgctgggtgccgggtctacaaggcagcaggtgcaattagcgatttgttgtatcaccttctcctgttgtttgtggtattggcattgtgaattccgatgcaaatgcagctttcgtagttttgggatgcagattagggacccgggtggacttagttgtgtattttgatattttcttgtagctgaggccttagatgatggagtacccgtggtgttgtaggcgtttttgttgtggtcttgtttctgtatgcaactgatctggttggacaatacccatccatgtaaagcgtttcatgaaactgatggttaagcaacctggctccaatttccc

SEQ ID NO: 42823 - protein, 306 aa, Panicum virgatum
  misc_feature: Ceres CLONE 2013635
  misc_feature (174)..(255): Pfam Name: Pollen_allerg_1 Pfam Description: Pollen allergen
  misc_feature (70)..(162): Pfam Name: DPBB_1 Pfam Description: Rare lipoprotein A (RlpA)-like double-psi beta-barrel
  misc_feature: Functional homolog of the protein sequence given in SEQ ID NO 50507
  misc_feature: Useful for making plants with altered carbohydrate content
MAIKIQHLSFIAITVFASLHPCVSIEFRHELSSWTTGIATWYGDPNGAGSEGGACGYQYAVDQPPFSSLIAAGSPFIYDSGNGCGSCYQVVCSGNQPCSGYPVTVVITDQGPGGGPCLSQASDGMCLNEGAHFDMSGTAFGAMAKPGMADQLRGAGILQIQYTRVQCEWPGVDVTFSVDSGSNPNYLAVVIEYEDSDSDLSAVDIMQSSTGQWVPMQHSWGAVWRLDSGSTLQGPFHIRLTFNSGRVLIASNATPAGWNAGVSYRSGGVAVTRARPRSAGCRVYKAAGAISDLLYHLLLLFVVLAL

SEQ ID NO: 42824 - DNA, 650 bp, Panicum virgatum
  misc_feature: Ceres CLONE 2013655
  misc_feature: Encodes the peptide sequence at SEQ ID NO. 42825
aagtacccggaggagtagccgccgccgcgaacacaggagcagcgggaacatacaggaccggcaagatgcagatcttcgtgaagacgcttactgggaagaccatcaccctcgaggtcgagagcagcgacaccatcgacaatgtcaaggccaagatccaggacaaggaaggaatcccgccggaccagcagcgtctgatcttcgccgggaagcagctggaggatggccgcactctggcggactacaatatccagaaggagtccacgctccaccttgtgctcaggctccgtggtggaattattgagccctcgctgcaggcgctcgcgcgcaagtacaatcaggacaagatgatctgccgcaaatgctacgcacgcctgcaccccagggccgtcaactgccgcaagaagaagtgtggtcacagcaaccagctgaggcccaagaagaagatcaagaactgaggtgtgttgctgctaatcagtttcatcgaccgtttaaatcatctgttgtagcggtgtatcgtgtgctatgttgtgttgttgtccggatgttgaaccgtgtctgtttatccaaacttttcggcctgccgtgatgtttcaccctgttgtcgatgatgacacttatatatggcaatacataccactatgctcttgcaa

SEQ ID NO: 42825 - protein, 129 aa, Panicum virgatum; identical to SEQ ID NO: 41506
  misc_feature: Ceres CLONE 2013655
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency

SEQ ID NO: 42826 - DNA, 673 bp, Panicum virgatum
  misc_feature: Ceres CLONE 2013666
  misc_feature: Encodes the peptide sequence at SEQ ID NO. 42827
tacgcggtcacacgcaactcccctagcaggacgacggccagcacccaccctccacgggtcaaccacccccctcctcttcaaaactcccccacccggccaccttgctcagtccgcaacccaccgccaggaaaggctcacggctccccgtcgaccccgagcgtccggccgcgcggccccctctccacgcgccgctgatcgcgcgcgcgagcggtcaagccagctaccccaggggaaggatcggagcgcggcgtcgcagctcacctcagctctgccgccgccgccgccgcctccggccggctggcggctagaggtagctagcagccatgtacgcggcgaaccactggggcgggtcgttcgagatcgccgacggggcggcggaggacgaccacagccgcaacatggacctggaccgcggcgcgctgtcgcggcagcagcaccacgagctggacgagacgcagcagagctggctgctcggcccgccggaggccaagaagaaggacaagtacgtcgacctcggctgcgtcgtcgtcaagcgcaagctcctgtggtgggccgtctggtgcgtcgtcggcgccttcgtcctcatcggcctccccatcatcatcgccaaggccatcccccacaagaagcccggcccgccgccgcccgaccagtacaccgaggcgctccacag

SEQ ID NO: 42827 - protein, 116 aa, Panicum virgatum
  misc_feature: Ceres CLONE 2013666
  misc_feature: SWISSPROT Homolog: EC 3.2.1.4 Cellulase
  misc_feature: Functional homolog of the protein sequence given in SEQ ID NO 50501
  misc_feature: Useful for making plants with altered carbohydrate content
  misc_feature: Functional homolog of the protein sequence given in SEQ ID NO 50500
  misc_feature: Useful for making plants with altered cell wall content and/or composition
MYAANHWGGSFEIADGAAEDDHSRNMDLDRGALSRQQHHELDETQQSWLLGPPEAKKKDKYVDLGCVVVKRKLLWWAVWCVVGAFVLIGLPIIIAKAIPHKKPGPPPPDQYTEALH

SEQ ID NO: 42828 - DNA, 650 bp, Panicum virgatum
  misc_feature: Ceres CLONE 2013673
  misc_feature: Encodes the peptide sequence at SEQ ID NO. 42829
gtctcaatctcaactccaaaacctcgcaacaaagcccgtgagcgaccaacccccaccccatccatcctctccttcctcgcagaacccaccaaccccggcggcgatgaccggcacagtgtccaagctggcggcgccccggccggcggcggcgctgctcccgccggcgtccctccgctccgccgccctcgccttcgccccctccccgcgccggttccgcgtctccatcgccggccgcgccaggagccccgtcattgcgatggcttctgccaaggaagggaatggtgctccgaccaagaagaccgcacttcacgatctctatgagctccagggcctgtcaccatggtacgacaacctctgcaggcctgtcaccgacttgctgccccttatcgccagtggtgttcgcggagtcaccagcaaccctacgattttccagaaagccatttcatcatcaagcgcatatgatgatcaattcaagcagctcattacacatatgcaatggctgctagtcgtgttgaaaatctgggtcttggccaaggtctagcgatgggcattctaaatttagctatcgtcataccacaggttattgtgtcacttggtagtgggccatgggatcaactgtttggcggtgggaatgcgccgggttttgcggt

SEQ ID NO: 42829 - protein, 145 aa, Panicum virgatum
  misc_feature: Ceres CLONE 2013673
  misc_feature: SWISSPROT Homolog: EC 2.2.1.2 Transaldolase
MTGTVSKLAAPRPAAALLPPASLRSAALAFAPSPRRFRVSIAGRARSPVIAMASAKEGNGAPTKKTALHDLYELQGLSPWYDNLCRPVTDLLPLIASGVRGVTSNPTIFQKAISSSSAYDDQFKQLITHMQWLLVVLKIWVLAKV

SEQ ID NO: 42830 - DNA, 689 bp, Panicum virgatum
  misc_feature: Ceres CLONE 2013674
  misc_feature: Encodes the peptide sequence at SEQ ID NO. 42831
gtccttcctcgtcgtctcggtcttggaagcaagcaaggtagctgcacggaggcaaccgcgcagtaaggtgattcctcttgcctgactgagctccactacctctgcgagcacttgtccgtcttttgcctggtgctcttggttctctgggatgatgaggcgcaggcagctcttgctggcgactgcctgcttgtgggctctgtcgtgcgccccgctgctccgtgcttccacccctgacggacttctcagggtcggcctgaacaagaacaagctcgaccgcgaggcgctggccgcggccaaggttgaaaggcagcacgacagccgccgcctgagggccgccggcgccgacgaggtccctctcatcgactacctcaacacccagtacttcggggtcgttggcatcggcacgccgccgcagaacttcaccgtcatcttcgacactgggagctccaacctctggatcccctcctccaaatgctatttctcgatagcattttacttccaccacagatacaagtccggcaagtctagcacttacaaagctgatggtgaggcttgcgaaattacttatggctctggatcaatttccggattcttcagcaaggataacgtgctggttggagaccttgttgttaaaagccagaagttcattgagactactcgcgaacccagtttctcattcatccttgggg

SEQ ID NO: 42831 - protein, 180 aa, Panicum virgatum
  misc_feature: Ceres CLONE 2013674
  misc_feature (77)..(180): Pfam Name: Asp Pfam Description: Eukaryotic aspartyl protease
  misc_feature: SWISSPROT Homolog: EC 3.4.23.40 Phytepsin
MMRRRQLLLATACLWALSCAPLLRASTPDGLLRVGLNKNKLDREALAAAKVERQHDSRRLRAAGADEVPLIDYLNTQYFGVVGIGTPPQNFTVIFDTGSSNLWIPSSKCYFSIAFYFHHRYKSGKSSTYKADGEACEITYGSGSISGFFSKDNVLVGDLVVKSQKFIETTREPSFSFILG

SEQ ID NO: 42832 - DNA, 700 bp, Panicum virgatum
  misc_feature: Ceres CLONE 2013679
  misc_feature: Encodes the peptide sequence at SEQ ID NO. 42833
tgaagacaacaaacattctcctggatgagaaatgggttgccaaggtttctgattttggtctgtccaagactggcccatctatggatcacactcatgtgagcacagttgttaagggcagttttggttacctcgatcctgaatacttccgcaggcagcagctcaccgagaaatctgatgtctactcttttggtgttgtactgtttgaggtcctctgcgcacggcctgccttgaatcctactcttccaaaggaagaagttagcttggcagagtgggcgttgcactgccagaagaagggcattcttgatcagattgttgatccctacctgaagggaaagattgctccacagtgtttcaagaagttcgctgagacagctgagaagtgtgtttctgatcagggcattgaccgcccttcaatgggcgatgttctctggaacttggagtttgcccttcaaatgcaggaaagtgcagaagagagtggaagccttggctgcgggatgtcagatgagggcactccccttgtgatggtcggaaagaaggatcccaatgacccgtccatcgaatcgagcaccaccacaaccaccaccacttctatcagcatgggcgatcaaagtgtcgcaagtatggactcagacgggctgacgcctagcgctgtcttctcacagatcatgaaccccaagggggcggtgaggtaaaagctgtt

SEQ ID NO: 42833 - protein, 229 aa, Panicum virgatum
  misc_feature: Ceres CLONE 2013679
  misc_feature: SWISSPROT Homolog: EC 2.7.11.1 Non-specific serine/threonine protein kinase
KTTNILLDEKWVAKVSDFGLSKTGPSMDHTHVSTVVKGSFGYLDPEYFRRQQLTEKSDVYSFGVVLFEVLCARPALNPTLPKEEVSLAEWALHCQKKGILDQIVDPYLKGKIAPQCFKKFAETAEKCVSDQGIDRPSMGDVLWNLEFALQMQESAEESGSLGCGMSDEGTPLVMVGKKDPNDPSIESSTTTTTTTSISMGDQSVASMDSDGLTPSAVFSQIMNPKGAVR

SEQ ID NO: 42834 - DNA, 1198 bp, Panicum virgatum
  misc_feature: Ceres CLONE 2013690
  misc_feature: Encodes the peptide sequence at SEQ ID NO. 42835
tgtccccctgcgcccctaccttcttccgctctccaccgtggcatcgcctccacgccgggcgctgctggaaagttttaaaacccacggggagctcggaggcgcgacgaccgccgcttcccccccctgccattgccgacgaagggagtgcgggagcgacctcgggcggcggggtccttcagcgtcgcgtcggcgatctgcgatgatgaacctgcgcgtcgccaccgcggcgcccgctgcgcccggcgtgcgcgtgctcggcgggggcgttgcgcgcgtgccgccgcggccgtgggcgctccgcggcagcagacgcctctccgtgcggatgtccgtcgcgaccaccgaggccgccaccgccgtgggcgcctccgaggacgaggcgctggaggccaggaactccaagacggtggtggcggtcatcctcggcggcggcgccgggaccaggctcttcccgctcaccaagcgcagggccaagcccgcggtgccgattggcggcgcgtaccggctgatcgacgtgccgatgagcaactgcataaacagcgggatcaacaaggtgtacatcctcacccagttcaactcggcgtccctcaaccgccacctctccagggcctacgatttcagcaatggcgtggcgtttggagacggattcgtcgaggttctagcagcaacacagaggcctggaacggagggaaagaggtggtttcagggtacagccgatgcagttcggcagttcgactggctttttgatgatgccagagccaaagacattgaagatgtgctgattctttctggtgatcacctctaccgtatggattacatggactttcttcagagtcatcggcaaagaggtgcaggcatcagcatctgttgtttgccaattgatggcagccgggcatctgattttggtctaatgaagatagatgacaccggaagaataatttcattcagcgagaagccaaaaggagatgatttaaaggcaatgcaagttgacaccacggtgcttggcttatcaaaagaggaagcagagcagaaaccctacatagcgtcaatgggggtttatatttttaagaaagacatactcctaaaccttttaagatggcgttttcccactgcgaatgattttggttctgaaataattcctgcttccgcaaaggaaatcaatgtaaaggcatatctttttaatgattactgggaagat

SEQ ID NO: 42835 - protein, 331 aa, Panicum virgatum
  misc_feature: Ceres CLONE 2013690
  misc_feature (70)..(331): Pfam Name: NTP_transferase Pfam Description: Nucleotidyl transferase
  misc_feature: SWISSPROT Homolog: EC 2.7.7.27 Glucose-1-phosphate adenylyltransferase
  misc_feature: The sequence is a functional homolog of SEQ ID NO 39 in US patent 7312378
  misc_feature: The sequence is a functional homolog of SEQ ID NO 38 in US patent 7312378
  misc_feature: The sequence is a functional homolog of SEQ ID NO 37 in US patent 7312378
MNLRVATAAPAAPGVRVLGGGVARVPPRPWALRGSRRLSVRMSVATTEAATAVGASEDEALEARNSKTVVAVILGGGAGTRLFPLTKRRAKPAVPIGGAYRLIDVPMSNCINSGINKVYILTQFNSASLNRHLSRAYDFSNGVAFGDGFVEVLAATQRPGTEGKRWFQGTADAVRQFDWLFDDARAKDIEDVLILSGDHLYRMDYMDFLQSHRQRGAGISICCLPIDGSRASDFGLMKIDDTGRIISFSEKPKGDDLKAMQVDTTVLGLSKEEAEQKPYIASMGVYIFKKDILLNLLRWRFPTANDFGSEIIPASAKEINVKAYLFNDYWE

SEQ ID NO: 42836 - DNA, 641 bp, Panicum virgatum
  misc_feature: Ceres CLONE 2013716
  misc_feature: Encodes the peptide sequence at SEQ ID NO. 42837
atacacacagtagccatttacacatcaaccatggcaagaacaccagcaacaatcttgcacctgcttctcgtagccctttgcatcctctccatccaaacaacaccctcctcagcttccagcgacgtgcatggcttgctcagctgcctctccggcggcatcccatcttccctcatccagaccccagcctccaactcctactcatcattcctcatgtcctccgttcgaaacctccgctacgtcttgcccggcatcacgagacccctcgtgatcgtcgcggccaacgagaccgcccatgtccaaaccaccataatatgcggccgccgccacggcgtgcacgtccgcacgcgcagcggcggccacgactacgagggcatgtcgtacgcctccgtcgataataaacacttcgccgtgctcgacctcggcgagctccgcgccatccacatcgacgcctcgagatccgaggcctgggtcggctccggcgccacgctcggcgagctctactacgccgccgccgccgccaaccaaaccttcggcttccccgccggcaactgccccaccgtcggcgtcggcggccacctcagcggcggcgggttcggcgcgctgtcccgaaagtacggcctctccgccgacaacgtcatcga

SEQ ID NO: 42837 - protein, 203 aa, Panicum virgatum
  misc_feature: Ceres CLONE 2013716
  misc_feature (77)..(203): Pfam Name: FAD_binding_4 Pfam Description: FAD binding domain
  misc_feature: SWISSPROT Homolog: EC 1.21.3.3 Reticuline oxidase
MARTPATILHLLLVALCILSIQTTPSSASSDVHGLLSCLSGGIPSSLIQTPASNSYSSFLMSSVRNLRYVLPGITRPLVIVAANETAHVQTTIICGRRHGVHVRTRSGGHDYEGMSYASVDNKHFAVLDLGELRAIHIDASRSEAWVGSGATLGELYYAAAAANQTFGFPAGNCPTVGVGGHLSGGGFGALSRKYGLSADNVI

SEQ ID NO: 42838 - DNA, 609 bp, Panicum virgatum
  misc_feature: Ceres CLONE 2013726
  misc_feature: Encodes the peptide sequence at SEQ ID NO. 42839
ttctcatcacacgaattagtgttaatcatcgtatctcgatgtaaactaaaaccagccacgttgtgttaaaaaaatgcaattgcacgcacataagtattgcacatcctctaccttatcaaataggtatagatttgccctcaaaaaaaatatttgagtatttaaaatcctttcagagacatatctttcaacaacctgacgggcaatcttccaattacaatgggatctctgtcaaaagtttctagcctctgcatgcaaaataatcaactatcaggcacagttgatgtcctcagcaacctaagccttgcgacactaaatattgcgaacaacaatttcagcggcatgataccacaagaattcagctcaattccaaatttgatagttggaggaaactcatttgtcaatatgcctgcctccccgccaccaaagaatccacgtgatcagccaaaccatcctcaaggacctgttagtgctccaactgcccctgacactcctattgatcaagatgacaagaagctgcaaacaggtcctcttgtagggatagctgttggctccatagctgttgcctcctgcgtacttttcacgttggtattctgcctttacaaggcccag

SEQ ID NO: 42839 - protein, 130 aa, Panicum virgatum
  misc_feature: Ceres CLONE 2013726
  misc_feature: SWISSPROT Homolog: EC 2.7.11.1 Non-specific serine/threonine protein kinase
MGSLSKVSSLCMQNNQLSGTVDVLSNLSLATLNIANNNFSGMIPQEFSSIPNLIVGGNSFVNMPASPPPKNPRDQPNHPQGPVSAPTAPDTPIDQDDKKLQTGPLVGIAVGSIAVASCVLFTLVFCLYKA

SEQ ID NO: 42840 - DNA, 690 bp, Panicum virgatum
  misc_feature: Ceres CLONE 2013732
  misc_feature: Encodes the peptide sequence at SEQ ID NO. 42841
actagctccttcctcacgagctcacccctcctagttaatccagcatgaacagctactattactacaatcggtcccggcagtggaaatggtggtggagggggtggcgcgaacctactacggatggtagacgctatcctgcagttaatatagttatattaactccggccaccttcaattatgcggtggcacatgcgttgggacgccaaccattgtcaaccgcccccccacaggataactctccagactatgtgatctcgatcaaagatatgaaggaatgggaatcgcattgggaccgggctgctccacacaacaagctgttggtgtatgagttctacgacaagaattccacactgtacaaggccatggacatgctgttggataacctcgccaagcagtataaaggccaggcagaattctacaagttagacgtcgacaacttcgagcttttggcgcggatttgcggagtggagggagcgtatccgacgttcgtgctattcaagaactgcaagcaggtgggcaaggtcgtcggcctcaaggaagacgaactcgaggggagcatcaagcaagcgctccaatcgactagtactcaataattttcgtgtgaaggcatatatataatatggtgttcatatatatacgcgtcgggagtgcgaggtacatgttgtacatgctacaaaactatgtagaata

SEQ ID NO: 42841 - protein, 182 aa, Panicum virgatum
  misc_feature: Ceres CLONE 2013732
  misc_feature (69)..(175): Pfam Name: Thioredoxin Pfam Description: Thioredoxin
MNSYYYYNRSRQWKWWWRGWREPTTDGRRYPAVNIVILTPATFNYAVAHALGRQPLSTAPPQDNSPDYVISIKDMKEWESHWDRAAPHNKLLVYEFYDKNSTLYKAMDMLLDNLAKQYKGQAEFYKLDVDNFELLARICGVEGAYPTFVLFKNCKQVGKVVGLKEDELEGSIKQALQSTSTQ

SEQ ID NO: 42842 - DNA, 729 bp, Panicum virgatum
  misc_feature: Ceres CLONE 2013786
  misc_feature: Encodes the peptide sequence at SEQ ID NO. 42843
atccgaatctagggtttttatcctcttctccagccgccgccgctccaccggccgctcctccatcccttctgccaatggcgaccactcacgcgatcagcaagaagcggaagttcgtggcggatggcgtgttcttcgcggagcttaacgagatgctcacccgtgagctcgccgaggacggctactccggcgtcgaggtccgtgtcacccccatgcgcaccgagatcataatccgcgccacccgcacccagaacgttctcggcgagaagggcaggaggatcagggaactgacttctgtggttcagaagcgcttcaacttcccggagggcggcgtcgagctctatgccgagaaggtgaacaaccgcggcctctgcgccattgcccaggctgagtcactccgctacaagctcctcggtggactcgccgtcagaagggcatgctatggcgttctacggtttgtcatggagagtggtgccaaaggctgtgaggttattgttagtgggaagctcagggcccaacgtgctaaatccatgaagttcaaggatggatacatgatctcttctggccatcctgtcaacctatatattgactcagctgtgaggcatgttctcctgagacagggtgtgctgggtatcaaggtaaagattatgctcgactgggatccaaagggcaagcaagggccaaccatgcctttacctgatcttgttacaattcaccccccaaaggaaggag

SEQ ID NO: 42843 - protein, 218 aa, Panicum virgatum
  misc_feature: Ceres CLONE 2013786
  misc_feature (106)..(190): Pfam Name: Ribosomal_S3_C Pfam Description: Ribosomal protein S3, C-terminal domain
  misc_feature (47)..(104): Pfam Name: KH_2 Pfam Description: KH domain
  misc_feature: Functional homolog of the protein sequence given in SEQ ID NO 51097
  misc_feature: Useful for making plants with modulated biomass
  misc_feature: Functional homolog of the protein sequence given in SEQ ID NO 51096
  misc_feature: Useful for making plants with modulated water use efficiency
MATTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHPPKEG

SEQ ID NO: 42844 - DNA, 535 bp, Panicum virgatum
  misc_feature: Ceres CLONE 2013799
  misc_feature: Encodes the peptide sequence at SEQ ID NO. 42845
gctaacgcgtggacacaaacgcgcgcagtgatcgagtactgtcagaacttgggtacctgcagctttaacggtatctatctgcagagagggatcgatcgatcgatcgatcgatcgatcggtacggtacagatcgagaggagaggagataccatacgatcgacggcgacaatggcggaggcggcggacatggagcggatcttcaagcggttcgacaccaacggcgacggcaagatctcgctgtcggagctgacggaggcgctgcggacgctggggtccacctccgccgacgaggtgcagcgcatgatggctgagatcgacaccgacggcgacggctgcatcgacttcaacgagttcatcaccttctgcaacgccaacccggggctcatgaaggacgtcgccaaggtcttctgaattctgatgatgcgtaatcgatccaacacctactaccacaatcaatcaagatggagtatcatcgccgtcgctccatccatctgctggctcgccgatcatatatatatatatatatatatatatc

SEQ ID NO: 42845 - protein, 80 aa, Panicum virgatum
  misc_feature: Ceres CLONE 2013799
  misc_feature (41)..(69): Pfam Name: efhand Pfam Description: EF hand
  misc_feature (6)..(34): Pfam Name: efhand Pfam Description: EF hand
  misc_feature: SWISSPROT Homolog: EC 2.7.11.1 Non-specific serine/threonine protein kinase
MAEAADMERIFKRFDTNGDGKISLSELTEALRTLGSTSADEVQRMMAEIDTDGDGCIDFNEFITFCNANPGLMKDVAKVF

SEQ ID NO: 42846 - DNA, 705 bp, Panicum virgatum
  misc_feature: Ceres CLONE 2013809
  misc_feature: Encodes the peptide sequence at SEQ ID NO. 42847
gcgactcctccaaacccttgcgccggcgcctccacttcgcttcctcaccccatctcctcgcgctcagggtccggcgccgaagggaggcaagatgtacaccgcgaggaagaagatccagaaggagaagggcctcgagccctccgagttcgaggactccgtcgctcaggccttctttgacctggagaatagcaaccaggagctcaagagcgacctcaaggacctctacatcaacaatgctatccagatggacgttgccgggaacaggaaggctgttgtgatccacgtcccataccgcctgcgcaaggccttcaggaagatccacgtcaggcttgtcagggagctggagaagaaattcagtggcaaggatgtagtagttgttgccacaagaaggattgtgaggccgccaaagaagggttcagctgttcagcgccctcgcaccaggactttaactgctgttcatgatggaatcttggaggatgttgtgtacccagccgagatagttgggaagcgagtcagataccgtttggatggtgccaagatcatcaagatcttcttggacccgaaggagaggaacaacactgaatacaagctggagactttcaccgcagtctaccgcaggctttgtgggaaggacgtggtctttgagtcccctgtagctgaaaacgcataaagctgaagtcgtggatatctccattttcatttctt

SEQ ID NO: 42847 - protein, 192 aa, Panicum virgatum
  misc_feature: Ceres CLONE 2013809
  misc_feature (6)..(191): Pfam Name: Ribosomal_S7e Pfam Description: Ribosomal protein S7e
  misc_feature: Functional homolog of the protein sequence given in SEQ ID NO 50192
  misc_feature: Useful for making plants with modulated biomass
MYTARKKIQKEKGLEPSEFEDSVAQAFFDLENSNQELKSDLKDLYINNAIQMDVAGNRKAVVIHVPYRLRKAFRKIHVRLVRELEKKFSGKDVVVVATRRIVRPPKKGSAVQRPRTRTLTAVHDGILEDVVYPAEIVGKRVRYRLDGAKIIKIFLDPKERNNTEYKLETFTAVYRRLCGKDVVFESPVAENA

SEQ ID NO: 42848 - DNA, 619 bp, Panicum virgatum
  misc_feature: Ceres CLONE 2013820
  misc_feature: Encodes the peptide sequence at SEQ ID NO. 42849
gcttgaacagcttttccgcttcctctcggtagtctccggcgccggcgagctccttcaccggcatccctcccccttccttctgcgcgcttcattttcctcgtcgtcgggctccccgcctccgcagccacagaaccgaagcggcgtcgatgggaggcgaggccacgagtgccggcggcgggggtttccgcgcgcggatggagcactacctgtacagtggagagaagaagcacgtcctcgccggcatcgccatcttcgccgccgtcttcggcgtcccgtggtacttcatgacccgaggagcaaagcatgaatctcatcaagattacatggaaagggctaacaaggcgaggtcggagaggctttcttctggacagccatcggcactgaaagaatgaagtagtagtgcctattctggcccctgacgtctagagctcagcatactcttttttgtttgtaatcagaggattttggtctattgtgaaataagcagatatctttcttatctcgctagatgtagaaaattggtgtaatacacaccagaaaatttgtctactggagcctacgtttccgtctgatattctcgagggcatgacccatacagaagtcttgcaatattttctac

SEQ ID NO: 42849 - protein, 81 aa, Panicum virgatum; identical to SEQ ID NO: 13008
  misc_feature: Ceres CLONE 2013820
  misc_feature: Functional homolog of the protein sequence given in SEQ ID NO 50460
  misc_feature: Useful for making plants with modulated biomass

SEQ ID NO: 42850 - DNA, 697 bp, Panicum virgatum
  misc_feature: Ceres CLONE 2013833
  misc_feature: Encodes the peptide sequence at SEQ ID NO. 42851
acccaagaaaccgtccagagcagagcagacacgcccccattgcctcccggcgcagcagttctttacatcaggaaagaagagcaagaagagttcagtaggtcaccatgcgccggtggttttgctgcactcattttgacacaccatatctcgaaaatgagaatggatttacaaaaagtccggacagaacaagtggaaacagtctaacttcgaacagtgatcctgcgaaaccaccttccattgaagtaccggcattgtcgtttgatgaactgaaagaaaagacagatgattttgggtcaaagactttggttggtgaggggtcatatggaagagtatattatgctgttttggaaaatggaaaacatgcagccttgaagaagcttgatgcttcagcagaccctgagcccgacaatgaatttctagcgcaggtctccgttgtttcaagattaaaacatgaaaattttgtggacatgcttggttattgcattgaaggagatcaacgtctgttggcttatgaattcgctacaatgggctccctacatgatattttgcatggaagaaaaggtgtcgcaggtgcgcagcctggtcctgctctcgactggatgcaaagagtcagaattgctgttgatgctgcaaaaggtcttgagtaccttcatgagaaggttcaaccttccatagtccatcgagacatgcgatctag

SEQ ID NO: 42851 - protein, 197 aa, Panicum virgatum
  misc_feature: Ceres CLONE 2013833
  misc_feature (50)..(195): Pfam Name: Pkinase_Tyr Pfam Description: Protein tyrosine kinase
  misc_feature: SWISSPROT Homolog: EC 2.7.11.1 Non-specific serine/threonine protein kinase
MRRWFCCTHFDTPYLENENGFTKSPDRTSGNSLTSNSDPAKPPSIEVPALSFDELKEKTDDFGSKTLVGEGSYGRVYYAVLENGKHAALKKLDASADPEPDNEFLAQVSVVSRLKHENFVDMLGYCIEGDQRLLAYEFATMGSLHDILHGRKGVAGAQPGPALDWMQRVRIAVDAAKGLEYLHEKVQPSIVHRDMRS

SEQ ID NO: 42852 - DNA, 277 bp, Panicum virgatum
  misc_feature: Ceres CLONE 2013834
  misc_feature: Encodes the peptide sequence at SEQ ID NO. 42853
gaactattacagtacgcactccggctgacgcgccccgcactctctcacaaagctcaagcctttcgctcgctcgctcgctcgcggctacatctacaatggcgcgattccaactcgcggccctggccatggccatgctcttcgccgcggcggcagcgcatgccccggcagccaccacgacgccgacacccactgctccaaccgcgtcggcaacacctacaccaaccccttcgcccgcgtctccaaccgcacaggcccccgcggtgcgtaccaccgtgtc

SEQ ID NO: 42853 - protein, 60 aa, Panicum virgatum
  misc_feature: Ceres CLONE 2013834
  misc_feature: Functional homolog of the protein sequence given in SEQ ID NO 50206
  misc_feature: Useful for making plants with altered carbohydrate content
MARFQLAALAMAMLFAAAAAHAPAATTTPTPTAPTASATPTPTPSPASPTAQAPAVRTTV

SEQ ID NO: 42854 - DNA, 556 bp, Panicum virgatum
  misc_feature: Ceres CLONE 2013841
  misc_feature: Encodes the peptide sequence at SEQ ID NO. 42855
caaaaccctagccccgagcagccgcagcgggcagcacttcacgtcccctggctccctctcctcacctggcggcggcgggagcgggaggatggcggcttccaccgggaagaaggggaaagaagtccacccccacgaattcctccagggctactccccccacctcaagcgcttcgggaagatggaactccctgaatgggttgaaattgggaaaaatgggagggtcaaggaacttcctccttatgaccctgactgggactaccccagggctgcctcaattgccaggaaaaactacctcaaggaagggattggtggaggtggaatccagaagaactatgggggcccccagaagaatgggtcccgcccaccacacttctggaagaacagtggtgccatttcacctaacctcctggaacagttgcagaagaagggcatcattgatgttgatccccaaggtgggccgctcatcacctcccaaggaaagcgtgatcttgaccaagtggctggaagaattgctggtgacgcctaaacatctctgttttctggtttgcccgtggtc

SEQ ID NO: 42855 - protein, 145 aa, Panicum virgatum
  misc_feature: Ceres CLONE 2013841
  misc_feature (10)..(145): Pfam Name: Ribosomal_S19e Pfam Description: Ribosomal protein S19e
MAASTGKKGKEVHPHEFLQGYSPHLKRFGKMELPEWVEIGKNGRVKELPPYDPDWDYPRAASIARKNYLKEGIGGGGIQKNYGGPQKNGSRPPHFWKNSGAISPNLLEQLQKKGIIDVDPQGGPLITSQGKRDLDQVAGRIAGDA

SEQ ID NO: 42856 - DNA, 687 bp, Panicum virgatum
  misc_feature: Ceres CLONE 2013845
  misc_feature: Encodes the peptide sequence at SEQ ID NO. 42857
tattaatatctggagatctgcagccaacttcaggaacagtattccgctcccccaaggtccgcatggctgtattcaaccaacatcatgttgatgggcttgatttaacagtgaatccccttctatacatgatgaggtgctatccgggtgtacctgagcagaagttaagggcacatctgggttcctttggtgtttcaggaaatcttgccctccaacctatgtatactttgtcaggtggtcagaagagtagggttgcattcgcgaaaatcaccttcaagaaaccacacattatacttctcgatgagccttctaaccatctggatctggacgcagttgaggcgctcatccaaggtttactggttttccagggtggagtgctaatggtgagtcacgatgagcatctcatcactggaagcgtggacgagctttgggcggtgtcagagggcagggtgaccccattctcgggcacgttcaaggattacaagaagttgctcaagccttagatcagcctggaggaatggaggatgcctcccttccgtgcacaaacgccgaaatctagaagagcgatgcacacaatgtaaagcaggaaacagttttgagtggtgtccagtttttatcctttgtgctgtgaactgaggcgacatgtacctctgccgtaggtgacatgcatcgttatcatcacagattata

SEQ ID NO: 42857 - protein, 165 aa, Panicum virgatum
  misc_feature: Ceres CLONE 2013845
  misc_feature (1)..(147): Pfam Name: ABC_tran Pfam Description: ABC transporter
  misc_feature: SWISSPROT Homolog: EC 3.6.3.41 Heme-transporting ATPase
LISGDLQPTSGTVFRSPKVRMAVFNQHHVDGLDLTVNPLLYMMRCYPGVPEQKLRAHLGSFGVSGNLALQPMYTLSGGQKSRVAFAKITFKKPHIILLDEPSNHLDLDAVEALIQGLLVFQGGVLMVSHDEHLITGSVDELWAVSEGRVTPFSGTFKDYKKLLKP

SEQ ID NO: 42858 - DNA, 693 bp, Panicum virgatum
  misc_feature: Ceres CLONE 2013847
  misc_feature: Encodes the peptide sequence at SEQ ID NO. 42859
ctctccaactccaaggccgccagtccgccgcagctcacggcctcacgcagctgtgtggacgcgaccccaaattcgaaattggccaacgtctcgtcgcctccgctcctcatttcaaaccaaatcccaatctcagctgccgcccccctccaccaccgccgtctccgatccgccatcgcctccgcccaacccagacgcgggagttctcctccgcctccgttgcacttgcgatgctgttggacggcgtcgacgacgagctcggcggcggcagcgccgctccctcacccgcgcggttcgagctccaggaggaccccgccttctggaaggagaacaacgtgcaggttgtgatccgtatccggcctctcagcggcagcgagatatcgctgcaggggcagaagaggtgcgtccggcaggacagtagccagagtcttacgtggactggtcatcctgagtctcggttcacttttgatctcgttgcggacgagcatgtcacgcaggagaatatgttcaaggttgctggagtgcccatggtggagaactgcatagctggctacaacagctgcatgtttgcttacgggcagactggcagtggaaaaacgcatacaatgcttggtgatatagaaaatgggacacggaggaacagtgcgaattgtggtatgacgcctcgagtgtttgagcatctatttgctagaatcc

SEQ ID NO: 42859 - protein, 155 aa, Panicum virgatum
  misc_feature: Ceres CLONE 2013847
  misc_feature (41)..(155): Pfam Name: Kinesin Pfam Description: Kinesin motor domain
MLLDGVDDELGGGSAAPSPARFELQEDPAFWKENNVQVVIRIRPLSGSEISLQGQKRCVRQDSSQSLTWTGHPESRFTFDLVADEHVTQENMFKVAGVPMVENCIAGYNSCMFAYGQTGSGKTHTMLGDIENGTRRNSANCGMTPRVFEHLFARI

SEQ ID NO: 42860 - DNA, 641 bp, Panicum virgatum
  misc_feature: Ceres CLONE 2013855
  misc_feature: Encodes the peptide sequence at SEQ ID NO. 42861
gttcccaaaggagagagagaagcacgcgcagcatcggttccttgccgctgccgcggccgctgccgctgccgctgccgctgcacagtccatagcagagcccccacccgcgcaaaagcagagcaaccactttcccctcccgccccccatctccgtcctcctccatggcgagatcgacgcgcggcgcgctcctcctcctcctcgcgctcctggcgctgttggcggcggcccgcgcgggcgacgtgccggcggcgctgggctgggagctcggggtggtgggcgccgcggaggacgaggagttcggcttccccgccggcggcgactccgtggcgcgccgggtgctgcagggcgggcccgggtacatcagctacggcgcgctgcggagggacaacgtgccgtgctccgtgcggggggcctcctactacaactgccgccccggcgcgcaggccaacccctactcgcgcggctgctccgccatcgcccgctgccgcggctgatccgcccgcccgcttcagcgcaggcggccggcgactgccgggaggacgaggaggaggttcaattcatcccgttagtccctcgccgttcagaaaaaacaaaagagagagaagaactgttcatctgccctttttaatcaattattgttg

SEQ ID NO: 42861 - protein, 110 aa, Panicum virgatum
  misc_feature: Ceres CLONE 2013855
  misc_feature (44)..(110): Pfam Name: RALF Pfam Description: Rapid ALkalinization Factor (RALF)
MARSTRGALLLLLALLALLAAARAGDVPAALGWELGVVGAAEDEEFGFPAGGDSVARRVLQGGPGYISYGALRRDNVPCSVRGASYYNCRPGAQANPYSRGCSAIARCRG

SEQ ID NO: 42862 - DNA, 459 bp, Panicum virgatum
  misc_feature: Ceres CLONE 2013865-R
  misc_feature: Encodes the peptide sequence at SEQ ID NO. 42863
tgataattctccacaggcctttgggttccagttagataatggcatacctatagagagctggtttgatgatcccaatgatacagaactgctgaaattactcccattcctagaaagtttggttggtgttgaagatgtccggccttatatagcaaggaagttcaaccttcgggagaaggtagccactgcagcttctctcacaatggacatgcagatgtgatgcatccagtgctgtcaaggattatttctgcggcatcaaggaggcagtggtgataaatgtagaaaacgacctgatatggtgattctgtagaatgtagtagcatatcaggttcccctcatgttgcaatgttgtatgttctggcatccaccttgtacaatttgctgcagtttggcagttgtaaactgtacttgctaggaataaaccatcttcaaatgtgaaggtcttgttgcaaattgtgtcgc

SEQ ID NO: 42863 - protein, 71 aa, Panicum virgatum
  misc_feature: Ceres CLONE 2013865-R
  misc_feature: SWISSPROT Homolog: EC 3.1.3.16 Phosphoprotein phosphatase
DNSPQAFGFQLDNGIPIESWFDDPNDTELLKLLPFLESLVGVEDVRPYIARKFNLREKVATAASLTMDMQM

SEQ ID NO: 42864 - DNA, 1394 bp, Panicum virgatum
  misc_feature: Ceres CLONE 2013865
attcctccccctcccccgcaaaacccccgcgtcggccatatctctctccggaggcgaataggcgacggctagggtttcgttccccggggacgcgccgccccctcgagcccccgcgccaccggatcccggcgaccgcgctccgccctcagcctcccgccgtcccgctccggtcgccgccgcccgacccggctgctcctccacgttgcctgccgctccgcgtcggcgccggttggttagggtttgggtttccagtggccgaagctgaaccccccccccccccccctacgcaggggctcgcgccggagggcccgagctcgcggagctctcctcatcctcctccgctcctgttggaagttgtcaaggaagcttttctacagtgtcttttctgttgcatgagtcagttatagtgctcgtagttaacaatgcataccaggaaaaagggtgctgtaagatcttcagctggggatcatgccagtcctaaaacaagcaggccatccagaagaacagctcagcctccagttgctcaaaagaaagtaactgatctcattacgtcgtcttccaagaagcaaaaacctgttggagccacttccaaaaagcattctaaaggaggaaggaagctgttagctgcatgtgatacaactgataatgaaaatgaggtgccgcaagtggcccctagtgttccccatgatctgcagcactctgatgacggtgcagatgatcgcccaaacaattccatattctcccctacataccatcatcacaaggatggcggtatgaataacctctcaaaagctggctcattagaagaacagatggcacctgttcatggtagcaaggaagctaccctaaaatccgggccaaaccttgcatgcaacacttgtgatggggcaagtgaccactcttgcacactcaatttgcaatcttctgggcagagcacattgcttgaagtggatgagtacagtgaattgggaaacctttcttcagaagtgtcagcaatatatcttgctatgcagcaatctaagttggagtgcattgatgaacagagtcaagattctacctcaacggaaggttatggtgatgctgaggatactgaggagtatgatgagtttgatccatattcttttatcaaagatttacctgatttatctatggtggtccccaaatttcgccctgtccttcttccaaagcagacccggagttgcccaacaactacactagtacttgatctagatgaaacacttgtccattcaactcttgaacactgtgcggatgagttcacatttccagttcattttaactttagagagcacacaatatatgttcgatgccgcccctatctcaaagaatttttggatagggttgccagcatgtttgagacgattattttcactgct

SEQ ID NO: 42865 - DNA, 1056 bp, Panicum virgatum
  misc_feature: Ceres CLONE 2013870
  misc_feature: Encodes the peptide sequence at SEQ ID NO. 42866
ctttttttctttcttcgctccacacgctttcaccctctctctcgctctcggcctcacttccgtggcggcgacggcggggcgagcgacgccgccctcgtccaggttctcgtcgggcgcctcgccggggacgagcatccgacagggatggccgaaaaaggaagctatgttcctccgcagtatattcctttatatggcctagacactgaagaggatcgtgttcctgctgtggaagagaaccaagctgcacgccataataagctaaaccgagatctaacacagtggtcttctggcatttgtgcttgttttgatgatccacagagctgttgtattggtgcaacttgcccctgtttcctttttggaaagaatgcacaattcttgggatctggaattcttgctggatcatgcactatgcattgcatgctttggggccttcttacaagtctctgctgtgtatttactggaggccttgtattagcagttcccggttctgctgttgcttgctatgcttgtggatatcgcagtgcactaagaacaaagtacaatcttccggaagcaccctgtggtgatttgacgacacatttgttctgccacctgtgcgccatatgccaggagtacagggagatccgggagagaacaggcagtagctcctcttcagctcctaacgtaactccacctccagttcagacaatggacgaccaattttgatatgattgattgtatgaatgtatcctctcaatctgacaaatcattggtgagtggatgtgacctgtgctgactttgcctgccagcgtgacacatttttgctcttgtgctcccaaagggtttccatgaggtttggtttcaaagttgttgtaaaggtaactgtttaagtagtgaaccgctgacagttcccaaaagttgtaaacgaagctgtatcacgggactgtagcagaagagttaagtgtaacattttttccatatgtattggcgggaggttgagaagggaatatatggttgtcttgtagaatgttcttttgtatttgccgtttgcaagtgtattattgttatcaaacgggc

SEQ ID NO: 42866 - protein, 186 aa, Panicum virgatum
  misc_feature: Ceres CLONE 2013870
  misc_feature (46)..(160): Pfam Name: PLAC8 Pfam Description: PLAC8 family
MAEKGSYVPPQYIPLYGLDTEEDRVPAVEENQAARHNKLNRDLTQWSSGICACFDDPQSCCIGATCPCFLFGKNAQFLGSGILAGSCTMHCMLWGLLTSLCCVFTGGLVLAVPGSAVACYACGYRSALRTKYNLPEAPCGDLTTHLFCHLCAICQEYREIRERTGSSSSSAPNVTPPPVQTMDDQF

SEQ ID NO: 42867 - DNA, 676 bp, Panicum virgatum
  misc_feature: Ceres CLONE 2013871
  misc_feature: Encodes the peptide sequence at SEQ ID NO. 42868
acgaccagaccaccggatccttgcccttgcgattgcagcagatcggactcggagctccaagcctcgaagaagaatcatcctccatccatggcggacgtgcatgaaccattggtgcgccgcaagaggaagacagttttggtggactacttggtgcagttccgatggatcctcgttatctttgtggtccttcccgtttcagctctcatctacttcaatatctatctgggcgacatgtggtccgccatgaagtcagagaagaagcgccagaagcaacatgacgacaatgtgcaaaaggggctcaaccttagcaaccatcctctccttgtcaacatggctcagattaccagagctacttgccctatgaaccttgcccttgcagtcgtcgcggagctcgacgacctcactgttggtgggctcatcaatggttatggtattgaggggagctctcacctctatggccttttctctgacacgggtgttgcaatggaagttgtccttgcagatggcagggttgttagagccaccaaggacaacgagtactctgaccttttctatggcattccctggtcccagggaacacttgggttccttgtgtctgctgagatcaagctcattcccatcaaggaatacatgaagctcacctacactccggtcaatgggactctcaaggaaattg

SEQ ID NO: 42868 - protein, 196 aa, Panicum virgatum
  misc_feature: Ceres CLONE 2013871
  misc_feature: SWISSPROT Homolog: EC 1.5.99.12 Cytokinin dehydrogenase
MADVHEPLVRRKRKTVLVDYLVQFRWILVIFVVLPVSALIYFNIYLGDMWSAMKSEKKRQKQHDDNVQKGLNLSNHPLLVNMAQITRATCPMNLALAVVAELDDLTVGGLINGYGIEGSSHLYGLFSDTGVAMEVVLADGRVVRATKDNEYSDLFYGIPWSQGTLGFLVSAEIKLIPIKEYMKLTYTPVNGTLKEI

SEQ ID NO: 42869 - DNA, 631 bp, Panicum virgatum
  misc_feature: Ceres CLONE 2013885
  misc_feature: Encodes the peptide sequence at SEQ ID NO. 42870
atttcgaccaaatctcgcggcgactgcaactcggagccccggcggaagaccacgccctcgcttctgaaggtctgatctccggccggtgcgaccacaggcgaatcgaagatgcagcagggggacggcacggaggcgcaggtgacgtgggaggaccaacagaatatcaaccgcttcggccgcctcaacaaccgcctccacgagctccaggacgagatcaagctcgccaaggaagcaaatgaaaacctagacgatgctgggaacgagctcatcttgtcagatgaagatgtggtacggttccagattggggaagtgtttgcccacatgccatgggatctcttgaagcgatgacaaaggggagtgatgcaaggtaccttggtgatacactgaagctcaaagttgcgcagggagttgttggagcagtagctgacaaaggttccgttctgaggttcattccttacacaatgcaagcagttaagcaaggattccaagatcttggtgcatcctcactgcagtcagctcatgatcttttgcgatcggagactcttagattagaggtgaggaccggcgcagcccaggttgaaggaggaatccatgggctggtctcatatgagaagaaggcattctagttcca

SEQ ID NO: 42870 - protein, 99 aa, Panicum virgatum
  misc_feature: Ceres CLONE 2013885
  misc_feature: SWISSPROT Homolog: EC 1.1.1.205 IMP dehydrogenase
MGSLEAMTKGSDARYLGDTLKLKVAQGVVGAVADKGSVLRFIPYTMQAVKQGFQDLGASSLQSAHDLLRSETLRLEVRTGAAQVEGGIHGLVSYEKKAF

SEQ ID NO: 42871 - DNA, 643 bp, Panicum virgatum
  misc_feature: Ceres CLONE 2013890
  misc_feature: Encodes the peptide sequence at SEQ ID NO. 42872
tacttaatgtcgctgagtgctgccttaatatggggaatgaatgaaggagctgtatacttgtggactttgccaatgttccactgtaatggctggtgctatacatgggcgcttgctgttctttgtggaacaagtatatgtcttcgtcaggtttcagcaaaggccatcttctcggctatagccaaccagggtgtgactcacttctgtggggcaccagtcgtgctgaacaccatcgtcaacgcccctccggtagacaccattctccctctgcctcgtgtcgtcaacgtcatgactgctggcgctgctccgccaccctccgtcctggcggcaatgtcgaagctcggcttccgcatcacccacacctacggcctgtcggagacgtatggaccatccaccgtgtgcgcctggaagccggagtgggacagcctgccagccgacgagcgcgcccgcctccatgcgcgacagggcatccagtacgtcggcctggagggcctcgacgtcatggacccgaatacgatggcgccggtcccggcggacggcaccacaatgggcgaaatcgtcatgcgcgggaacgccgtcatgaaggggtacctgaagaacccgaaagcgaacgccgaggcgtttcaaaacgggtggttccactccg

SEQ ID NO: 42872 - protein, 214 aa, Panicum virgatum
  misc_feature: Ceres CLONE 2013890
  misc_feature: SWISSPROT Homolog: EC 6.2.1.12 4-coumarate--CoA ligase
YLMSLSAALIWGMNEGAVYLWTLPMFHCNGWCYTWALAVLCGTSICLRQVSAKAIFSAIANQGVTHFCGAPVVLNTIVNAPPVDTILPLPRVVNVMTAGAAPPPSVLAAMSKLGFRITHTYGLSETYGPSTVCAWKPEWDSLPADERARLHARQGIQYVGLEGLDVMDPNTMAPVPADGTTMGEIVMRGNAVMKGYLKNPKANAEAFQNGWFHS

SEQ ID NO: 42873 - DNA, 661 bp, Panicum virgatum
  misc_feature: Ceres CLONE 2013893
  misc_feature: Encodes the peptide sequence at SEQ ID NO. 42874
atgatcctaccatctcaactatcagttaatagtcgaaaaggaatcgactcttgccaggtccatgatctcatgcgtgagattagcatatcaaagtcaattgaagaaaatcttgtttttagaatggaggaaggttgcagctcaaacacccaaggcatagttcgccaccttgtcataagcaccaactgggagggagataagagtgagtttgagagctcagttgatctttcccgcatacgctcgttaacggtgtttgggaaatggaggccatttttcatttctgagaagatgaggttcttgcgggtgctggacttggaaggcacgtcaagtctatttgatcatcaccttgagaatatagggaggctccgtcaccttagatacctttctctaagaggatgtcaacgtatttttcacttgccagattcgataggtaatcttactcaactgcagacattagatcttgcatttacacggatatggaaacttccaaagaccatcaccaaacttaggaagctacagtatcttcgtgttgcgggcattggacaacatgagatggacctactcgaagatttgagtgaagatctaccaaaagtattcaagaacaagtcatgcattcttactgtatctttgctggtatgttgtgtggcttgttgtggacctcaaa

SEQ ID NO: 42874 - protein, 197 aa, Panicum virgatum
  misc_feature: Ceres CLONE 2013893
  misc_feature: SWISSPROT Homolog: EC 2.7.11.1 Non-specific serine/threonine protein kinase
MREISISKSIEENLVFRMEEGCSSNTQGIVRHLVISTNWEGDKSEFESSVDLSRIRSLTVFGKWRPFFISEKMRFLRVLDLEGTSSLFDHHLENIGRLRHLRYLSLRGCQRIFHLPDSIGNLTQLQTLDLAFTRIWKLPKTITKLRKLQYLRVAGIGQHEMDLLEDLSEDLPKVFKNKSCILTVSLLVCCVACCGPQ

SEQ ID NO: 42875 - DNA, 562 bp, Panicum virgatum
  misc_feature: Ceres CLONE 2013896
  misc_feature: Encodes the peptide sequence at SEQ ID NO. 42876
attccccccctggcaccgaagcgggcgcggccgttggaactcatttccctcctcgtcgtcttcctcttcctcagaacggagcgaagcctggagggaagcgcgcggatgaggatccgctgctagagcgagaggagcaagtgtcctgcgccagcgtcggccgcggcggcggaggagggggaggaggaggaggccatggatgctagcgtcgggctggtggcccgttcccacaaccgcgacgagatcgtacagagtcccgccgccactgccatctccggccgaatgccgctgcgtgagcggaaaagggaagtgtgcctgatttgcggcaacaacggcggagtcggtggcggctgggagcccttcgaggcctgcaactaccgccccctccccgcccgcccggactgctaccatcactaccgcccggaggggacgcacaagtgctcccagtgcaagactcactacgagggcctcttggggtgcccgagcgtgcgctgtgatgaggaacaagaccgcatcgactacctggagagcgagttcacgtgggacggcactgactcgcaatatg

SEQ ID NO: 42876 - protein, 123 aa, Panicum virgatum
  misc_feature: Ceres CLONE 2013896
  misc_feature: SWISSPROT Homolog: EC 2.4.1.12 Cellulose synthase (UDP-forming)
MDASVGLVARSHNRDEIVQSPAATAISGRMPLRERKREVCLICGNNGGVGGGWEPFEACNYRPLPARPDCYHHYRPEGTHKCSQCKTHYEGLLGCPSVRCDEEQDRIDYLESEFTWDGTDSQY

SEQ ID NO: 42877 - DNA, 1829 bp, Panicum virgatum
  misc_feature: Ceres CLONE 2013932
  misc_feature: Encodes the peptide sequence at SEQ ID NO. 42878
gggatcccgtccgcgtccatccacaccgcccgtgggaagggaagggaagggaagagcagcgagcgacgcaggcaggcatcggctccggctccggctccgcccgccgccgcaccggcccccctcctcccccgatccgatcgccgatcaccgaccctcgcttcgcctcgccgcgcggcaatatttggaaccctcgtcaccgatcgcctcatgccgtaccactgaccgatccccacaccccccaactccgccctccacctccgccgccgccggtcgcgccgtcgcctccaccccatcgaactcgctatctcccgtgggctttcggtgcggacgatggctaccagcgccgacccgcatgctgccgttgctggggccgggacgccgcccccgtccgatagcccgtttggggcgaagatggctggggcggccgcggccgcctggaagcgccccgggggcgcgactgtgccagccgcggtggcggttgaaagccccgtcatggacacggactcgtggccggcgctgcccgggctggcgtctcccccgccgccggctgccaaggcgtcacctaaggccgcttctcccgcttccacaggggcggtgatctcgccagtctctttgggcatttccagcgctcgggatgctaaccctggcaatgagactcctgtgcgcaatcctgtggcccggcgtgccctggtgatgcctgtggcggatgggctggagaagagtgtacctgccacagaaccgtcccctgtctttgcgcctaatgcccggagcaacggtggagattttcatcatcagaatggacgttttggttcccatacccatggccgaggtggctatggtggcggaaacaggaggggtaatggtggaggtgggggacgacgtgggaacgagcaccatgggggttttgatggtccacggcgaggaggtggccgcagagatggccatggaccagctcaccagcagcgtgaccaccagccagcatacattagggctcctcctgctctggctgttgtaacaggagcacctccgccgccaccgccattccttagccctactactcctcagacaccaccttatggggtacctatgggcttccctgacatagcgccgcatgtttactattttgcggcagcagcccccacggaaggcattcaaggcatgccttttgtgcctcatccagcaagcccccaagctattttagttgaccctcttcgacaggagcttctggagcaaattaattactatttcagtgatgacaatctgtgcaaggacccattcttgcggcaacacatggatgaccaaggttgggtcccattatccctgattgctggcttccgcaaagtccagaagctgactgataatattcagtttatcttggagacagtcatgatgtctactgttgtggaagttcagggtgataaactacgaaggcgtggaacatgggagaattggctgcttccaaaaccaaattattctgctggaagttctggtccgttgacccctgtgacatctaacactgatttgctggcatctcagtttcattctgttggacttgagggggcaacttaccatgctaacatgcaaggaatgcctggtgaagctcttctgactagatcagtgacttcagttagtctaggctatcatgcaccaaccttgggtgggctacacaaccatgggagtggaccactttttggaccaaaggcagcaagaaatttactcaggagcgataccttttgaggctatatattcaaggaatatgacaatggcaggccgagttttcacagtgacggcatgcacaccttgtatgaggtgtaaagatcagttggttc

SEQ ID NO: 42878 - protein, 468 aa, Panicum virgatum
  misc_feature: Ceres CLONE 2013932
  misc_feature (298)..(355): Pfam Name: La Pfam Description: La domain
MATSADPHAAVAGAGTPPPSDSPFGAKMAGAAAAAWKRPGGATVPAAVAVESPVMDTDSWPALPGLASPPPPAAKASPKAASPASTGAVISPVSLGISSARDANPGNETPVRNPVARRALVMPVADGLEKSVPATEPSPVFAPNARSNGGDFHHQNGRFGSHTHGRGGYGGGNRRGNGGGGGRRGNEHHGGFDGPRRGGGRRDGHGPAHQQRDHQPAYIRAPPALAVVTGAPPPPPPFLSPTTPQTPPYGVPMGFPDIAPHVYYFAAAAPTEGIQGMPFVPHPASPQAILVDPLRQELLEQINYYFSDDNLCKDPFLRQHMDDQGWVPLSLIAGFRKVQKLTDNIQFILETVMMSTVVEVQGDKLRRRGTWENWLLPKPNYSAGSSGPLTPVTSNTDLLASQFHSVGLEGATYHANMQGMPGEALLTRSVTSVSLGYHAPTLGGLHNHGSGPLFGPKAARNLLRSDTF

SEQ ID NO: 42879 - DNA, 1721 bp, Panicum virgatum
  misc_feature: Ceres CLONE 2013939
  misc_feature: Encodes the peptide sequence at SEQ ID NO. 42880
ggcttcggctcctacctcgcgccttcctcgcgcggcgcgcctctcgccccctcgtcccctctcgcctctacgcacgtccctccctcgaccccgcgcaccgcggccgatcgagaccggcggcggagagaccctgcccggcgagcgccggcgccgcgggagctgtttggccccgggtgggggcggcgcgatgcccgcgtggtggcccggcaagtcgaggtccaagtcgaaggcgaagccccccgggtcgggggccgtctccgcggcctcctccccgcgcaagtcggcggacctcgagtccccctccccgtccccgacgccgcgggcccgggagaaggcgcggagcctcgacacgcccggcgcggcggcgcgcgcccggtgccccgcggggcacgggctggtggggtacaagctcccggtgcccgcgccggacccggagcccgtcggggctctcttcgaggaggaggtggcctcctccgcgggggagtccagcgcgtgctccgtcgggtcgttggacgaggcgcacgaccagcatgggttcaggtcaatggatcctgttgcttttgtaaggggaagaaatatgccatctgattcagatagaatcttaaatgaagacaagcatgtcatgtcttgcagcatgcctcgggagcatcagaagttctttgatgttcctgtgtctattgtcagagaacatcatttgcacaacgaagaaccttcaacaagtgaaaccagttgttcacgtggaagaacggtatctgaagatctttttgctcaaagaacgagaagcctctcccctgtcccgaaaggccatacattcgccatgagcaatggaaattctagagaatttgggtttagcccgaggtcaccagtgagaatgatggatggtttgaggagcccacctcatcccttgcctcttcctccaggttctgctgcttgctcgccacttcctccagcttttactggttgttcacctctccatccagcttctgccgcttgctcacctcttcacccagctgctgcttctgcttgctcacctcttcctccaacccacagttcgtgctcgcctcttccttcatctcccagttcctgcccgcctcttccttcatctcccactactttggcacagtcccaatcacaatggaaaaaagggaaattgctagggagtggtacatttggccaggtttaccttggatttaacagcgaaaatggtcagttttgtgcaattaaggaggttcaagttagtatggatgatccacattcaaaggaacggctcaaacaattaaatcaggaaatagatatgcttaggcaactctcgcacccgaatattgtgcagtatcatggaagtgatctgactgatgacgcactttccatttatcttgagtatgtttccgggggttcaatccacaaattactaagagagtatggcccttttaaggaacctgtgattcgtaattacactggtcaaattctttctggtcttgcctacttacatgggaggaacactgtccacagagatatcaaaggagcaaacatacttgtgggccctaatggtgaagtcaaacttgctgactttggcatggctaagcatgtatgcagtgtttactttctgactatccctctccgtcccatgtatttacactcaattaccataagatttagtcttctctggacttataaagtcactattgattttgtctctgaatgatgtaaattttatactaccc

SEQ ID NO: 42880 - protein, 504 aa, Panicum virgatum
  misc_feature: Ceres CLONE 2013939
  misc_feature (317)..(504): Pfam Name: Pkinase Pfam Description: Protein kinase domain
  misc_feature: SWISSPROT Homolog: EC 2.7.11.25 Mitogen-activated protein kinase kinase kinase
MPAWWPGKSRSKSKAKPPGSGAVSAASSPRKSADLESPSPSPTPRAREKARSLDTPGAAARARCPAGHGLVGYKLPVPAPDPEPVGALFEEEVASSAGESSACSVGSLDEAHDQHGFRSMDPVAFVRGRNMPSDSDRILNEDKHVMSCSMPREHQKFFDVPVSIVREHHLHNEEPSTSETSCSRGRTVSEDLFAQRTRSLSPVPKGHTFAMSNGNSREFGFSPRSPVRMMDGLRSPPHPLPLPPGSAACSPLPPAFTGCSPLHPASAACSPLHPAAASACSPLPPTHSSCSPLPSSPSSCPPLPSSPTTLAQSQSQWKKGKLLGSGTFGQVYLGFNSENGQFCAIKEVQVSMDDPHSKERLKQLNQEIDMLRQLSHPNIVQYHGSDLTDDALSIYLEYVSGGSIHKLLREYGPFKEPVIRNYTGQILSGLAYLHGRNTVHRDIKGANILVGPNGEVKLADFGMAKHVCSVYFLTIPLRPMYLHSITIRFSLLWTYKVTIDFVSE

SEQ ID NO: 42881 - DNA, 1639 bp, Panicum virgatum
  misc_feature: Ceres CLONE 2013946
  misc_feature: Encodes the peptide sequence at SEQ ID NO. 42882
gtcaccccctccccggccttccctctctgcctcgagcctcccacccatctttagccgcaggagcaactcgatccaccggcgccccgtaacgaaccaaacaggaggcccctcgaccttctcgctcccctccggccgctggcgaagctgccaggcgaagcgaagggctagctgccaagacggcacctctccggcttcaagcgcctccggctctcccccgttcactctggccttccccgcgccaccgccgcctcgcagcttgagcgaggagcatgcgagtttgccctcttccatcttccccgtcggcgtgctctccgggtcgccacggaggatacacctcggacacgctcgaggagggcccggccgcagaccgcaagaagaagaaggtcatggttgacgactcgccgtcgccgccgccgttcgcctcgaaccagtgggtcgccttctgcgccgagaactccctccacgaccgcgtcagcgcctgggtgtgcagcatcgagaacgagcctccgttccacatcgccgaggaggacgaaaactacgacggagaggacaacacggatgacgacggcgatgagcacggcgagtgcgcggcgcgcccgcgccccgtcgagctcggggagtcatcttcggggaagaaccacggcaagtccaagcgctgcgcggcggccgacgaggtcgtccaggccaacaccatcgtacagtccctgaacgccttctcgtcggtggcgcacatatctgggatggggctcaaggtcatgccaatgatcgcgccgttctcgagcctccgagccgtcaacctctccagcaacttcatcgttcatatctccccaggatcgctgccgaagggcctgcactcgctcgatctatcgaggaataagattgcaaacatcgaggggctccgggagctgacgaagctgcgcgtgctgaatctcagctacaaccggatttcgcgcatcgggcacgggctgtcgaactgcacggcgatccgggagctgtacctggcgggtaacaagatcagcgacgtggagggcctccaccggctgctgaagctggcggtgctggacctgagcttcaacaagatcacgacggccaaggcgctgggccagctggtggccaactaccactccctcctggcgctcaacctggtgggcaacccggtgcaggccaacgtcggcgacgacgcgctgcgccgggccgtgacgggcctcctcccgagcctggcctacctgaacaagcagcccgtgaagccgcagcgcagcgcgcgggaggcggccacggacagcgtcgcgcgcgccgcgctcggcgggtcgggctccggcaaccggagcctgcggaagaggccgtcgcggcggctcacccagagcccccggtcgtcgtcgctgacgaggggccgcagcggcggcggggacggcagcgtgaggagcaggtccaagggaaggcaccacggctgaggcaggacgaggatcggaggagctgatgaaacgaaaatgaattgctgcgtgtgacgttttgtgcatgcctgcctgcccggatttcgcagagctgcgatgggactattgatgtgaattactacgggcttgatgatggattgtttgtagatgcaaaagtgcgatttaagatgatgatgccagcgttgcgc

SEQ ID NO: 42882 - protein, 393 aa, Panicum virgatum
  misc_feature: Ceres CLONE 2013946
  misc_feature: SWISSPROT Homolog: EC 4.6.1.1 Adenylate cyclase
  misc_feature: Functional homolog of the protein sequence given in SEQ ID NO 51147
  misc_feature: Useful for making plants with altered protein content
MRVCPLPSSPSACSPGRHGGYTSDTLEEGPAADRKKKKVMVDDSPSPPPFASNQWVAFCAENSLHDRVSAWVCSIENEPPFHIAEEDENYDGEDNTDDDGDEHGECAARPRPVELGESSSGKNHGKSKRCAAADEVVQANTIVQSLNAFSSVAHISGMGLKVMPMIAPFSSLRAVNLSSNFIVHISPGSLPKGLHSLDLSRNKIANIEGLRELTKLRVLNLSYNRISRIGHGLSNCTAIRELYLAGNKISDVEGLHRLLKLAVLDLSFNKITTAKALGQLVANYHSLLALNLVGNPVQANVGDDALRRAVTGLLPSLAYLNKQPVKPQRSAREAATDSVARAALGGSGSGNRSLRKRPSRRLTQSPRSSSLTRGRSGGGDGSVRSRSKGRHHG

SEQ ID NO: 42883 - DNA, 867 bp, Panicum virgatum
  misc_feature: Ceres CLONE 2013975
  misc_feature: Encodes the peptide sequence at SEQ ID NO. 42884
atccaaaatcttcatctgtaagaaaaaccagttcagaagaggagtcgcgtcgttttcctgccatctccttccgctctccgctctccgcccgccccgcactaccctcgccgccgccgcatcagccgccgcgatgcacaagacggcgcaggcctggtttaccggcggcaccgccgcctcttccgcggccgccgtccgctccgccaacgacactgtctccggaacctttagctcggtgaccaagggcgtgcgggagctaccggggagcttccagagcgcgaccagcagcttcccctcggggagggcgctcatgtacttcggcctcttcctcgccaccggcatcttcttcgtcttcatcgccttcgcgctcttcctccccgtcatggtgctcatgccgcagaagttcgccctcagcttcacgctcggatgcgcgctcatcatcgcctcgctcttcgcgctcaaggggccagccaaccagctcgcccacatgacctccaaggagaggctaccattctcagtgggttttattggatgcatggttggtacgatttatgtttcaatgatgcttcacagctatttcctctctgtgatcttctcagtccttcaggttctagcccttgcgtattataccatatcctacttccccggaggatctagtggattgaaatttatctcgtccagtcttttgtcttcggtgacaagttgctttggtcgataatggtagcctgtcgtacatttacttgtttttgtatgtagttgctgatcatctccccgatatgaccccaaaaaaccctctccagtcatcacgttgtttacattagacttggatgggtgttggatatagattatagagtgaaaagggtctgtggt

SEQ ID NO: 42884 - protein, 194 aa, Panicum virgatum
  misc_feature: Ceres CLONE 2013975
  misc_feature (53)..(177): Pfam Name: SFT2 Pfam Description: SFT2-like protein
MHKTAQAWFTGGTAASSAAAVRSANDTVSGTFSSVTKGVRELPGSFQSATSSFPSGRALMYFGLFLATGIFFVFIAFALFLPVMVLMPQKFALSFTLGCALIIASLFALKGPANQLAHMTSKERLPFSVGFIGCMVGTIYVSMMLHSYFLSVIFSVLQVLALAYYTISYFPGGSSGLKFISSSLLSSVTSCFGR

SEQ ID NO: 42885 - DNA, 682 bp, Panicum virgatum
  misc_feature: Ceres CLONE 2013981
  misc_feature: Encodes the peptide sequence at SEQ ID NO. 42886
ctcccccacgctgaagacgacgccatccctcgccagctcgcctcctccactcctcccaaacccctcgccgactcagattccgctgccccgcgccgccgccgccgccatgccgttcaccccgggcccctactccggcgtcagcaccctcgctctcgtggcgagggcgtcggccttcggcgtcggcgtcgtctacgggagcatcaagctctccatcctcaaggtaaactctcggctgtggattcgcgcaatctggtagcggcggggcagatggtttgattacccgcaacgttctagcattagggtttgtggaaaaacttggggttctaggacgcgaggattagatgtgttgttgcgatggtaccttttgattgaatggcttagttccttctgcccagtctgaggccgttgtatgttgatttgtggcttaagactgaaattatttagcccttgtttgtttacctcttcatgtttgtgatatataggttaatcttcttccctgaagatgaagtgtgtttgcgtattaggtcgttagtagtcatgttctggccagtaccctgcagtgttgccagttgctcatttggctttcattatgttgaattcccaaacttatgaaattattcctcttttttggtgttgcttcaagatgattatatcacccttgatccaacttgaggtttgtaac

SEQ ID NO: 42886 - protein, 49 aa, Panicum virgatum
  misc_feature: Ceres CLONE 2013981
  misc_feature: Functional homolog of the protein sequence given in SEQ ID NO 51660
  misc_feature: Useful for making plants with altered carbohydrate content
  misc_feature: Functional homolog of the protein sequence given in SEQ ID NO 51509
  misc_feature: Useful for making plants with altered cell wall content and/or composition
MPFTPGPYSGVSTLALVARASAFGVGVVYGSIKLSILKVNSRLWIRAIW

SEQ ID NO: 42887 - DNA, 700 bp, Panicum virgatum
  misc_feature: Ceres CLONE 2013982
  misc_feature: Encodes the peptide sequence at SEQ ID NO. 42888
gcaacctccttccgagtctcagctccgcaccccaccttgcgcgccgccgccgccgctcgacgcccgccgcgcagccatggcggaacagactgagaaggctttcctcaagcagcctaaggtattccttagcacaaagaaatctgccaaggataagaagccaggcaagggaggcagccgcttctggaagagcattggcctgggcttcaagacccccagggaagcaattgaagggacctacattgacaagaagtgcccattcactggaactgtttccatcagaggcaggattattgctggaacatgccatagtgcaaagatgaacagaaccatcattgttcgcaggaactacctccacttcgttaagaaatatcagaggtacgagaagaggcactccaacattcctgctcacatctccccgtgcttccgtgtcaaggaaggtgactatgtcatcatcggccagtgcaggcccctctccaaaactgtgaggttcaacgtggtgaaagtcatcccagctggatccactggtggcagcggcgggaagaaggccttcaccgcagcctgagctttagactgttccatgagtagtctatagaatggtgtctttttgctaaaaattcctgctaggctggtgtttttcactatggtttggagattgttcgctgtctgaatggagtctcatcaccagaacatgttactcttt

SEQ ID NO: 42888 - protein, 161 aa, Panicum virgatum
  misc_feature: Ceres CLONE 2013982
  misc_feature (74)..(143): Pfam Name: Ribosomal_S17 Pfam Description: Ribosomal protein S17
MAEQTEKAFLKQPKVFLSTKKSAKDKKPGKGGSRFWKSIGLGFKTPREAIEGTYIDKKCPFTGTVSIRGRIIAGTCHSAKMNRTIIVRRNYLHFVKKYQRYEKRHSNIPAHISPCFRVKEGDYVIIGQCRPLSKTVRFNVVKVIPAGSTGGSGGKKAFTAA

SEQ ID NO: 42889 - DNA, 628 bp, Panicum virgatum
  misc_feature: Ceres CLONE 2013985
  misc_feature: Encodes the peptide sequence at SEQ ID NO. 42890
atctacagcctgttgttaagctttaccagtcttgttccagaatctcatacatcaagggtattcttcagcaatacaatggacaattttccacattgataaggacaaagtttcttgagccattggaagaatggatgacagagaatcgatttggtaggtttgcttctcttgttgagacagctattgaccttgatcagctggacaatggagagtacagaatatctcccctatattcttctgacttagctgtgctgaaggatgagctttctgttgttgaagatcacataaataatttgcacatgcatacagctaatgatctggatctttctgttgataagcatctgaagctagaaaaaggaccgtttggacatgtgtttagaatctcgaagaaagaggagcagaaagtcaggaagaaactcactagcaactacataatcatagaaactcgtaaagatggtgtgaagttcactagtccgaagctgaaaaagctaggtgatcaataccaggcactgcttagtgagtacacaagttgtcaaaaaaaggttgctgataatgtagtgagggtttcgggcaccttctcagaggtatttgaaaattttgctgcagttctttcagagttggatgttttaca

SEQ ID NO: 42890 - protein, 208 aa, Panicum virgatum
  misc_feature: Ceres CLONE 2013985
  misc_feature (75)..(172): Pfam Name: MutS_IV Pfam Description: MutS family domain IV
LQPVVKLYQSCSRISYIKGILQQYNGQFSTLIRTKFLEPLEEWMTENRFGRFASLVETAIDLDQLDNGEYRISPLYSSDLAVLKDELSVVEDHINNLHMHTANDLDLSVDKHLKLEKGPFGHVFRISKKEEQKVRKKLTSNYIIIETRKDGVKFTSPKLKKLGDQYQALLSEYTSCQKKVADNVVRVSGTFSEVFENFAAVLSELDVL

SEQ ID NO: 42891 - DNA, 747 bp, Panicum virgatum
  misc_feature: Ceres CLONE 2014021
  misc_feature: Encodes the peptide sequence at SEQ ID NO. 42892
aagacaagcagccaaccagcttcttcccttcgaccgctgatcggagagggttctcgtcgttcggggctaaacttacagcccgcggtgatctgaatgagctttgcgatcggcagctccgggcctgagctctggttctcgataccatcatcgtcaaacatcgagtccccccgtccgttcacgatggagaggaggtcggcgaggaggagcgggcctcaccggaagcagggagcggtagcgcactgtgccgagcgcaagccgcagggggcgggccaccggggaccggcggcgccgcccgcgccgccgcagccggggtgcttcacggcggagctggcgatggcgctcctcctcgtggccgcgtcgctggcgctcctgccgctggtcctgccgccgctgtcgccgccgccgttcctgctgctgctggtgcccgtgggcctgctcgccgtgctcgccgcgctcgcgttcgtcccgctcgacgcgcacagccaccacctcgtcggctcgccgcgctgacgccggtcccgcggggaggcggcttagattgccagcgtcgtagtacataaattgctgctgattcggatcagattagctaggattgttatttttttggctcgagtatttccattgtaacctgctgatcagataagttgggttcggtcgatcgagccatgcagctgcaattcattcatcgactgatcccacgaatgcgatccaaatgcagtatagcgatctaatccctccttgttttat

SEQ ID NO: 42892 - protein, 109 aa, Panicum virgatum
  misc_feature: Ceres CLONE 2014021
  misc_feature: Functional homolog of the protein sequence given in SEQ ID NO 50534
  misc_feature: Useful for making plants with modulated biomass
  misc_feature: The sequence is a functional homolog of SEQ ID NO 2 in US patent 7151206
MERRSARRSGPHRKQGAVAHCAERKPQGAGHRGPAAPPAPPQPGCFTAELAMALLLVAASLALLPLVLPPLSPPPFLLLLVPVGLLAVLAALAFVPLDAHSHHLVGSPR

SEQ ID NO: 42893 - DNA, 712 bp, Panicum virgatum
  misc_feature: Ceres CLONE 2014092
  misc_feature: Encodes the peptide sequence at SEQ ID NO. 42894
accgagctcccccaagaaacgtctcctctctccctccctcttcatcagttcgtcagcggcctccctccgctcaccattcttgccatggctctagattctgttcctacctatctcagcgacttgggatcagcccacagggctgccagaacccagcagcaaaggatcagcatcaggaaagatgagcgcacctggacctcggacacttacgctccgtatgatgacgggcaccagtggaggaagtacggcgagaagaagctctccaactccaacttcccaaggttctattacagatgcacctacaagaacgacatgaagtgccctgccacaaagcaagtccagcagaaggacaccagcgatcctccattgttttctgtcacttacttcaaccagcacacctgcagcaccagctcaaatcccatgggaagcacgagagatattgctgcgccatcgtcgtcgaggaaggcggtatcaatctgcttcagcccgcacacagccaatgagcagcccacattcttgacaacctcggcgacgcattctttcagagccaatcaacaaccagagaggagcccctatgcaagccagtttcagtggacaacctcatcgtcacctacaggtaacggtccggttatgattgaggttgacagtatttcaggaggaagcatttcatccagcagcgggggtgctctgcctaggacattgctgccgattggtc

SEQ ID NO: 42894 - protein, 209 aa, Panicum virgatum
  misc_feature: Ceres CLONE 2014092
  misc_feature (44)..(107): Pfam Name: WRKY Pfam Description: WRKY DNA -binding domain
MALDSVPTYLSDLGSAHRAARTQQQRISIRKDERTWTSDTYAPYDDGHQWRKYGEKKLSNSNFPRFYYRCTYKNDMKCPATKQVQQKDTSDPPLFSVTYFNQHTCSTSSNPMGSTRDIAAPSSSRKAVSICFSPHTANEQPTFLTTSATHSFRANQQPERSPYASQFQWTTSSSPTGNGPVMIEVDSISGGSISSSSGGALPRTLLPIG

SEQ ID NO: 42895 - DNA, 423 bp, Panicum virgatum
  misc_feature: Ceres CLONE 2014098
  misc_feature: Encodes the peptide sequence at SEQ ID NO. 42896
ctccacttctcctcctatctcaccgccacctgcgcctccgccgcaccggttccggcgatcttgggcccccctcggaaggaagggaggaagggaagggaagggacgagaagatgagttccggcggccgcacgggcacggccccgggcaccaagtcggtgtcgcggtcctccaaggccggcctgcagttccccgtcggccgcttcgcgcgcttcttcaagacgggcaggtacgccgagcgcgtcggcggccgcgcgcccctctacctcgccgccgccctcgactacctcggcgcggaggtgctggagctcgccggcaacgcggcgcgcgaccacaagaagaaccggatcgtgccgcgccccgtccagctcgccgcgcgccaccaccacgacctcagcgagctggtgggggccctcaccctcgccg

SEQ ID NO: 42896 - protein, 104 aa, Panicum virgatum
  misc_feature: Ceres CLONE 2014098
  misc_feature (18)..(91): Pfam Name: Histone Pfam Description: Core histone H2A/H2B/H3/H4
MSSGGRTGTAPGTKSVSRSSKAGLQFPVGRFARFFKTGRYAERVGGRAPLYLAAALDYLGAEVLELAGNAARDHKKNRIVPRPVQLAARHHHDLSELVGALTLA

SEQ ID NO: 42897 - DNA, 658 bp, Panicum virgatum
  misc_feature: Ceres CLONE 2014107
  misc_feature: Encodes the peptide sequence at SEQ ID NO. 42898
aaccagaggagcggcggcgcgggcggaccaggcggagcagcagctgccgggcgaggccaccgacgccaccatgggtatctcgcgtgactcgatgcacaagcgccgggccaccggtgggaagcagaaagcctggaggaagaagcgaaagtatgagctcggccgccagcctgctaacaccaagctgtccagcaacaagacagtgaggagggtccgtgtccgtggaggtaatgtgaagtggagggctctccgcctggataccggtaactactcatggggtagtgaggcggttactcgcaagacccgtatcctggatgttgtctacaacgcgtcaaacaatgagcttgttcgaacccagaccctcgtgaagagtgccattgtgcaagttgatgctgccccattcaagcagtggtacctcactcactatggagtggacattggtaggaagaagaaggccccggctgctaagaaggatgctgctgagggtcaagagggtgacgccacagctgaagaaacaaaaaagagtaaccatgtcctgaggaagcttgagaagcgccagcagggacggacacttgacccgcacattgaggagcaatttggcagtggaaggttgttggcatgtattgcttctcgccctgggcagtgtggccgagctgacggt

SEQ ID NO: 42898 - protein, 195 aa, Panicum virgatum
  misc_feature: Ceres CLONE 2014107
  misc_feature (1)..(195): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGDATAEETKKSNHVLRKLEKRQQGRTLDPHIEEQFGSGRLLACIASRPGQCGRAD

SEQ ID NO: 42899 - DNA, 1053 bp, Panicum virgatum
  misc_feature: Ceres CLONE 2014133
  misc_feature: Encodes the peptide sequence at SEQ ID NO. 42900
gtcggctcctcctcctgccgccgccgccgccgccgctgtcgtcaccacccgcctcgtttttgaactgacctctctctctctctctctctcgttcttatcttcgtctctctttcctccgcaaaggaaaagcggaggggaaaaaggcggagcaggcggagcggtacgaggagatggtggagttcatggagaaggtcgccgcggcggcgggcgccggggagctcaccgtcgaggagcgcaacctgctgtcggtcgcctacaagaacgtcatcggcgcgcgccgcgcgtcgtggcgcatcgtctcttccatcgagcagaaggaggaggcccgcggcgccgcgggccacgccgccgccgccgtcgacgccaaggtcttctacctcaagatgaagggcgactaccaccgctacctcgccgagttcaagaccggagccgagcgcaaggacgccgctgactccaccctagccgcctaccaggccgcccaggacatagccataaaggagctgccgcccacacaccccatcaggctcggcctcgcgctcaacttctccgtcttctactacgagatcctcaactcgccggaccgcgcgtgctcgctcgccaagcaggccttcgatgaagccatttcagaactggacactcttggggaagagtcctacaaggatagcaccctgatcatgcagcttcttcgtgacaacctcaccttgtggacttctgacatgcaggatgatggcggcgatgaaatgagggatgccagcaagcccgaggatgagcagtagccatgatccaagtgactgccgtctctatctcttaaccctttgggtagtcgtgatgcttgtacaaggaccattttcgtgtgtcctttatcatcgggtctgcttacctttcgttttgttatattcctatattgtgttatccatgtattgttttactttcctactggaaccctgttagtgtgtgggagagaataacctaagcctgcctttaactagtacaaggattgtcaactcttttgtactatgattgaatggttatgcatgttccatatatatccag

SEQ ID NO: 42900 - protein, 201 aa, Panicum virgatum
  misc_feature: Ceres CLONE 2014133
  misc_feature (1)..(187): Pfam Name: 14-3-3 Pfam Description: 14-3-3 protein
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 789 in the 11/479,226 US patent application
  misc_feature: The sequence is a functional homolog of SEQ ID NO 801 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application
  misc_feature: The sequence is a functional homolog of SEQ ID NO 1777 in the 11/479,226 US patent application
MVEFMEKVAAAAGAGELTVEERNLLSVAYKNVIGARRASWRIVSSIEQKEEARGAAGHAAAAVDAKVFYLKMKGDYHRYLAEFKTGAERKDAADSTLAAYQAAQDIAIKELPPTHPIRLGLALNFSVFYYEILNSPDRACSLAKQAFDEAISELDTLGEESYKDSTLIMQLLRDNLTLWTSDMQDDGGDEMRDASKPEDEQ

SEQ ID NO: 42901 - DNA, 659 bp, Panicum virgatum
  misc_feature: Ceres CLONE 2014145
  misc_feature: Encodes the peptide sequence at SEQ ID NO. 42902
agaaatcagcggaacacaacctatgtggatgctgtaatgacagttcctcttggtgcaatgctgcctgtgagtgggataaatgttgcatttaaccgtgaggcgttggggcctgctattttcccaggcctccggctacgcaacgaagggaagcacagatgggatacccttgaagatgtgtggaatggcttgtgtgctaaagtagtgtgcgacagcttagggtatggtgtgaagactggactgccttatgtgatgagaagtgatgcagaagcaggtaaagcactggagagcttgaaagactgggaaggggttaaaatcatggatgatgttcttccattcttccaatcactcaaactatcaaggactgctgttactgttgaggattgtgtcaaggagctagccagcattgtccgggagaaactaggaccaaagaatgcaatcttcaccaaagcagctgatgccatggtggaatggaacaacctctggaagtctcatgcagctcggaatgcttagtttggagtttgtgtgtttactacaaagcataattgtttggaatactttttttcagttttaatctttgcttgtggaactcatgaagctgaataaacgacgttccagtatgcagggaatttggcagaataattgaacatctgattgtatcg

SEQ ID NO: 42902 - protein, 169 aa, Panicum virgatum
  misc_feature: Ceres CLONE 2014145
  misc_feature (1)..(169): Pfam Name: RGP Pfam Description: Reversibly glycosylated polypeptide
RNQRNTTYVDAVMTVPLGAMLPVSGINVAFNREALGPAIFPGLRLRNEGKHRWDTLEDVWNGLCAKVVCDSLGYGVKTGLPYVMRSDAEAGKALESLKDWEGVKIMDDVLPFFQSLKLSRTAVTVEDCVKELASIVREKLGPKNAIFTKAADAMVEWNNLWKSHAARNA

SEQ ID NO: 42903 - DNA, 664 bp, Panicum virgatum
  misc_feature: Ceres CLONE 2014148
  misc_feature: Encodes the peptide sequence at SEQ ID NO. 42904
ctacgcggaatacttcgaaatgtatgaaaactgccccttgcccccttccctgctttgcggccttgcctcgatttggaactgccccgtgcacgtgcgccgccgcgatccgcaccctccccgcctcgcctcggggatcccgccgccgttccacccgcctctgcttccagagagagagagagagatggccaaggccaggtcgtcggcgaagcagtcgcgcgcgcaggcgccggcgcagcagcagaacggcgcccacgcgctctcctccaagctcgcgaggtacctcgatccggaggccacctgggacaaggaccagctgctggacgcggtgcactggatccgccaggcggtggggctcttctgcggcctgctctggggagccgtccccctcgtcggcgccgtctggatcgcgctatttatggctatttcgacgggcattatttattggtactacgcatacgttttgaagattgacgaggaggaatatggaggccatggggcgctacttcaggagggactttttgcttctttcacccttttcctgctttcgtggactctagtatacagtttggctcacttttgagaagctcctttgctgcacataccatgcgatctttgctcaccgtgtcaacaaaagaaactcaccaggaaagtgtaaattaaagag

SEQ ID NO: 42904 - protein, 132 aa, Panicum virgatum; identical to SEQ ID NO: 27248
  misc_feature: Ceres CLONE 2014148
  misc_feature (19)..(132): Pfam Name: Rab5ip Pfam Description: Rab5-interacting protein (Rab5ip)

SEQ ID NO: 42905 - DNA, 675 bp, Panicum virgatum
  misc_feature: Ceres CLONE 2014152
  misc_feature: Encodes the peptide sequence at SEQ ID NO. 42906
ttgcgccgcaaccctgcaggcgtgcaatatgctgattggcagattaaagccagtcttggataggctgcagcagcaatctgaaaatgtctcatgggatactttgatttctcaggcttccaaagaaaatgttaatttatctgcgagtgcatactgggtacctgatcaagattcttacaggtacctgaactatggagctggtataagtgaggtggagattgatcttcttacaggagcaattactatattaaggggtgatcttgtgtatgactgtggaaagagcatgaaccctgctgtggacttaggccagattgaaggttcctttatacagggaattggcttcttcgtatatgaagaatatgttacgaacagtgatggcttgatgattagcaacagcacatgggactacaagatcccaagcgtcgacataatcccaaagcagtttaatgctgaggttctgaacactggataccataagaaacgcgtgctttcttcaaaagcttgtggtgaacctgctttgattgctgcctcatccgttcattgtgcactgagagaagctattagagcagcaagaaaggagtttgcaaacagcactggatctggaagctcacctctggaattccagatggatgtccctgcgccaatgacactggtgaaagaactatgtggttttgacat

SEQ ID NO: 42906 - protein, 224 aa, Panicum virgatum
  misc_feature: Ceres CLONE 2014152
  misc_feature: SWISSPROT Homolog: EC 1.2.3.14 Abscisic-aldehyde oxidase
CAATLQACNMLIGRLKPVLDRLQQQSENVSWDTLISQASKENVNLSASAYWVPDQDSYRYLNYGAGISEVEIDLLTGAITILRGDLVYDCGKSMNPAVDLGQIEGSFIQGIGFFVYEEYVTNSDGLMISNSTWDYKIPSVDIIPKQFNAEVLNTGYHKKRVLSSKACGEPALIAASSVHCALREAIRAARKEFANSTGSGSSPLEFQMDVPAPMTLVKELCGFD

SEQ ID NO: 42907 - DNA, 713 bp, Panicum virgatum
  misc_feature: Ceres CLONE 2014163
  misc_feature: Encodes the peptide sequence at SEQ ID NO. 42908
taccatcgatgagtatgctgttggtcagctgaaggagtttgagggcaagaagcttgtctctgccaccaaggagggcctgaagcttgatgagactgaggatgagaagaagaggaaggaggagctgaaggagaagtttgaggggctctgcaaggtcatcaaggaggttctgggcgacaaggttgagaaggtggtggtctctgaccgtgttgtggactcaccgtgctgccttgtaactggcgagtacggctggactgccaacatggagaggatcatgaaggcgcaggccttgagggactcgagcatggcgggctacatgtcgagcaagaagaccatggagatcaacccggagaatgccattatggacgagctccgcaagcgtgctgaggccgacaagaacgacaagtcagtgaaggacctggtgatgctgctcttcgagactgcacttctcacctccggcttcagcctggacgaccccaacaccttcggcaccaggatccaccgcatgctcaagctcggcctgagcattgacgaggacgagtctgctgaagcagatgctgagatgcctccactggaggatgacgctggcgagagcaagatggaggaggtcgactaagcgtctgcggtttatccttagttatctgtcgtagcttaatctgactactgttcgatgcttttggcacgttattggttttgtgtaagctagctacgagtgg

SEQ ID NO: 42908 - protein, 203 aa, Panicum virgatum
  misc_feature: Ceres CLONE 2014163
  misc_feature (1)..(203): Pfam Name: HSP90 Pfam Description: Hsp90 protein
TIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENAIMDELRKRAEADKNDKSVKDLVMLLFETALLTSGFSLDDPNTFGTRIHRMLKLGLSIDEDESAEADAEMPPLEDDAGESKMEEVD

SEQ ID NO: 42909 - DNA, 703 bp, Panicum virgatum
  misc_feature: Ceres CLONE 2014182
  misc_feature: Encodes the peptide sequence at SEQ ID NO. 42910
aaggagtccgttccttcaactctgctctcccccttccttcccctccccccgtcccctgtccgtctccgcccagatccagatccagggttcaatcaccacaccaggataagcaaccgagacaatggcggcagactctagcgctcgtaggcagccaaccttcaccaaggttgaccagctgcgcccggggacccatggccacaacctcattgtcaaggtcgttgactccaagatggtcgtccagaggggccgcgatggagggccgcagggcaggcagatgcggattgctgagtgcttggtcggcgatgaaaccggcatcatcgtcttcactgcaagaaacgaccaagtggatgtaatgaagcctggaacaactgttgaactgaggaatgcaaagattgacatgttcaagggttcgatgcggctcgccgttgacaagtggggaattgtgaaagctgcagaaagcccagctgagtttgcagtcaaggaggacaacaacctgtccttgattgagtttgagctggtgaccgtggtggagtgaaaaccaccttttgtaggaggatgttgcgttatgttatgttgttgaacctattgggcaccaccaaaaaataaacaagacatggttgatgttctcgtatacattggaggttggttatggttagtgatgtttagttatcaaaatcagcgagagtcgtccatggcatctccc

SEQ ID NO: 42910 - protein, 137 aa, Panicum virgatum; identical to SEQ ID NO: 40098
  misc_feature: Ceres CLONE 2014182
  misc_feature: Functional homolog of the protein sequence given in SEQ ID NO 50161
  misc_feature: Useful for making plants with modulated drought sensitivity
  misc_feature: Useful for making plants with modulated water use efficiency

SEQ ID NO: 42911 - DNA, 651 bp, Panicum virgatum
  misc_feature: Ceres CLONE 2014183
  misc_feature: Encodes the peptide sequence at SEQ ID NO. 42912
agcgctggcatcactcggagccttgcctctgtaggtagagagtgtgttgtttgcagggggaagaagggaagaagggaagagggcaatggcgacctccttccaggggacgaccaccaagtgcaccgcctgcgacaagacggtgtacctcgtcgacaagctcaccgccgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggaacccccaaggttgtcaagccagaaagaaagaatgagaatgctattaaagtctccagtgcctttgctggcaccagagagaaatgtgttggatgcagcaagacagtctatccaattgagagggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatccatgagaagacatcacaggctggatcgctgggagacg

SEQ ID NO: 42912 - protein, 177 aa, Panicum virgatum
  misc_feature: Ceres CLONE 2014183
  misc_feature (108)..(164): Pfam Name: LIM Pfam Description: LIM domain
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: Functional homolog of the protein sequence given in SEQ ID NO 50126
  misc_feature: Useful for making plants with altered carbohydrate content
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSSAFAGTREKCVGCSKTVYPIERVTVNNTMYHKSCFKCCHGGCTISPSNYIAHEGKLYCKHHHIQLIKEKGNFSQLENDP

SEQ ID NO: 42913 - DNA, 710 bp, Panicum virgatum
  misc_feature: Ceres CLONE 2014195
  misc_feature: Encodes the peptide sequence at SEQ ID NO. 42914
atcggttcacccgggatcagctgcgccccgctccgccaccaacatcgctccgtcggccaaatccccccgcgccctgttcctccagcgcgccaaatcctcctgcgccaccagctcatccacacctgcgtcacgcaggaggaggacgccgccggccgcggcggcgtctccctctccaaggacctcgtgctcgtcgccgacgaggccctgcgcaccaacatcaccacgctggggccgctcgtccaccccatgtccgagcagctccgcttcctcgccaccgtcgtcctcacccacgtcttccgcgccaacgtccgtcccccaggcgctcgcgcgcccaattcgtcgccgcgccaaatccacccccgtcactcccccagatcctcccccacgcctctcctcgccgcgccaatccacccgcccaagtcccagccccgcggccggccgtcatccttccgcccccagccccgcggccggcatccgctcgtcgataaggacgggcgatgcatatctgtctagctctctagaacttgtgcaacttgtctctagtcaaatataggacggtggtattccaaataaaagtgtaaatctatgttttttttattttttttgttcgtgcgcacatgctatctgggctgtaccacggttgatttggtacttacatgtcttctgccatcatccgcagagattgaaatatattatatgtaattatttcc

SEQ ID NO: 42914 - protein, 170 aa, Panicum virgatum
  misc_feature: Ceres CLONE 2014195
  misc_feature (9)..(98): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
IGSPGISCAPLRHQHRSVGQIPPRPVPPARQILLRHQLIHTCVTQEEDAAGRGGVSLSKDLVLVADEALRTNITTLGPLVHPMSEQLRFLATVVLTHVFRANVRPPGARAPNSSPRQIHPRHSPRSSPTPLLAAPIHPPKSQPRGRPSSFRPQPRGRHPLVDKDGRCISV

SEQ ID NO: 42915 - DNA, 714 bp, Panicum virgatum
  misc_feature: Ceres CLONE 2014206
  misc_feature: Encodes the peptide sequence at SEQ ID NO. 42916
aagtcaccaacgcgcctccattcccgttcctctcttgcctagggttctagccctctcgtcgtcgccctccggcgccgaccatgacggccgagaccacgacgccggaggagcagctccgcgcccagctcgaggagcagaagatccacgagggagatgacccgattgttgaggatgacgatgatgaggaagatgacgatgatgaggatgacgatgatgctgagggagttgatgctagtgggagatctaagcagagccgcagtgagaaaaagagcaggaaggccatgctgaagcttggcatgaaggcgatcactggtgtaagccgtgtaactgtcaagaagagcaagaatatgctctttgtcatctccaaaccagatgtcttcaagagccctgcatcagacacctacgtgatctttggggaggccaagattgaggacctgagctcacagctgcagacacaggctgcagagcagttcaaggcaccagacatgagcagcgtcctgtcaaagccagaggtctccacagcggcccaggatgacgatgaagctgtcgatgagactggtgtggaggagaaggacattgagttggtgatgacccaggctaccgtgtcgagggctagggcggtgaaggcgctgaaggcggccgatggggacatagttagtgcaatcatggagctgacaacttagctggccgtgcgcctacttgtgatatcatgtc

SEQ ID NO: 42916 - protein, 200 aa, Panicum virgatum
  misc_feature: Ceres CLONE 2014206
  misc_feature (59)..(118): Pfam Name: NAC Pfam Description: NAC domain
  misc_feature (161)..(198): Pfam Name: UBA Pfam Description: UBA/TS-N domain
MTAETTTPEEQLRAQLEEQKIHEGDDPIVEDDDDEEDDDDEDDDDAEGVDASGRSKQSRSEKKSRKAMLKLGMKAITGVSRVTVKKSKNMLFVISKPDVFKSPASDTYVIFGEAKIEDLSSQLQTQAAEQFKAPDMSSVLSKPEVSTAAQDDDEAVDETGVEEKDIELVMTQATVSRARAVKALKAADGDIVSAIMELTT

SEQ ID NO: 42917 - DNA, 689 bp, Panicum virgatum
  misc_feature: Ceres CLONE 2014211
  misc_feature: Encodes the peptide sequence at SEQ ID NO. 42918
acacacacacacacacacacacccacacccagctcacagcctgctccaccagcacatcacccagctccagctccggcagcagcagcagcagccgtcagccatgagcaaggactgcggcaaccacggcgacgacgacttcaagcagagcctccggcgcctgctgggcgtcctcctggtgctcgccctcatcgtcggcctcatcgcgctcatcgtctacctggtcctgcgccccacgcacccgcgcttcatcctccaggacgccgcgctccgccagctcgacctctccaacggctcggcgccgctgctctccacggcggtccaggtcaccgtcgcctcccgcaaccccaacggccgcgtcggcgtgcactacgaccgcctcgacgtctacgcctcctacaagtaccagcaggtcacgctcgcgtccaggctcccgccgctgtaccagggccacggcgacgtcgacgtctggtcgccagtgctgaccggcccgaacgtgcccttcgcgccgttcctcgccgacaccatgagaaaggacatcgccaccgggtacctcatcatggaggtcaggatcgacggccgcgtccggtggaaggtcggcagctggacgtccggccactaccacatcttcgtcacctgcccggcctacttcatcggcagcggcacatccagcgtcgtcggtgcgcatgggc

SEQ ID NO: 42918 - protein, 196 aa, Panicum virgatum
  misc_feature: Ceres CLONE 2014211
  misc_feature (39)..(179): Pfam Name: Hin1 Pfam Description: Harpin-induced protein 1 (Hin1)
MSKDCGNHGDDDFKQSLRRLLGVLLVLALIVGLIALIVYLVLRPTHPRFILQDAALRQLDLSNGSAPLLSTAVQVTVASRNPNGRVGVHYDRLDVYASYKYQQVTLASRLPPLYQGHGDVDVWSPVLTGPNVPFAPFLADTMRKDIATGYLIMEVRIDGRVRWKVGSWTSGHYHIFVTCPAYFIGSGTSSVVGAHG

SEQ ID NO: 42919 - DNA, 666 bp, Panicum virgatum
  misc_feature: Ceres CLONE 2014244
  misc_feature: Encodes the peptide sequence at SEQ ID NO. 42920
attgacagctgccctcccgctcaaggctaaggctctctaccgctcagggcctcaggttcatctcctccctctgtttctcttctcaaacccttcccttctctcgaagagaaactctctcctgatctcctcccttgctcgagatcttccttccctggcgacgacgactgggcgggcggtggcccagccctttaccggcgacgagcgcatcctccaggtcatggcagagaccatagatttatcaggggacggaggtgttcttaagacggtggtccggaaagcaaaggatggtgctatagcgccatctgatagtctgcccctggttgatgttcattacgaaggcacacttgctgagaatggtgaagtttttgacaccacccatgaagacaactctattttctcatttgaaattggacagggggctgtcatcaaagcatgggatatagccttaagaactatgaaggttggcgaggttgcaaaacttacgtgcaagccagaatatgcatatggaactgcgggctcaccaccggagatagctcctaatgcaaccctcatttttgaggtggagttagttgcttgcaagccgaggaaaggttcaagtgtgggcagtgtctctgatgagaaagccaggcttgaggaacttaagaagcagcgagagctagctgctgc

SEQ ID NO: 42920 - protein, 149 aa, Panicum virgatum
  misc_feature: Ceres CLONE 2014244
  misc_feature (22)..(118): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature: Functional homolog of the protein sequence given in SEQ ID NO 50112
  misc_feature: Useful for making plants with modulated biomass
MAETIDLSGDGGVLKTVVRKAKDGAIAPSDSLPLVDVHYEGTLAENGEVFDTTHEDNSIFSFEIGQGAVIKAWDIALRTMKVGEVAKLTCKPEYAYGTAGSPPEIAPNATLIFEVELVACKPRKGSSVGSVSDEKARLEELKKQRELAA

SEQ ID NO: 42921 - DNA, 982 bp, Panicum virgatum
  misc_feature: Ceres CLONE 2014247
  misc_feature: Encodes the peptide sequence at SEQ ID NO. 42922
cccacagtgcagtgctcctccccgttgccactcgcagtcgcagccagagagcctcccgcagcagccagcgctcgcaatggagcggccttccagcagcgccgtcctcctcccctgcctcctcctcctcctggccacgggctccctcgcgcagtcccccgcggcagctccggcccaggcgccgcccaagtcctccaaggccacgccggcgccggccgccgccaccccggccgcgcccgcgcccaagtccgcctccaaggccagccctgcccccgccgccgccccgaccaccacccccgccaccccggcccccgccgcggcgccgacgaccaagcccaaggcccctgcgcccgcgccccctgccaaggccaccgccccggcgcccgctgcgacgccccccgccgccgccgcgccgcccgcgcccgtgcccgaggtcccggccgccgcgccggcgccggagaccaagcccgccgaggcgcccgcccccgccaagaagaagaagccgtcgtcgccgccgcccaagagcaagaagaagaagaaggcggccgcgcccgccccggccgcggaggcccccgtcgccaagaagcacaaggccgccgacgcgccctcaaccgacgccgaggccccagggcccagcggcgacgccgccgccgccgacaccgcgagcgccgcagggaggaccacggggcgggcggcgggcgcgatcgcgtcggccgtcgcggtggcgctggccgcggcggcgctgctcgcctagatcccggatgcttttgctctgtgcctgtgaccccacaggatccgatgctgctactggccgtgctacccttttcccgctttttcctcttttgtgtaatttgtgactagtgtagtagggctctcacttgtgcggatgcattcttttgctttaggttagagatggtaggggtgtgcttgcctgtgtattgttcagatttatttataactctttatatatcattgttattgcttc

SEQ ID NO: 42922 - protein, 224 aa, Panicum virgatum
  misc_feature: Ceres CLONE 2014247
  misc_feature: Functional homolog of the protein sequence given in SEQ ID NO 50275
  misc_feature: Useful for making plants with altered carbohydrate content
MERPSSSAVLLPCLLLLLATGSLAQSPAAAPAQAPPKSSKATPAPAAATPAAPAPKSASKASPAPAAAPTTTPATPAPAAAPTTKPKAPAPAPPAKATAPAPAATPPAAAAPPAPVPEVPAAAPAPETKPAEAPAPAKKKKPSSPPPKSKKKKKAAAPAPAAEAPVAKKHKAADAPSTDAEAPGPSGDAAAADTASAAGRTTGRAAGAIASAVAVALAAAALLA

SEQ ID NO: 42923 - DNA, 555 bp, Panicum virgatum
  misc_feature: Ceres CLONE 2014249
  misc_feature: Encodes the peptide sequence at SEQ ID NO. 42924
gttcaatcgagtcgagtccaatcgcatcgcagcaattccaactccggcgatctcgctccggtcggaagcagcaagatgtccggcgaggaggaggagaacgccgccgagctcaagatcggagaagagttcctcaaggccaagtgcctgatgaactgcgaggtggccatcatcctggagcacaagtacgagcagatccagcagcacgcgtcggactcggacccctcgtcgcaggtgtcgcaggtgttcgagaagtcgctgcagtacgtcaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgacggcgacgccggcgacgagaagatgctcaacgacctctccctcatcaagaagttcgagtagccagctctagtgccatctgccgcagtcttgctatattgccatggccatgccttttgt

SEQ ID NO: 42924 - protein, 140 aa, Panicum virgatum
  misc_feature: Ceres CLONE 2014249
  misc_feature (19)..(137): Pfam Name: RNA_pol_Rpb4 Pfam Description: RNA polymerase Rpb4
  misc_feature: SWISSPROT Homolog: EC 2.7.7.6 DNA-directed RNA polymerase
  misc_feature: Functional homolog of the protein sequence given in SEQ ID NO 50814
  misc_feature: Useful for making plants with modulated drought sensitivity
MSGEEEENAAELKIGEEFLKAKCLMNCEVAIILEHKYEQIQQHASDSDPSSQVSQVFEKSLQYVKRFSRYKNPDAVRQVRETLSRYGLAEFELCTIGNLCPDTSGEATALVPSLKSGGRFDGDAGDEKMLNDLSLIKKFE

SEQ ID NO: 42925 - DNA, 690 bp, Panicum virgatum
  misc_feature: Ceres CLONE 2014261
  misc_feature: Encodes the peptide sequence at SEQ ID NO. 42926
acataggcatagccaggcaacacattacatagaagctcgatacaatggcgatccggaacatgcaggtggcgacgcgttcgctggacgcggacatgacggtggacgagttcaaggagtggctgcggcggttcgacacggaccgcgacgggcgcatcagccgcgacgagctgcggcgcgccatgcgcgccatccgcgcccggttcacggggtggcggagcaggcagggcatcagctacgccgacgcggacggcgacggctacatcgacgacagcgaggtggacggcctcatcgagttcgcgcagaagaacctcgggctcaagatcgtcgcctactgagctagtcgacgcaggtggcggccgggcgggccgggcggcggcgagagctagctccatcaccatggtccatgggctagccgcagcacgccaccatctgcctgtccccgctaaaaataagaactgcttgatcgaccgcttgcttgcttaaagcttttctttcttgtacgtactctatcaattcatgggctctgtatccctctgtgtgtgatctatgtaaggtgtgtatggcggctgcctcctctgcaaggtcgagccctgccatgggtgccgccgccgcggattttcatttgtttgctctagtgaaattgacagtgtatccttgaccatcatatcccgtgtctcctctgaatctccc

SEQ ID NO: 42926 - protein, 96 aa, Panicum virgatum; identical to SEQ ID NO: 10230
  misc_feature: Ceres CLONE 2014261
  misc_feature (21)..(49): Pfam Name: efhand Pfam Description: EF hand

SEQ ID NO: 42927 - DNA, 638 bp, Panicum virgatum
  misc_feature: Ceres CLONE 2014278
  misc_feature: Encodes the peptide sequence at SEQ ID NO. 42928
cctggaggaccatcagtgaaatttctagttaatgcagttcacactatggaggagttgaagcttactggtaaccatctaaaagggtcacggccgcttcttactttttctacaaattttgatgagcaacctcattggatgcttgtgaaggaaatgataactcagatatttgctactcctaaagatcaccgcaaagccaaacccttccatgaccatgtgtttgccttttccatcattgacggtcatgtttggtttcggaactaccagatctctgttccccacaatgagattgacaaagttgataaaggaggtcttgataaaatgacacttattgaggttggccccaggttttgtttgaatccaatcaaaatatttggtggtagttttggtggtcctacgtggtatgagaatccatactatatttctcccaatcagatccgtgcactagagaagcggcagaaggcaggcaaatatgtcaagaaggtgaaggccaaggtgaggaggaagatgcatgagatggagaacaccctggagcctgatgagtttgctgaactctggaaaggggagtagaagtgctttcatcgaccctgccaaaggtgtggaacacctgcaacggcttttaaggaagcacagattttgtt

SEQ ID NO: 42928 - protein, 188 aa, Panicum virgatum
  misc_feature: Ceres CLONE 2014278
  misc_feature (1)..(123): Pfam Name: Brix Pfam Description: Brix domain
PGGPSVKFLVNAVHTMEELKLTGNHLKGSRPLLTFSTNFDEQPHWMLVKEMITQIFATPKDHRKAKPFHDHVFAFSIIDGHVWFRNYQISVPHNEIDKVDKGGLDKMTLIEVGPRFCLNPIKIFGGSFGGPTWYENPYYISPNQIRALEKRQKAGKYVKKVKAKVRRKMHEMENTLEPDEFAELWKGE

SEQ ID NO: 42929 - DNA, 672 bp, Panicum virgatum
  misc_feature: Ceres CLONE 2014279
  misc_feature: Encodes the peptide sequence at SEQ ID NO. 42930
ctataattttacagttgaggaattcaaatcgatcaccacaaaatacaaagtttcgtcaatgatgttagctcccattcatggctttggtttctggtttgaggtggagttcaatgggccccaagagtcctcccataatattccttccaatttgaatccacttgaaattattcagaataaaaggagacgatcatctgaagatacagttcttttgtccacagcccctgaggatgagccgacccattggcagcagactattctgtacctccctgatcctatagaggcgaagcaggatcaaactgtagaaggctctgtaacggtgtcccagagcaaggagaacccacgttttctgaatattcatctagagtgctccacaggaggacatacggtggtaaaagactgtgccatgcgatgaactggtcctttttactttttagttacagtactgggggctgtggctgggttcccccagtaaagatcctataacttgaaagaggtcttctagtattcctttctgcttccgcgaactgaattctatcatctgcagcgaggagttcaagattttgtactgatagtttatgtcccctcattttctgattttttactggaagcggagaatttgtattattaatgcattttttgtccactgttaatgaaggtgggggattgcaggat

SEQ ID NO: 42930 - protein, 136 aa, Panicum virgatum
  misc_feature: Ceres CLONE 2014279
  misc_feature: SWISSPROT Homolog: EC 2.1.1.125 Histone-arginine N-methyltransferase
YNFTVEEFKSITTKYKVSSMMLAPIHGFGFWFEVEFNGPQESSHNIPSNLNPLEIIQNKRRRSSEDTVLLSTAPEDEPTHWQQTILYLPDPIEAKQDQTVEGSVTVSQSKENPRFLNIHLECSTGGHTVVKDCAMR

SEQ ID NO: 42931 - DNA, 982 bp, Panicum virgatum
  misc_feature: Ceres CLONE 2014286
  misc_feature: Encodes the peptide sequence at SEQ ID NO. 42932
atcgagctccatggagctgctgctgctgctgctgctgctgctgcttgtgttcaccatcatcagccagttcctgcctcccgcgtcctgctcccctccttccaactacaaacactactgcgactggtgccctcgccactccaccgcctcgctgatgatcttccctccggccgccgccggtgcctgtgggtacggggccgccttggctacggagctcaatggaggaggatacctcgccgccgccgcgggcgccgagttcttccgcgacggcgccggctgcggcgcctgctaccagttgcggtgcagggaccggcgggtgtgcggcgacgccggcgtcaaggtcgtagtcgtcacggacgcggccaaccgcacggggggcttcctcctcgccagggaggccttcgccgcgatggccaacaaggacggcatggcggccgatcagcatcaactactcgccggccgctcggacaacgtcgtcatcccggtcgaattccggaggataccttgcgagtacaagaggaacctggcggtgcgggttgaggagggcagccggaaccctggccatctcgccgtgcggttcctataccagggcgggcagaccgacatcgccaccgtcgagatcgcgcagccgcaggcgtcgtcgccgtggcggcccatggcgcggctgcgccgtcgcgtgtggcgcgccgcgcgcgccccggccggcccgctgcggctccgcctcgtcgtcacggccggcttcggcggcaagtggctgcggacccaggacgcggtgctgccggcggactggcggcccgggcaggagtacgacacgggcctgcgggtcgccgacgtcgccatgcgcacctgcacccgctcctgccgcgcgcgcgccgccggcggcgccggcgacgaggagctcagatagtcgtcagcagatgacgtgcatgcatgttggcacgcgcgcttgttgtacatatttagtagtagcttgcattgatcccgt

SEQ ID NO: 42932 - protein, 297 aa, Panicum virgatum
  misc_feature: Ceres CLONE 2014286
  misc_feature (171)..(256): Pfam Name: Pollen_allerg_1 Pfam Description: Pollen allergen
  misc_feature (75)..(156): Pfam Name: DPBB_1 Pfam Description: Rare lipoprotein A (RlpA)-like double-psi beta-barrel
MELLLLLLLLLLVFTIISQFLPPASCSPPSNYKHYCDWCPRHSTASLMIFPPAAAGACGYGAALATELNGGGYLAAAAGAEFFRDGAGCGACYQLRCRDRRVCGDAGVKVVVVTDAANRTGGFLLAREAFAAMANKDGMAADQHQLLAGRSDNVVIPVEFRRIPCEYKRNLAVRVEEGSRNPGHLAVRFLYQGGQTDIATVEIAQPQASSPWRPMARLRRRVWRAARAPAGPLRLRLVVTAGFGGKWLRTQDAVLPADWRPGQEYDTGLRVADVAMRTCTRSCRARAAGGAGDEELR

SEQ ID NO: 42933 - DNA, 705 bp, Panicum virgatum
  misc_feature: Ceres CLONE 2014317
  misc_feature: Encodes the peptide sequence at SEQ ID NO. 42934
atctacttggagtctggacgtggggataaacttacactaccaacgaggaagtacatccaaaatcttctaaaggttaacatggaggaaccctatggaccagaatggccttcagaaaagaaaattaagcgccaagaaatggtggccctggaagcgcgatatatctttatcaagcaatattcaaacgggttcactactgaatgttccatgaatcaaggtgaaggggtggaacataaccacacaccatgtaatgaaggtcacttggttggttttgtacactataggtttgttctggaagacgagctacctgttgtctatgtgtatgagctacaaatggagacttctgcccacggcaaggggctgggaaagtttatgatgcagttaattgaacagatagcttgcacgaaccaaatgggagctgtgatgctaacagttcagaaagctaatactcaagctatggctttctatactaagttgagatatgtaatatccagtacctcaccatcacgagtggatcctcagataggacttgaaaaaagctatgagatattgtgcaagacatttgactcggaagctaagtctaaattagaggatggcaacgaagaactctgaagtcaaaattctcaggatgggcgtggccacagtccccatagcatgatctgtagctaagccacaagtttacatgacatattgtcatgcggccctggt

SEQ ID NO: 42934 - protein, 202 aa, Panicum virgatum
  misc_feature: Ceres CLONE 2014317
  misc_feature (79)..(161): Pfam Name: Acetyltransf_1 Pfam Description: Acetyltransferase (GNAT) family
  misc_feature: SWISSPROT Homolog: EC 2.3.1.178 Diaminobutyrate acetyltransferase
IYLESGRGDKLTLPTRKYIQNLLKVNMEEPYGPEWPSEKKIKRQEMVALEARYIFIKQYSNGFTTECSMNQGEGVEHNHTPCNEGHLVGFVHYRFVLEDELPVVYVYELQMETSAHGKGLGKFMMQLIEQIACTNQMGAVMLTVQKANTQAMAFYTKLRYVISSTSPSRVDPQIGLEKSYEILCKTFDSEAKSKLEDGNEEL

SEQ ID NO: 42935 - DNA, 662 bp, Panicum virgatum
  misc_feature: Ceres CLONE 2014324
  misc_feature: Encodes the peptide sequence at SEQ ID NO. 42936
aacaaccagcaaccgcatttcctcggctcgcatttctccccaaatcccccaattcaccaccgcgaacccgagcaccccagccgcaatcgatggcgcccaaggcggagaagaagcccgcggcgaagaagccggcggaggaggagccggccaccgagaaggcgcccgccggcaagaagcccaaggcggagaagcggctccccgcgggcaagtcggccggcaaggagggcggcgagggcaagaaggggaagaagaaggccaagaagagcgtggagacctacaagatctacatcttcaaggtgctgaagcaggtgcacccggacatcggcatctcctccaaggccatgtccatcatgaactccttcatcaacgacatcttcgagaagctggcggcggaggcggccaagctcgcgcgctacaacaagaagcccaccatcacctcccgcgagatccagacctccgtgcgcctcgttctccccggggagctcgccaagcacgccgtctccgagggcaccaaggccgtcaccaagttcacctcctcctaggctagctaggttcctatgctgttcatgatgttcacgagatttggctgctacggtggtgtagttagatgctctgaatgtgttttctgtaggaagtctcttgtgatttgttgaacagtaatg

SEQ ID NO: 42936 - protein, 150 aa, Panicum virgatum
  misc_feature: Ceres CLONE 2014324
  misc_feature (57)..(127): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAAKKPAEEEPATEKAPAGKKPKAEKRLPAGKSAGKEGGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 42937 - DNA, 842 bp, Panicum virgatum
  misc_feature: Ceres CLONE 2014350
  misc_feature: Encodes the peptide sequence at SEQ ID NO. 42938
ctctccccgcagcgcgccaccgcccccctgaaacacccccaagccggcgccgctgccgtccggccctcgtccttcaccatgatcatctccaagaagaaccgccgcgagatctgcaagtacctcttccacgagggggtcttgtatgccaagaaggactacaacctggccaagcaccccaagcttgacgtccccaacttggaggtcattaagctcatgcagagcttcaagtcaaaggagtatgtgagggagaccttctcctggcagtattactactggtacctcaccaatgatggcattgagcacctccgcaccttcctcaacctgccatcggaggttgtgcctaataccctcaagaagtcctccaagcccccatctcgtaccttcggctctggcccaccgggtgaccgccccaggggtcccccacgttttgagggtgacaggccgaggtttggagacagggagggttaccgaggaggtccgcgtggtgctccaggtgattttggtggtgataagggtggtgctcctgcggagttccagccctcttttaggggtagcagaccgggctttggccgtggtggtggcggcggcgcatttggtgctggggcatcttccatggagtgatacttgagttagccagcacattgatttgatgaatggctttacagatgcagcgcacaaggggaggcttctctgttggtctttgaatcatgaggacaatgcgattttgtttaccaagttgtagcagtggttatgtgatttttcgtttttgttagatgaaattcttgaggctgttggtcggccaagaatgaagaatgttatgagcaatttatcataattctgtc

SEQ ID NO: 42938 - protein, 180 aa, Panicum virgatum
  misc_feature: Ceres CLONE 2014350
  misc_feature (3)..(98): Pfam Name: S10_plectin Pfam Description: Plectin/S10 domain
  misc_feature: Functional homolog of the protein sequence given in SEQ ID NO 50186
  misc_feature: Useful for making plants with modulated nitrogen use efficiency
MIISKKNRREICKYLFHEGVLYAKKDYNLAKHPKLDVPNLEVIKLMQSFKSKEYVRETFSWQYYYWYLTNDGIEHLRTFLNLPSEVVPNTLKKSSKPPSRTFGSGPPGDRPRGPPRFEGDRPRFGDREGYRGGPRGAPGDFGGDKGGAPAEFQPSFRGSRPGFGRGGGGGAFGAGASSME

SEQ ID NO: 42939 - DNA, 735 bp, Panicum virgatum
  misc_feature: Ceres CLONE 2014357
  misc_feature: Encodes the peptide sequence at SEQ ID NO. 42940
accgtgcgatctcgcattcctctctccaatctctcgagcctttcctcctcgtccgtcccgagacactcgaagcccagcggcggccatggacaccaccggcaccggagctggcggcaaggtgaagaagggagccggtgggcgcaagaccggcgggccaaggaagaagtcggtgacgaggtccgtgaaggccgggctccagttccccgtcggccgtatcgggcgctacctcaagaagggccgctacgcgcagcgcgtcggcagtggtgcccccgtctacctcgccgccgtcctcgagtatctcgccgctgaggttctggagctcgccggcaacgcggccagggacaacaagaagacgcgcatcatcccccgccacgtgctcctggcgatccgcaacgacgaggagctcgggaagctgctctccggcgtcaccatcgcccacggcggcgtcctccccaacatcaacccggtcctgctgccgaagaagacggcggagaaggcgtccagcggcggcagcaaggaggccaagtcgccgaagaaggcggccaagtcccccaagaaggcatagagggtggacttagatccaaatgtgtagcgccgtctcgtgtttcctgtgatgtttaggttgtaggtcagtggtgtcgtaacctgtgatctgtggttttcaatggaagaaatggttagttcaacttaactcggtgcgcctgattttgaaatgtgctgtaactctttttgcgc

SEQ ID NO: 42940 - protein, 159 aa, Panicum virgatum; identical to SEQ ID NO: 42337
  misc_feature: Ceres CLONE 2014357
  misc_feature (31)..(104): Pfam Name: Histone Pfam Description: Core histone H2A/H2B/H3/H4

SEQ ID NO: 42941 - DNA, 672 bp, Panicum virgatum
  misc_feature: Ceres CLONE 2014359
  misc_feature: Encodes the peptide sequence at SEQ ID NO. 42942
atccccactctctgccatccattccttcccggccggtggtcaagaagaagaaggagaatgctgctgggctcgacgttcgtggcgtccccggcggcgctggcgatgccgctgccggcgtgtcgtcgggcggcggcggggctccggatcgaggcggcgaagcagctgacgggtcgggtggtgacgaccaaggcggacaagacggtgggcgtggaggtggttcgcctggcgccgcaccccaagtacaagcgccgggagcgcatcaagaagaagtaccaggcgcacgaccccgacaaccagttcaaggtcggcgacgtcgtcgagctccgccgctcgcgccccatctccaagaccaagcacttcgtcgccatcccgctcccgccgcgagacacccgccgcaagtcgcagctcctgccgccgctccagtcgcagcaagacgagtcgtccatgcctgctgaatgagatgaaccactcaatgtagctgctgcttccacccactgtctgcattttacttgttatccgttttaatctcaacacattacatgctacttgcttgtgtaccctgctagtttttttttttaatcgaaacaaacatgcatgctgtgctcagctctgcctgccaagagaaacatgctgtgattgtcatactaccactactgcgatgtttcgagtctc

SEQ ID NO: 42942 - protein, 133 aa, Panicum virgatum
  misc_feature: Ceres CLONE 2014359
  misc_feature (38)..(106): Pfam Name: Ribosomal_S17 Pfam Description: Ribosomal protein S17
MLLGSTFVASPAALAMPLPACRRAAAGLRIEAAKQLTGRVVTTKADKTVGVEVVRLAPHPKYKRRERIKKKYQAHDPDNQFKVGDVVELRRSRPISKTKHFVAIPLPPRDTRRKSQLLPPLQSQQDESSMPAE

SEQ ID NO: 42943 - DNA, 700 bp, Panicum virgatum
  misc_feature: Ceres CLONE 2014361
  misc_feature: Encodes the peptide sequence at SEQ ID NO. 42944
gagaggacgtcccgaagggagagagagaaagaggcacgcgcagcatccattccttgccgctgccgccgcacactcccattgcagagccccaccccgcgcaaaagcagagcagccactttcccctcccgctccccatctccgtcctcctcctcctcctcgcgctgctggcgctggcggcggcggcccgcgcgggcgacgtgccggcggcggcgctgggctgggagctcggggtggtgggcgccgcggaggacgaggagttcggcttccccgccggcggcggctccgtggcgcgccgggtgctgcagggcgggtccgggtacatcagctacggcgcgctgcggcgggacaacgtgccgtgctccgtgcggggggcctcctactacaactgccgccccggcgcgcaggccaacccctactcgcgcggctgctccgccatcgcccgctgccgcggctgatccctcgcccgcctgcttcggcaccggcgaccgccgggaggaagaggagaaggttcatcccgttaatccctcgccgttcagcagaaaaaaaaggaaactgttcatctgccccttttaatcaattgttattgttattagtgctggtattatttgtcttgtcgtccatgcttagccgaggatgattggtggtggttgggctgattcagttcagatccggctgtcggggtctgtaaattgcacgcatg

SEQ ID NO: 42944 - protein, 150 aa, Panicum virgatum
  misc_feature: Ceres CLONE 2014361
  misc_feature (84)..(150): Pfam Name: RALF Pfam Description: Rapid ALkalinization Factor (RALF)
EDVPKGERERGTRSIHSLPLPPHTPIAEPHPAQKQSSHFPLPLPISVLLLLLALLALAAAARAGDVPAAALGWELGVVGAAEDEEFGFPAGGGSVARRVLQGGSGYISYGALRRDNVPCSVRGASYYNCRPGAQANPYSRGCSAIARCRG

SEQ ID NO: 42945 - DNA, 663 bp, Panicum virgatum
  misc_feature: Ceres CLONE 2014371
  misc_feature: Encodes the peptide sequence at SEQ ID NO. 42946
attccttctcctcccctgcatagactggtcctttaatttgaagcaacaaggagagaaagatgtccagtgtttggaagaccaaggttctgcctggcctcaacaagttctttgacaaggatggcaagaaggcggcggcggctgagttcttgaagtccttcaacaaggaggagattggcaaggagattgaggacaagaagacagagctggagcccaaggttgtggaggcttatgaagcatctcctcctgaagttaaggctcttttcaaggacaagaaaccagtcaagatcaccaagaagaactcggctgcagcaaccaagttcctcgacgagctggctaagattgagttccctgaagccagcggaagccgaagccgaggccgcggcggcgccaccagctgaggaggagaagaagtgatctgatcgccggtggacattagtgaagaattgctaagcaagcaaattaagctactaccaagctccgatcctgcacaaattaagtgattaagtaagtcgttacatgtacacacagttgccatgcatgctgcttcaattgatttgcttgcatatatgggtgcgtggtggatgcatgaacatttgttattcttttgtgtcacctggaccggatcgatgaatggaccttcattctgtaaatttgtaatgtggg

SEQ ID NO: 42946 - protein, 112 aa, Panicum virgatum
  misc_feature: Ceres CLONE 2014371
  misc_feature (2)..(112): Pfam Name: DREPP Pfam Description: DREPP plasma membrane polypeptide
MSSVWKTKVLPGLNKFFDKDGKKAAAAEFLKSFNKEEIGKEIEDKKTELEPKVVEAYEASPPEVKALFKDKKPVKITKKNSAAATKFLDELAKIEFPEASGSRSRGRGGATS

SEQ ID NO: 42947 - DNA, 660 bp, Panicum virgatum
  misc_feature: Ceres CLONE 2014374
  misc_feature: Encodes the peptide sequence at SEQ ID NO. 42948
atcctccgccgtcgcctctccactttccccatccttcgccgacgtcccggtcgcctcgcagtgcgaagaccccccttactcccatggccagccgctgggtccgacccgaagtgtacccgctgttcgcggcggtgggcgtggtcctcggctatctgcggatttcggatcgtgaggaacgtcgccggcggcccggaaatcacggtatgcaagggggggagggcccctggtgtgtttgagaatcatgaggaggggaggccttctcctctgcacagactacgaagctttgtgcctgatcctaccccggaaataatgccctctattcctcaggtctttcgtgacggcctgtttagttcctttttgtctaagcggacatcggtgtaaactctctatttgaaggagtgcctcgaagtctatttcactcctttttttgcatcgatgggttgtcaaatcgcgagatgaatctcatgatgctgattaatgcctgattaatcgataccttagggcatggttagctgttgcatcggtggtgaagatcatgaataaagtaggctcattaaatatctctcggtatttgtcgacgctccatgccacagataatgtaaatagagttcgttaagtacatcgaaatagcgagattcgttttctcttccatgcgtttac

SEQ ID NO: 42948 - protein, 126 aa, Panicum virgatum
  misc_feature: Ceres CLONE 2014374
  misc_feature (42)..(116): Pfam Name: B12D Pfam Description: B12D protein
ILRRRLSTFPILRRRPGRLAVRRPPLLPWPAAGSDPKCTRCSRRWAWSSAICGFRIVRNVAGGPEITVCKGGRAPGVFENHEEGRPSPLHRLRSFVPDPTPEIMPSIPQVFRDGLFSSFLSKRTSV

SEQ ID NO: 42949 - DNA, 929 bp, Panicum virgatum
  misc_feature: Ceres CLONE 2014404
  misc_feature: Encodes the peptide sequence at SEQ ID NO. 42950
aatgaactgctactccacattcatcccatcccctttcaacctcttcgccgccgcagctcgcataaactagagcgaagttgctagcactgctagcatgggaggagccactaacctacctccaggtttccacttcttcccctcagatgaagatcttgtcatccatttcctcagtcgcaaagcggccaacctcccatgccgccctgacatcatcccaacagttcttctgcaacactacagcccgtgggaactgaatggcactgcactgcaagctggaaaccagtggtatttcttcagccatgcggcacaaagcaggatttcaccgaatgggtactggagccctattggtgctgatgaaacagtgacaagcagtggctgtgttgttggcctgaagaagacgctcatcttctgcaccggcgaaccttccaagggtttcaaaactaactggatcatgcatgagtaccaccttcaagatggagggtataatgtcagcggcagcagcacctcatcaagcagctcgagctccagcaggaaatcccaaaggaagagagttcactcgagcacggagtccaacaactgggtgatatgcagagtgttcgagtcgagctgcggttcgcaagtgagcttccatgacgagggcacggagctttcatgcttagatgaggtgtttttgtcgctagatgactatgatgaagtgagtctgccaaataattagaaccctagctagtaagtagtgctgacggtaggtcctatgcctatcaagccatttaattaaactgtgatggtgatatctacgtaagtggttgcaagttgcattatgtatgattcagatggcctgataggcatcgaacttaatccactctatcctaaatcattacaatgtaattaactatcatgcaagcaataggtataaaggttgagcttttgtctct

SEQ ID NO: 42950 - protein, 205 aa, Panicum virgatum
  misc_feature: Ceres CLONE 2014404
  misc_feature (7)..(125): Pfam Name: NAM Pfam Description: No apical meristem (NAM) protein
  misc_feature: Functional homolog of the protein sequence given in SEQ ID NO 51661
  misc_feature: Useful for making plants with altered carbohydrate content
  misc_feature: The sequence is a functional homolog of SEQ ID NO 2694 in the 10/374,780 US patent application
  misc_feature: The sequence is a functional homolog of SEQ ID NO 662 in the 10/225,066 US patent application
MGGATNLPPGFHFFPSDEDLVIHFLSRKAANLPCRPDIIPTVLLQHYSPWELNGTALQAGNQWYFFSHAAQSRISPNGYWSPIGADETVTSSGCVVGLKKTLIFCTGEPSKGFKTNWIMHEYHLQDGGYNVSGSSTSSSSSSSSRKSQRKRVHSSTESNNWVICRVFESSCGSQVSFHDEGTELSCLDEVFLSLDDYDEVSLPNN

SEQ ID NO: 42951 - DNA, 627 bp, Panicum virgatum
  misc_feature: Ceres CLONE 2014405
  misc_feature: Encodes the peptide sequence at SEQ ID NO. 42952
gaaaagaaaaagaaaaatcatctccaatctccaatcaagttaaccctagcagccgccggcggttagggtttcgagcgagatccggtggcgggggcggcgccggcgcctgctacaagtgcggggagcccggccacatggccagggactgccccagcgctgatggcggcggcggatacggcgggggcggctacggcggcggcggtggatacggcgggggcggctacggcggcggcggtggcggtggatgctttaagtgcggggagcctggccacatggccagggactgctccagcggcggaggcggttacggcggcggcggctacggaggcggaggcggcggcggcggcggcgcctgctacaactgcggccagaccggccacttggcgagggactgcgcctccggcggcggcggcggcggcggcggccgcttcggaggtggcggcggcggcggcggcgaccgctcctgctacaactgcggcgaggccggccacatcgcccgcgactgccccgccggcgccgcgtgagatcgggtcggatcgcgccgcgccactacccggtagtggtgtggcctccctatagatctcgcctaagcctctcactgtgtctcgttcgtcggagtattgcttt

SEQ ID NO: 42952 - protein, 173 aa, Panicum virgatum
  misc_feature: Ceres CLONE 2014405
  misc_feature (34)..(51): Pfam Name: zf-CCHC Pfam Description: Zinc knuckle
  misc_feature (153)..(170): Pfam Name: zf-CCHC Pfam Description: Zinc knuckle
  misc_feature (116)..(133): Pfam Name: zf-CCHC Pfam Description: Zinc knuckle
  misc_feature (80)..(97): Pfam Name: zf-CCHC Pfam Description: Zinc knuckle
  misc_feature: The sequence is a functional homolog of SEQ ID NO 468 in the 11/479,226 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
KEKEKSSPISNQVNPSSRRRLGFRARSGGGGGAGACYKCGEPGHMARDCPSADGGGGYGGGGYGGGGGYGGGGYGGGGGGGCFKCGEPGHMARDCSSGGGGYGGGGYGGGGGGGGGACYNCGQTGHLARDCASGGGGGGGGRFGGGGGGGGDRSCYNCGEAGHIARDCPAGAA

SEQ ID NO: 42953 - DNA, 1191 bp, Panicum virgatum
  misc_feature: Ceres CLONE 2014407
  misc_feature: Encodes the peptide sequence at SEQ ID NO. 42954
cttgagataagtggctacaagtttgtcaaggttctgccaggcaccatacaaaaactcacccacctgcaaactctaatttgcaagagaatgttttcgctgccggagtggttgggagacctcagatctctcacgagacttgggctagatcattgctcgtggatcaagactctgccagacagcatacaactacttacctgcctgcaaactctagaagtgagattttgtgaaagcatggtatcgctgccagagtatttgggagaccttacatctctcatggaacttacaataatacactgcaggcgcatggtttctctgccggagacgttaggagacctaatttctcttacaacacttcggatagatgaatgcgagggcatcaagtctctgccagtcagcatacaacaactcactcacctgcagactctagaagtgagcagtttcaagggcatggtttctctgccggaggcgttaggagacctcatttctcttacaacactttggatacaagattgcgagggcatcaagtctctgccagtcagcatacaacaactcactcgcctgcagactctaaaagtgaacagttgcaagggcatggtttctctgccggagacgttaggagacctcatttctcttacaagcctttggataactgattgcaggggcatcaagtctctgccaggcaccatacagaaactcaccagtttgcagcacctaatgattgagggatgccctgaactagttcagtggtgcgaatcggaggagaacaagatgaagctcgctcatattatacacaaggacttttgacggaggctgccaagtgatgatgagtcagaaactgatgaagaatcaggaagtggtcatgaagatccagtaattgatgaagagccggaaagtgatgtagagcaagaaactggtcagaaactgatgaagaaccagaaagtgatgaagacccagtaactgatgaagagtcagaaagtgagaaagaactagaaactggatcagaaggtgatgaagagtcagaaagtgacagaagagtctggaagtggcgaagagtcggagaacgaggacttcgagagtggtcaggaggaaacataatgcaatgcatagttcaggaagtgtcttttctggggaagtcaaagaggagcaccctacttaaattttattaagataggaatgcagttatacatcagc

SEQ ID NO: 42954 - protein, 267 aa, Panicum virgatum
  misc_feature: Ceres CLONE 2014407
  misc_feature: SWISSPROT Homolog: EC 2.7.11.1 Non-specific serine/threonine protein kinase
LEISGYKFVKVLPGTIQKLTHLQTLICKRMFSLPEWLGDLRSLTRLGLDHCSWIKTLPDSIQLLTCLQTLEVRFCESMVSLPEYLGDLTSLMELTIIHCRRMVSLPETLGDLISLTTLRIDECEGIKSLPVSIQQLTHLQTLEVSSFKGMVSLPEALGDLISLTTLWIQDCEGIKSLPVSIQQLTRLQTLKVNSCKGMVSLPETLGDLISLTSLWITDCRGIKSLPGTIQKLTSLQHLMIEGCPELVQWCESEENKMKLAHIIHKDF

SEQ ID NO: 42955 - DNA, 699 bp, Panicum virgatum
  misc_feature: Ceres CLONE 2014423
  misc_feature: Encodes the peptide sequence at SEQ ID NO. 42956
atcacaaccgacctccgatccacttctgctcaccacactgctaagctagctagctgctttacacttcactcactagtcactagcagcttgatcattcgacgatcagtgagtgttatcatatatcagtcgtagctgcaatattatatatggctcgcctctccgccgttgtcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctaggtggcaacatgggcaacgccgccgccagcatcccaagcaagtgcggcgtcaacgtcggcgtgccaatcagcccaaacgtcgactgcgccaagattaactgataagatgctaaggatggtggatgctcagctctttccttctctttgggtatgatgtcggccaacagagcagagagcagtcgtttaatttactacctcttccttttacatttgtacaacaccaggcaccaccacctgtgtacgtcgtcgtctatgtacaacaataatcctctctctgcttatgggtttgctgggtctctgt

SEQ ID NO: 42956 - protein, 117 aa, Panicum virgatum; identical to SEQ ID NO: 12304
  misc_feature: Ceres CLONE 2014423
  misc_feature (28)..(113): Pfam Name: Tryp_alpha_amyl Pfam Description: Protease inhibitor/seed storage/LTP family

SEQ ID NO: 42957 - DNA, 701 bp, Panicum virgatum
  misc_feature: Ceres CLONE 2014424
  misc_feature: Encodes the peptide sequence at SEQ ID NO. 42958
agcgacctaccactctgagtctcagtcacccaccgcacccctgagctagggtttccgcaccccgatcgatccaagctgcctccatgtccaccgcggcggcgcagggcggcgacaagccggcgctccgcaagcccgtcttcaccaaggtcgaccagctcaggccgggcaccaacggccacaccctcaccgtcaaggtcgtcagcgccacccccgtccctggacgcgcgcgcccaggagccaccaccaccaccgcgcccccccgcgcgccacgcatcgccgagtgcctcgtcggggatgagaccggcgccatagtcttcacggcccgcaacgaccaagttgatttgctgaagcctgatgccacagtgatcttgcgcaatgctaaaattgacatgttcaaaggatcaatgaggcttgcagttgataaatgggggcggattgaggctacagaacctgccagcttcacagtgaaggaggacaataacctgtcactagtagagtatgaattggttaatgtggctgagtaattggccaagcttttctaccccttttccgcgccataagaaggaagtaccatgaatgaacatcataaagcctctcaaagcgagtttatttgttagtggtacagtagtagataattaaggtgaaggttgtatcgctcctgttagaactttggattgagtaagctgagttgaccttgcatc

SEQ ID NO: 42958 - protein, 146 aa, Panicum virgatum
  misc_feature: Ceres CLONE 2014424
  misc_feature: Functional homolog of the protein sequence given in SEQ ID NO 50161
  misc_feature: Useful for making plants with modulated drought sensitivity
  misc_feature: Useful for making plants with modulated water use efficiency
MSTAAAQGGDKPALRKPVFTKVDQLRPGTNGHTLTVKVVSATPVPGRARPGATTTTAPPRAPRIAECLVGDETGAIVFTARNDQVDLLKPDATVILRNAKIDMFKGSMRLAVDKWGRIEATEPASFTVKEDNNLSLVEYELVNVAE

SEQ ID NO: 42959 - DNA, 677 bp, Panicum virgatum
  misc_feature: Ceres CLONE 2014431
  misc_feature: Encodes the peptide sequence at SEQ ID NO. 42960
ccgccattcctcaggcttccaaaccctacccacaccaccccgccgccgccgctcccagctcccgagcaagcagccgccatgccgcccaagttggacccctctcaggtggtggaggtcttcgtccgcgtgacgggcggcgaggtcggcgcggcgtcgtcgctggcccctaagatcggcccgctcggactctccccgaagaagatcggagaggacatcgccaaggagaccgccaaggactggaagggcctccgcgtcaccgtcaagctcaccgtccagaaccgccaggccaaggtctccgtcgtgccctccgccgcggcgctcgtcatcaaggcgctaaaggagcccgagagggacaggaagaaggtcaagaacatcaagcacagcggcaacatcagcctcgatgacgtcatcgagatcgccaggaccatgagggtcaggtccatggccaaggagatggccgggaccgtcaaggagatcctcggcacctgcgtcagcgtcggctgcaccgtcgacggcaaggaccccaaggatctgcagcaggagatcgacgatggggaggtcgaaatcccctccgcgtaaaggctagacatctaaggagattatcatcagatgcaactgaagtgttctgttccgtctgctgtctatttaccttaccaaacaatgtggctgcgcctatt

SEQ ID NO: 42960 - protein, 166 aa, Panicum virgatum
  misc_feature: Ceres CLONE 2014431
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARTMRVRSMAKEMAGTVKEILGTCVSVGCTVDGKDPKDLQQEIDDGEVEIPSA

SEQ ID NO: 42961 - DNA, 657 bp, Panicum virgatum
  misc_feature: Ceres CLONE 2014438
  misc_feature: Encodes the peptide sequence at SEQ ID NO. 42962
aaaaaccatgtccgcgcccgcccgccgcttctccccggccgccgatcgtttggcgtcgccggagccgcctataaaatcccggcggccaccccagcgtctctgcaacccatcatccatcgccctcacctagctcgctcctttcagtttcagactttcagtgccactcgtcatcaccaggaacagagctgcttcgtttcaaagcaaaccagccaatctcgcccttcttctcttaccacacagcatcaacgatgtcgactgtgagccgtgcgtcccttgaccagaagctcgccctcgccaagcgctgctcgcgagaggcgacccttgcaggagccaaggcggcagccgtggccaccatcgcctccgcgatcccaacgctggcgagcgtgcggatgctgccgtgggccaaggccaacatcaaccccaccggccaggccctcatcatctccacagttgctgggatggcatacttcatcgccgctgacacgaagattctgtcactggcgagaaggcactcgttcgaggaagctcccgaccacctcaagaacacctcctaccagggcgccggccgcccacacccggctttcttcaggccatgatgaggcatctggcgagatggcgccctcttggaagtaactgtactctgtgccgtagatgtcc

SEQ ID NO: 42962 - protein, 115 aa, Panicum virgatum
  misc_feature: Ceres CLONE 2014438
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIISTVAGMAYFIAADTKILSLARRHSFEEAPDHLKNTSYQGAGRPHPAFFRP

SEQ ID NO: 42963 - DNA, 669 bp, Panicum virgatum
  misc_feature: Ceres CLONE 2014440
  misc_feature: Encodes the peptide sequence at SEQ ID NO. 42964
tttttcctttctggagcagttccgtttctggagctgctctgtgctctcacttctttcgtcttcctctcggccacccttggaattggaagacgacctcacgcggggcttcgaatattccttgtcttctctcctcggtttggcaccaacaccgcccttcggctccagtacgcgtcctccactcctcccatctcaggaaatcgccgttgcagcaagcggagctggaggaagcggaggggctcgcgatggggtccgagggaccgtcggcaacggtcgtcgttcccagaaacttcaggctgctagaagaactagaacgtggtgagaagggcattggtgatggaacagtgagctatgggatggatgatgctgatgacatttatatgcggtcctggacaggaactatcattggccctcccaatactgttcacgagggacgaatctatcaattaaagcttttctgtgatacagattatccagataaagcaccaactgttcgatttcagactcgaatcaatatgacatgtgtgaacaaagaaactggattggttgaaccaagtctatttcctatgcttggaaactggcaaagggaacatacaatggaggacatcctaaccagcttaaaaagggagatgtcaactcctcagaatcgcaggctgcaccagcctcaagaag

SEQ ID NO: 42964 - protein, 142 aa, Panicum virgatum
  misc_feature: Ceres CLONE 2014440
  misc_feature (17)..(139): Pfam Name: UQ_con Pfam Description: Ubiquitin-conjugating enzyme
  misc_feature: SWISSPROT Homolog: EC 6.3.2.19 Ubiquitin--protein ligase
MGSEGPSATVVVPRNFRLLEELERGEKGIGDGTVSYGMDDADDIYMRSWTGTIIGPPNTVHEGRIYQLKLFCDTDYPDKAPTVRFQTRINMTCVNKETGLVEPSLFPMLGNWQREHTMEDILTSLKREMSTPQNRRLHQPQE

SEQ ID NO: 42965 - DNA, 705 bp, Panicum virgatum
  misc_feature: Ceres CLONE 2014455
  misc_feature: Encodes the peptide sequence at SEQ ID NO. 42966
gaaaaccgtcaccgaacaaaccccaccgccgccgtgcccccgccccccgagcccggaaaccacccgcccgcccgccatggcgttccggctgagcaaggatgggaaaaaggccaagaaggctgaggagaagccagatatcatgtatgcaaacgttgttgttgacccaaaggaggcgaggcgcaggaagaagagaaggattaagaacaagaagaaggagctgcagcgggctaagcggttgcaggaggcgaagcaggatcctgagaaggcgaacaagatcgcgtgggatacagcaagaagacgggctgctggggagaaggtgcatgatgaccccaagttgattaaggagagcttgaagaaggaggaaaagcggcagcagaagcatgctgctcagtggaaggagaggcagaagactgtggacaagcagaggaaggagaagcagaagaaaaggacagagaacatccgggagcgggcaaaccagaagaagatgcgcaagattgagaagcgtgagaaaaagcttatgcgccctggatttgagggacgcaaggatggttatgtcaacgagtaacatctatgtccaaggctgtccaggaagtagtttaccatgttttctacttttctttcagagtatcatttgctgatatgggtagttggtgcttgtaataggctaccaattcatggctgctaaaatgccttagctattgcacg

SEQ ID NO: 42966 - protein, 162 aa, Panicum virgatum
  misc_feature: Ceres CLONE 2014455
  misc_feature (1)..(148): Pfam Name: SURF6 Pfam Description: Surfeit locus protein 6
MAFRLSKDGKKAKKAEEKPDIMYANVVVDPKEARRRKKRRIKNKKKELQRAKRLQEAKQDPEKANKIAWDTARRRAAGEKVHDDPKLIKESLKKEEKRQQKHAAQWKERQKTVDKQRKEKQKKRTENIRERANQKKMRKIEKREKKLMRPGFEGRKDGYVNE

SEQ ID NO: 42967 - DNA, 714 bp, Panicum virgatum
  misc_feature: Ceres CLONE 2014456
  misc_feature: Encodes the peptide sequence at SEQ ID NO. 42968
ctcttccacctcggcctccactccctgccgccgccgccccgccgctgcgccgcgagccgatccaatggcgccgtcgtctaagctgtcactgggcatcaagaaggcctcgcggtcccactcctaccaccgccgcgggctgtgggcgctcaagtccaagcacggcggcgccttccccaaggcggagaagcccgccgctgccgccgagctcaagttctaccccgccgatgacgtgaaaccgcgcaagcccagcacccgcaagccgaaacccaccaagctcagctactttgccagggaaaagaagaagaaggcaaagaagatcgagggtgaacttttcgagaaagaggaggcgactgaggacctgccgcagttcaagaaggatgaccagaaggctctggatgctgcgctgatcaaagctattgaggccgtgccagatctgaaaacctaccttggtgcacggttctctctcagggatggtgataagccacatgagatggttttctagattagttggcgctaggtgcgaagctcaatagtcactttgcttggtctacctgagcgagctcttgaattttgtatctgaccggtgaacctttggtttctgtttgattcattgtcaaatctttaatgaagtcattgctccttaagttagcattgctttgcacaatactactataatatatgtaagctatcaacaacggggatcctgtcctgacg

SEQ ID NO: 42968 - protein, 145 aa, Panicum virgatum
  misc_feature: Ceres CLONE 2014456
  misc_feature (62)..(145): Pfam Name: Ribosomal_L6e Pfam Description: Ribosomal protein L6e
  misc_feature (1)..(47): Pfam Name: Ribosomal_L6e_N Pfam Description: Ribosomal protein L6, N-terminal domain
  misc_feature: Functional homolog of the protein sequence given in SEQ ID NO 50169
  misc_feature: Useful for making plants with modulated nitrogen use efficiency
MAPSSKLSLGIKKASRSHSYHRRGLWALKSKHGGAFPKAEKPAAAAELKFYPADDVKPRKPSTRKPKPTKLSYFAREKKKKAKKIEGELFEKEEATEDLPQFKKDDQKALDAALIKAIEAVPDLKTYLGARFSLRDGDKPHEMVF

SEQ ID NO: 42969 - DNA, 734 bp, Panicum virgatum
  misc_feature: Ceres CLONE 2014457
  misc_feature: Encodes the peptide sequence at SEQ ID NO. 42970
atctgccgtcgcccgactcgcaccgtagcacacaaccctcacgttccgtacccaaccaccgcctcgttccgccgccgtcgtcgggtggtcgagagaagagatggcgggccgtggcaaagcgatcggcgcgggcgcggcgaagaaggcgacgtcgaggagctccaaggccgggctccagttccccgtcggcaggatcgccaggttcctcaaggccggcaagtacgccgagcgcgtcggcgccggcgcccccgtctacctcgccgccgtcctcgaatacctcgccgctgaggttctcgagctggccgggaacgccgcgagggacaacaagaagacccgtatcgtgccgcgccacatccagcttgccgtccgcaacgatgaggagctctcgcgcctgctgggcacggtgaccatcgcgagcgggggtgtcatgcccaacatccacaacctgctgctccccaagaagtccggtggcggcagcgccaaggctgtggccggcgacgaggactagatccctgactgcaccgtatcacttgtggatgcagcgtatcacttgtgcttgtgtagtagtgtgttctagactcgcctaggtgttgccttcttgtagggaggttgtatgtgtgtgccctgtaccgatgctaaacctagttcactcttgtgttcgctaaggattagttatttctgtatttgctgccatatctctataaaagatgcatcgttccgatgacttgttaatc

SEQ ID NO: 42970 - protein, 135 aa, Panicum virgatum; identical to SEQ ID NO: 34322
  misc_feature: Ceres CLONE 2014457
  misc_feature (19)..(92): Pfam Name: Histone Pfam Description: Core histone H2A/H2B/H3/H4

SEQ ID NO: 42971 - DNA, 929 bp, Panicum virgatum
  misc_feature: Ceres CLONE 2014462
  misc_feature: Encodes the peptide sequence at SEQ ID NO. 42972
atggatccagattgatcgatgagacaatgaggcttcgaccatatctcttccgatcctgcccgcgcgatctgcagtcacaacagcgctgccacgccaaaccacccacacgagcgcgcatggcgcctccggcggccctgcagaacgccaagcgctacaccctggcggccctcgcggcgacgctcgccgtggcggccgtcgtcaccgtcgcttccgtcgtgctgcgcccggcgcgcgtcaccttctccgtcgcccgcacgggcttccgccgcacgcccggcggcggcctgctcctcaacctcaccctcgccgccgacaaccgcagccggcacgcggcggtggcgtacaggagcatgttcgtcgacgtgggcaacagcacgacggcgccgccgcggggcagctgggtccgggccacggtggccgcgcccatgccgctgcggcagccgggccgcagcgccgtggccgtcgccgcgacggtggacctggtgggcgcggccctcgccgcggccttcacgggcaacatgaccgccagcctcgccgtgatgctcaccgcgcaggcgaagttcagggtcggcgtcgcgtggacgaggctctacgacatcaaggtctcctgcgggccagtcagcttcttccccgcgccccccggcgccggcgccggcggcgcggcgagactgccggtctactgcgtctaggtagctggcgtgcgcggcggcgcatcccttccaggatcaattccaattccggtgtacgatttggctgcggttttcctcgtttcaaaagatttgaggtcttctctgttaaatttctgccagtttgtacaactaattatgatccgatgtgcaatggaagagttacttaatgattgtgctcgttttatttgtgaatgcaaaataaataattatgatccggcatttggtcgttgttgggcctgc

SEQ ID NO: 42972 - protein, 190 aa, Panicum virgatum
  misc_feature: Ceres CLONE 2014462
  misc_feature (32)..(165): Pfam Name: Hin1 Pfam Description: Harpin-induced protein 1 (Hin1)
MAPPAALQNAKRYTLAALAATLAVAAVVTVASVVLRPARVTFSVARTGFRRTPGGGLLLNLTLAADNRSRHAAVAYRSMFVDVGNSTTAPPRGSWVRATVAAPMPLRQPGRSAVAVAATVDLVGAALAAAFTGNMTASLAVMLTAQAKFRVGVAWTRLYDIKVSCGPVSFFPAPPGAGAGGAARLPVYCV

SEQ ID NO: 42973 - DNA, 702 bp, Panicum virgatum
  misc_feature: Ceres CLONE 2014463
  misc_feature: Encodes the peptide sequence at SEQ ID NO. 42974
atttacataattacagaatgcatgtctagaggaagtctgtttgatttcttgcacaacgagcataatgtcttggacctcccaacaattctgaagttcgcattagatatatgcagagggatgtcctacttgcatcagaagggcatcatccacagagatttaaagtctgccaaccttttactgggcaaagaccatgtatgtgcacaacttctatcaagtttgttgagaggaattatatgcatcttcctgctggtggatgtagtcatgtggaagatatttaatggctcagattgtattgtctgtttcgtagcccatgttagagccatgcttatggatttaaaagaactgaagatgtcaatttataagtcattctattgctcatttttctaggttgtgagagtggcagattttggtctagcccgtttccaggatgaagggggtgctatgacagctgaaactgggacctatcgatggatggcgcctgaggttatcaatcatcagccctatgataacaaagaagatgtctacagttttgctattgtactttcggaactcatgacatccaagattccatatactaccatgagccccctccaggcagctgttggtgtgaggcagggattgcggccacaagttccagaaaatgcacatcccagactcctaatcttgatgcagagatgttgggaagcccttccatctaacccg

SEQ ID NO: 42974 - protein, 128 aa, Panicum virgatum
  misc_feature: Ceres CLONE 2014463
  misc_feature: SWISSPROT Homolog: EC 2.7.10.2 Non-specific protein-tyrosine kinase
IYIITECMSRGSLFDFLHNEHNVLDLPTILKFALDICRGMSYLHQKGIIHRDLKSANLLLGKDHVCAQLLSSLLRGIICIFLLVDVVMWKIFNGSDCIVCFVAHVRAMLMDLKELKMSIYKSFYCSFF

SEQ ID NO: 42975 - DNA, 701 bp, Panicum virgatum
  misc_feature: Ceres CLONE 2014464
  misc_feature: Encodes the peptide sequence at SEQ ID NO. 42976
cctacagctacaaatagccaacctcgaatcgaatcgaatcgccattccgtccgccgcccattcgtgttccagtttccaatcccccagatcctccgacctccccgcgcagccgtcgaatcatggcccgcacaaagcagacggcgcgcaagtcgaccggcggcaaggcgccgaggaagcagctggccaccaaggccgcgcgcaagtcggcgccggccaccggcggcgtgaagaagccgcaccgcttccgccccggcaccgtcgcgctccgggagatccgcaagtaccagaagagcacggagctgctgatccggaagctccccttccagcgcctcgtccgggagatcgcgcaggacttcaagacggacctccggttccagtcctccgccgtcgccgcgctgcaggaggccgcggaggcctacctcgtcgggctcttcgaggacaccaacctgtgcgccatccacgccaagcgcgtcaccatcatgcccaaggacatccagctcgcgcgccgcatcaggggcgagagggcctgagcgagcgatggtgctcttcgtcagcgttctttcgatttctctggcctgtcgccttgctagtctgctctgctacaactggacggggaatcgtttcttgccggcctggttggtgtatcttggtagtgctctggatgttggcctcactcgaattaaatggaaaaatgatctgtg

SEQ ID NO: 42976 - protein, 136 aa, Panicum virgatum; identical to SEQ ID NO: 10238
  misc_feature: Ceres CLONE 2014464
  misc_feature (58)..(132): Pfam Name: Histone Pfam Description: Core histone H2A/H2B/H3/H4

SEQ ID NO: 42977 - DNA, 530 bp, Panicum virgatum
  misc_feature: Ceres CLONE 2014465
  misc_feature: Encodes the peptide sequence at SEQ ID NO. 42978
ggttctttccccaaccgccagccacgctcacgcaacggcgcagccatggcggacggagccgacgccgcctccagctgcgaggtggacctcggcaaccttatggcgtacgatccgtcgcaccacgtcgccgccgccgccgcctccagggaggacctgaggcaggagtgcctgctaaaggcgacggagctggcgcaagcggtggccaactcccttttcgcgctgccgcccagcgaggaccgcgacggcccaatcgtccacctcccgccgccaaccatccgacttccgcgcgagaagcatctaccgaagccaaagccacccaccaagtgggagctctttgcaaaggcgaaagggattaccaagcacaagaagaacaagcgcgaatgggacgagcaaactcaatcctggaaacggacttacggctatgaccgtgttaatgatgacaaagatgttccgatcattgatgccaaatccactgacgagcctggtgtcgatccttttgcacaaagaaggcaagagaagaagaagcgtgt

SEQ ID NO: 42978 - protein, 161 aa, Panicum virgatum
  misc_feature: Ceres CLONE 2014465
  misc_feature (1)..(161): Pfam Name: RRS1 Pfam Description: Ribosome biogenesis regulatory protein (RRS1)
MADGADAASSCEVDLGNLMAYDPSHHVAAAAASREDLRQECLLKATELAQAVANSLFALPPSEDRDGPIVHLPPPTIRLPREKHLPKPKPPTKWELFAKAKGITKHKKNKREWDEQTQSWKRTYGYDRVNDDKDVPIIDAKSTDEPGVDPFAQRRQEKKKR

SEQ ID NO: 42979 - DNA, 767 bp, Panicum virgatum
  misc_feature: Ceres CLONE 2014474
  misc_feature: Encodes the peptide sequence at SEQ ID NO. 42980
gatccacgcccctcccccccccttcctccctccgccgcccctctcctctcgctctccgattcgatgctctcctcccgtctcccatgatctgaggtctccgacggagtagcaccgagactattcagaagctgacaagccatccaagaattcaggcacaggacgccagcagcaagacgacgaagcggagctaaagggggaaggagaggagagagcgcatccggttccgtcatggagggcggcgagacgacgctgtcggggttcggcggcggcggcggcgcgggggccggcgtggacactaaggtgctgcacgcgttccagacgagcttcgtgcaggtgcagagcctgctggaccagaaccgcgtcctcatcaacgagatcaaccagaaccacgagtccaaggtgcccggcgacctctcccgcaacgtcggcctcatccgggagctcaacaacaacatccgccgcgtcgtcgacctctacgccgacctctcctcgctcttcgccgcctccgacggcggcggccgcgcggcctccgagggcggatccgtcggcaccgtccggcaggccggcgccggccacaagcggatcaggtccggcctcgactgacgacttcatcatctctcatagcctcatagctagctagccagggaccgacctccttcttcctctctctcctctccctctttgacttgagctgttcttgtatctatcgacatatctacctaccttatctactatctccattacgactgctactcttacatatgagc

SEQ ID NO: 42980 - protein, 124 aa, Panicum virgatum
  misc_feature: Ceres CLONE 2014474
  misc_feature: Functional homolog of the protein sequence given in SEQ ID NO 50381
  misc_feature: Useful for making plants with altered lignin content
MEGGETTLSGFGGGGGAGAGVDTKVLHAFQTSFVQVQSLLDQNRVLINEINQNHESKVPGDLSRNVGLIRELNNNIRRVVDLYADLSSLFAASDGGGRAASEGGSVGTVRQAGAGHKRIRSGLD

SEQ ID NO: 42981 - DNA, 677 bp, Panicum virgatum
  misc_feature: Ceres CLONE 2014488
  misc_feature: Encodes the peptide sequence at SEQ ID NO. 42982
aaaatccatctgcttccggcttccgcaaccacctccgctgcccagcgaaacccaaattccccagtcccagaatccccaagcagctgcgtcgatggcccccaaggcggagaagaagccggcggcgaagaagcccgcggaggaggagctggccaccgagaaggcggagaaggccccggcggggaagaagcccaaggcggagaagcggctgcctgccggcaagtccgccggcaaggagggcggcgagagcaagaggggaaggaagaaggggaagaagtcggtggagacctacaagatctacatcttcaaggtcctcaagcaggtccaccccgacatcggcatctcctccaaggccatgtccatcatgaactccttcatcaacgacatcttcgagaagctcgccgccgaggccgccaagctcgcccgctacaataagaagcccaccatcacctcccgcgagatccagacctccgtccgcctcgtcctccccggcgagctcgccaagcacgccgtctccgagggcaccaaggccgttaccaagttcacctcgtcttaggcgctaggcttcccctgtggtcgtggttatgatgctcctgttagtagtttcggatggtgtagttagatgttggtggttgctgaccttgtctttctgtatgaagttgctatctgatggaatggac

SEQ ID NO: 42982 - protein, 153 aa, Panicum virgatum
  misc_feature: Ceres CLONE 2014488
  misc_feature (60)..(130): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAAKKPAEEELATEKAEKAPAGKKPKAEKRLPAGKSAGKEGGESKRGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 42983 - DNA, 835 bp, Panicum virgatum
  misc_feature: Ceres CLONE 2014490
  misc_feature: Encodes the peptide sequence at SEQ ID NO. 42984
ctcttttcttttcttcgggtgggatgggtcgtgttattcgagcgcagaggaagggtgctggaggtatcttcaaatcccacaccaagcaccgaaagggcgcccccaagcatcgcccccttgatttctccgaacgtcatgggtacatgaagggcgttgtcaaggaaatcatccacgaccctggtcgcggtgcccctctcgccaaggttcagttccgtcatccttaccaatacaaaaaggaccatcaactcttcgttgccactgagggcatgtacaccggccaatttgtctactgcggaaagaaggccgaattgactgtcggaaacgttttgcctttgggtaaaatccctgagggtactttggtttgcaacgtcgaggagaaagttggggatcgtggtgctttggctcgtacctctggaaactacgccactgtcgtcagccacaacagcgagactggcaagacccgtatccgtctcccctctggtgccaagaaagttgtgaactccaatggacgcgccatgattggtattgttgccggtggtggtcgtaccgagaagcccttgttgaaggccggccgtgcttattacaaatacaagtccaagaggaactcatggcccaaggtgcgaggtgttgctatgaaccctgtagagcatccccacggtggtggtaaccatcaacacatcggtcatgcatcaactgtcaaacgtgatgcccctgccggtcagaaggtcggccttattgctgctcgtcgtactggtcgtctgcgaggtagcgccggagtcgcgaagaagcttttggctgcggctgagtaaacaaaataaatatatcataataaatc

SEQ ID NO: 42984 - protein, 261 aa, Panicum virgatum
  misc_feature: Ceres CLONE 2014490
  misc_feature (96)..(231): Pfam Name: Ribosomal_L2_C Pfam Description: Ribosomal Proteins L2, C-terminal domain
  misc_feature (11)..(90): Pfam Name: Ribosomal_L2 Pfam Description: Ribosomal Proteins L2, RNA binding domain
  misc_feature: Functional homolog of the protein sequence given in SEQ ID NO 51015
  misc_feature: Useful for making plants with modulated nitrogen use efficiency
MGRVIRAQRKGAGGIFKSHTKHRKGAPKHRPLDFSERHGYMKGVVKEIIHDPGRGAPLAKVQFRHPYQYKKDHQLFVATEGMYTGQFVYCGKKAELTVGNVLPLGKIPEGTLVCNVEEKVGDRGALARTSGNYATVVSHNSETGKTRIRLPSGAKKVVNSNGRAMIGIVAGGGRTEKPLLKAGRAYYKYKSKRNSWPKVRGVAMNPVEHPHGGGNHQHIGHASTVKRDAPAGQKVGLIAARRTGRLRGSAGVAKKLLAAAE

SEQ ID NO: 42985 - DNA, 674 bp, Panicum virgatum
  misc_feature: Ceres CLONE 2014508
  misc_feature: Encodes the peptide sequence at SEQ ID NO. 42986
gccactcgctcctgccccccgcgcctctctccgctcccaactcgcgtctcgatccctcctccgatctctcttctctcgggctgccaaaccattcttcttgctagctgggcccaatgtgattgaatcggaggagcatgtcctgaagatggccaaacacattaaaggcatcacaaccaagcttgggatcccacttgtgttcaaatctagcttcgataaagcaaatcgtacatcatcaaaatctttccgtggccctggtctggaagaaggcctgaagatccttgaaaaggtgaaagcaacatatgaccttccagttgtcactgatgtgcatgaaagccaccagtgtgaagctgttggaaaagttgctgacattatacaaattccagctttcctctgtcgccagactgatcttctcgtggctgctgctaagactggaaaaattatcaatatcaagaaaggacaattctgtgcaccctctgttatggtcaactctgcggagaaaataagacttgctggaaatcctaatgtgatggtctgtgagcgtggtaccatgtttggctacaatgatctaattgttgacccaaggaattttgagtggctgagggaagctaactgcccagttgtagctgatataacacatgctttacaacaaccagctggaagaaagcttgatggtg

SEQ ID NO: 42986 - protein, 224 aa, Panicum virgatum
  misc_feature: Ceres CLONE 2014508
  misc_feature (26)..(224): Pfam Name: DAHP_synth_1 Pfam Description: DAHP synthetase I family
  misc_feature: SWISSPROT Homolog: EC 2.5.1.55 3-deoxy-8-phosphooctulonate synthase
PLAPAPRASLRSQLASRSLLRSLFSRAAKPFFLLAGPNVIESEEHVLKMAKHIKGITTKLGIPLVFKSSFDKANRTSSKSFRGPGLEEGLKILEKVKATYDLPVVTDVHESHQCEAVGKVADIIQIPAFLCRQTDLLVAAAKTGKIINIKKGQFCAPSVMVNSAEKIRLAGNPNVMVCERGTMFGYNDLIVDPRNFEWLREANCPVVADITHALQQPAGRKLDG

SEQ ID NO: 42987 - DNA, 520 bp, Panicum virgatum
  misc_feature: Ceres CLONE 2014509
  misc_feature: Encodes the peptide sequence at SEQ ID NO. 42988
ctggcagcaggcagaccgggccagctcaggcacggagccgctcgccgcctccgccacggcggttaccggcgatgaacggcgggctccctggattccacaatgcgccggcatcgagggccgtggtcgtcgcctccgcgctcttctccgtccccttcggcttccgcggccgcttcctcgacctcggcctttcctaccagaatgtttacgaaaggctgagtatatggaggcttattacctcgttgtttgctttctcatcgacccctgagctgatatttggagccgcgctgctgtactacttcagggtgttcgaaaggcaaataggttcgaacaagtatgctgtcttcattgtattctcaaccatggtgtctgtcctgcttcagatccttgctttaggttacctgaaagatccttctataaatcctcggacgtcaggaccctatggcctcatttttgcatcttatgtgccattcttctttgacattccggtctcaatgaggttccgcatatttcgactgagctt

SEQ ID NO: 42988 - protein, 149 aa, Panicum virgatum
  misc_feature: Ceres CLONE 2014509
  misc_feature: SWISSPROT Homolog: EC 3.4.21.105 Rhomboid protease
MNGGLPGFHNAPASRAVVVASALFSVPFGFRGRFLDLGLSYQNVYERLSIWRLITSLFAFSSTPELIFGAALLYYFRVFERQIGSNKYAVFIVFSTMVSVLLQILALGYLKDPSINPRTSGPYGLIFASYVPFFFDIPVSMRFRIFRLS

SEQ ID NO: 42989 - DNA, 676 bp, Panicum virgatum
  misc_feature: Ceres CLONE 2014520
  misc_feature: Encodes the peptide sequence at SEQ ID NO. 42990
accacatctccctcctcatccctgagctctgagcagcagcagtctcctgtgattagctcgtgtgggagagaaaggcgcgcaggtgaagaaagatgccgatcaggaacatcgccgtggggaacacccaggaggtgtaccacccgggtgccctcaaggcggcgctcgctgagttcatctccaccctcatcttcgtcttcgccggccagggctccggcatggccttcagcaagctgagcggcggcggttcgacccctgccggcctgatatccgctgcgattgcccacgccttcgccctgttcgttgccgtttccgtgggcgccaacatctccggcggtcacgtgaaccctgccgtgaccttcggcgccttcctcggcggcaacatcaccctgttccgcggcatcctgtactggatcgcccagctgctgggctcgaccgtggcgtgcctcctgctgcgcttctccaccggcggtctccccaccggcaccttcggcctgaccggcgtgtccgtgtgggaggctgtggtcctcgagatcgtgatgaccttcgggctggtgtacacagtgtacgccaccgccgtggacccgaagaagggcagcctgggcaccatcgcccccatcgccatcggcttcatcgtgggcgccaacatcctggtcggcggcgccttcgacggcgcgtc

SEQ ID NO: 42990 - protein, 194 aa, Panicum virgatum
  misc_feature: Ceres CLONE 2014520
  misc_feature (13)..(194): Pfam Name: MIP Pfam Description: Major intrinsic protein
MPIRNIAVGNTQEVYHPGALKAALAEFISTLIFVFAGQGSGMAFSKLSGGGSTPAGLISAAIAHAFALFVAVSVGANISGGHVNPAVTFGAFLGGNITLFRGILYWIAQLLGSTVACLLLRFSTGGLPTGTFGLTGVSVWEAVVLEIVMTFGLVYTVYATAVDPKKGSLGTIAPIAIGFIVGANILVGGAFDGA

SEQ ID NO: 42991 - DNA, 1150 bp, Panicum virgatum
  misc_feature: Ceres CLONE 2014536
  misc_feature: Encodes the peptide sequence at SEQ ID NO. 42992
atcgtcctcgcttccttctcaatccccagcagcagcagcagctcccctctcctctcctctcccacaaccctaccctccgcgagcgagcgagctccgggtggccggccaatggacggaggaggcggatttatgggcccaccgccggtcccccgctcgccggaggacgtcttccgggatttccgcgcgcgccgggccggcctgatcagggcgctcaccaccgatgtggagaagttctacgtgatgtgcgacccagagaaggagaacctatgtttgtatggacttcccaatgagacatgggaagtcaacttgcctgcagaggaggtccctcctgaactcccagagccagctctgggaattaactttgcacgtgatgggatgaatgaaaaagattggctgtcacttgttgccgtgcatagtgactcttggttattgtcagttgcattttattttggagcaaggtttggtttcgacaaagaatccaggaaacggctcttcaccatgatcaataaccttcccacagtatatgaggttgtcacaggaacagccaagaaagagcccaaagacaaaacccctaaaaacagcaataagagtaacaaaactggctcgaagccacaccaatcagaacccaactcaagggccccgaagctgccacctccaaaggaagaagagagtgaaggggaggatggggaaccacaggaagaccatgagagcacgctgtgcggcgcatgcggccaaagttacgatgacttctggatctgctgtgacctgtgtgagaaatggttccatggcaagtgcgtgaagatcaccccagccaaagcggaacacatcaagcagtacaagtgcccctcctgcacaggcagcaagagggctaaggcttgagtctaggaaacccgaattgccaacaatgctctaaggagccttgtcgagttgtaagctaaagttctcaggttagggcagctatagattcgaataccttgtccggatattgtcggcgttgatgcttgaggatccatctaaatttagtgtcagtactatgattactgactgactgctgtagtgtgtgtgtggcctcaagcatctatgctctgtagtctactgaattgtgtgttttagattccaactatgccatgtttgatcattttgtcgtttt

SEQ ID NO: 42992 - protein, 256 aa, Panicum virgatum
  misc_feature: Ceres CLONE 2014536
  misc_feature (203)..(251): Pfam Name: PHD Pfam Description: PHD-finger
  misc_feature: SWISSPROT Homolog: EC 1.14.11.27 [Histone H3]-lysine-36 demethylase
  misc_feature: Functional homolog of the protein sequence given in SEQ ID NO 50174
  misc_feature: Useful for making plants with altered alkaloid content
  misc_feature: The sequence is a functional homolog of SEQ ID NO 1981 in the 11/479,226 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50175
  misc_feature: Useful for making plants with altered lignin content
  misc_feature: Useful for making plants with modulated flowering time
MDGGGGFMGPPPVPRSPEDVFRDFRARRAGLIRALTTDVEKFYVMCDPEKENLCLYGLPNETWEVNLPAEEVPPELPEPALGINFARDGMNEKDWLSLVAVHSDSWLLSVAFYFGARFGFDKESRKRLFTMINNLPTVYEVVTGTAKKEPKDKTPKNSNKSNKTGSKPHQSEPNSRAPKLPPPKEEESEGEDGEPQEDHESTLCGACGQSYDDFWICCDLCEKWFHGKCVKITPAKAEHIKQYKCPSCTGSKRAKA

SEQ ID NO: 42993 - DNA, 942 bp, Panicum virgatum
  misc_feature: Ceres CLONE 2014540
  misc_feature: Encodes the peptide sequence at SEQ ID NO. 42994
aaataattgaattatttcgtataagagcgcttcaaaatggatccaaaccctcagcagcccaaaaagtttaaagtcatgcttatcggagatgttagtgtcggcaagaccagtttcctgaccagatatatcagagatgtcgtcaaaaagactgaaatgcccactatcggtgttgagtatacaaccactaatctcgttttgaaggatagcaccactgccaaggtcgtcttatgggatactgctgggtccgagaaatacgtgtctctcacaactgcacattacagagaatctcacggagcactcctgtttttcgatttgactgacagagcaactttcgatcacgtttctttctggttgagtaaaatcgcagaccacgctgaagaagacaccattgttatgcttatcggaaacaaatgcgatctcgtgaacgatgaccccagcgcaagaaaagtcagcgagcacgaagccagagaatttgctcaaaaatacgggctcatgtataacgaaacctctgccaaaacaggagcaaacgtaaaggaggctttcaacgatctcatcgaagcaatccacggatctcagaaggacaactcctcaagagacacaaaggaaaagcaaaaggaaagaaatttgaaaataaagattgagaaaaattttggaaaatccgatgatgatgatgagcacatggaaagcatccaccccaacagatgctgttgctaataattgagaatagaattgatagatagagagagacaatttaggaattggatctagctagatagatagataaaatgtattcactcatttggtttttttataacagtgcgatattactgccagctaacgcctgatgtataagcaaagcaatcttcattcgtaattttatactgatttgatatattgatattattcgctcataaaaaagaacctcatcagcttttaattcag

SEQ ID NO: 42994 - protein, 225 aa, Panicum virgatum
  misc_feature: Ceres CLONE 2014540
  misc_feature (12)..(178): Pfam Name: Ras Pfam Description: Ras family
  misc_feature (12)..(127): Pfam Name: Miro Pfam Description: Miro-like protein
  misc_feature: SWISSPROT Homolog: EC 2.7.11.1 Non-specific serine/threonine protein kinase
MDPNPQQPKKFKVMLIGDVSVGKTSFLTRYIRDVVKKTEMPTIGVEYTTTNLVLKDSTTAKVVLWDTAGSEKYVSLTTAHYRESHGALLFFDLTDRATFDHVSFWLSKIADHAEEDTIVMLIGNKCDLVNDDPSARKVSEHEAREFAQKYGLMYNETSAKTGANVKEAFNDLIEAIHGSQKDNSSRDTKEKQKERNLKIKIEKNFGKSDDDDEHMESIHPNRCCC

SEQ ID NO: 42995 - DNA, 684 bp, Panicum virgatum
  misc_feature: Ceres CLONE 2014548
  misc_feature: Encodes the peptide sequence at SEQ ID NO. 42996
ccccgcaaagaaagaaacgagcagcagcagcgacgctggcgagcggcggcatgaagagggagatcagcgagacccacgacgccctccgcttcggcatcaacgccggcgtcaaggccgacctcgctccgccgcacccgctccagtccaccatccagtcggaggccaaattctgggcggacaagaaaaagttcgggacggaggcaatctacggatccgccttcaacatccgcaaggatctcgatgcccaaatcctctccaggttccaaaggccccctggtgctttgccatcatctatgcttggatatgaggcactgacaggttccctggatgattttggatttgaagattatcttaacatgcctcaagattctgacagtttccgtcaacctgacttgcaccatggaatggaggttcgccttggcttgtccaagggacctatctgcccttgcttcaattgatccatccatgtagttctgcagtacgttgtgcacctcagtccagtgcgtcggtcaatagaccatattatcatagtgaaaagtgaaaagtgaaaaccgacgaggctagcacctgttcaatgttcagtgtcatgtttcagtcaacacagaatttagttcttatccctatttgagcacacatttgatggttggtctgcctctctgaatctacgtgttccagcttgctgac

SEQ ID NO: 42996 - protein, 151 aa, Panicum virgatum
  misc_feature: Ceres CLONE 2014548
  misc_feature (4)..(142): Pfam Name: UMP1 Pfam Description: Proteasome maturation factor UMP1
PQRKKRAAAATLASGGMKREISETHDALRFGINAGVKADLAPPHPLQSTIQSEAKFWADKKKFGTEAIYGSAFNIRKDLDAQILSRFQRPPGALPSSMLGYEALTGSLDDFGFEDYLNMPQDSDSFRQPDLHHGMEVRLGLSKGPICPCFN

SEQ ID NO: 42997 - DNA, 683 bp, Panicum virgatum
  misc_feature: Ceres CLONE 2014549
  misc_feature: Encodes the peptide sequence at SEQ ID NO. 42998
ctccagccgcaccccgcctcgccgtcccgctcggtcccgcttcgccgcgccgccgccgcagccgccaaaatgccgttcaagaggttcgtggagatcggacgggtggccctggtgaactacggcaaggactacggccgcctcgtcgtcatcgtcgacgtcgtcgaccagaacagggcacttgtggatgcccccgacatggtccgctgccagatgaacttcaagcggctttccctgactgacatcaagattgacattaaacgtgtcccaaagaagactacattgattaaggccatggaggaagctgatgtgaaaaacaagtgggagaagagctcatggggcaagaagctgattgtccagaagaggagagcatcactcaatgacttcgacaggttcaaggtcatgttggcaaagatcaagaggggtggtgctatcagacaggagcttgctaagcttaaaaaggaggttgctgctgcttagattgctttggtggtttagattttgtttgtctatgtttcgatatctgaaaaaggaacatgtacaatgtgcgaattacttttacggtttatcagagcttgtcaaaatggtaatttcaaacatggcttgtttagaaattttgcccagattactttttctgaatatgagatagtttgacaatatgaagatatatggtgtctactgtttct

SEQ ID NO: 42998 - protein, 135 aa, Panicum virgatum; identical to SEQ ID NO: 26916
  misc_feature: Ceres CLONE 2014549
  misc_feature (44)..(120): Pfam Name: Ribosomal_L14e Pfam Description: Ribosomal protein L14

SEQ ID NO: 42999 - DNA, 662 bp, Panicum virgatum
  misc_feature: Ceres CLONE 2014552
  misc_feature: Encodes the peptide sequence at SEQ ID NO. 43000
actctctctctctctctctctctctctctcacacacacacacacacacacacacacacacgagtcaaagaggagaagagcagatctacatctgctccaccgatgagcgcttctcggttcatcaagtgcgtcaccgtgggggacggcgccgtcggcaagacctgcatgcttatctcctacacctccaacactttccccaccgattatgttccaactgtgttcgacaacttcagtgccaatgttgtggttgacggaagcaccatcaacttgggtctgtgggacacagcaggacaagaggactacaatagactgcgcccgttgagctatcgtggtgctgatgtttttctgctcgccttttctcttatcagcaaagcaagctacgagaatgtatcaaagaagtggattcctgaattaaggcactatgctcctggcgtgcctataattcttgtcgggaccaagcttgatctgcgggatgataagcagttttttgttgatcaccctggtgctgttcctatctctactgcccagggtgaagagctgaggaagctaattggtgcagctgcctacatcgaatgcagttcaaaaacccaacaagtagtgcagttcttttctttccctgcagaagatgcatcattgagctcacttgctgtgcatgcttactga

SEQ ID NO: 43000 - protein, 186 aa, Panicum virgatum
  misc_feature: Ceres CLONE 2014552
  misc_feature (8)..(178): Pfam Name: Ras Pfam Description: Ras family
  misc_feature (8)..(121): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50617
  misc_feature: Useful for making plants with modulated nitrogen use efficiency
MSASRFIKCVTVGDGAVGKTCMLISYTSNTFPTDYVPTVFDNFSANVVVDGSTINLGLWDTAGQEDYNRLRPLSYRGADVFLLAFSLISKASYENVSKKWIPELRHYAPGVPIILVGTKLDLRDDKQFFVDHPGAVPISTAQGEELRKLIGAAAYIECSSKTQQVVQFFSFPAEDASLSSLAVHAY

SEQ ID NO: 43001 - DNA, 1116 bp, Panicum virgatum
  misc_feature: Ceres CLONE 2014559
  misc_feature: Encodes the peptide sequence at SEQ ID NO. 43002
aggggcagcaacagccagccaacaaaggctactggaattttttggttgggaaaatctcggaggaggagctcatggcatggatcgtccgtcctgctgtctgattcgattccgctagctgttccgcgctctccaagcctccaggtccattcgattcgactcgattccccttccccgcctcctggctgctcttctacggcccgggccgcggctacaccgcgctctccctcgcctccgacatgctcctgcacctcctcaccgtgctcttcctctggggcaaggccgcgcgcctcctcaacaggccgacgccccccgtcccggcgatgcgcgtctcgcagcgggccgtggacgaggcggcggccctgctgcgcgccgccctcgacgccgtctgctccggcttccatgacatcgccacgggcggggactcgctcctcttctgccgggtcttcctctgcctgtgggccctctccatcgtcggcagcctcaccgatttccccaccttctgctacgcgagcatcgtggctgctctgacgctcccggcattgtaccagaaataccaagattgtgtggacacatacatgaggtttgcctacatgaacctgcgcatgtacgagatggtgtacgagaggttctccatgaaatgcttcatcagggtcagggattgcgtcacggaggtcctcaaggatccatgaccagccttccaccggctaccgccattgcatcgcttgcttccacagggattggatttggtttctcctctatagttttctttgattgagcatagcatagccctgttagcacaggagtgggaaatatagaaagaaatgagtagttctgattggttctgatgattatttgtttgcttgccccgagtggtgtgctggttgctttgagcttcagctgttgttcagctaggagcagtctagcgtgacgcgtgcaaatggctgcaggctgcaggctgcagctggtccagtttggtgctcagcacagccacgatcgcatgtagttttgtgtgcgcgcctgttgttcccaggctgctttcatgtagctgttgagtttgtacacaaagacaaactcactgtaaacattttgcttatatctccatgaatgaattgaact

SEQ ID NO: 43002 - protein, 150 aa, Panicum virgatum
  misc_feature: Ceres CLONE 2014559
  misc_feature (1)..(149): Pfam Name: Reticulon Pfam Description: Reticulon
MLLHLLTVLFLWGKAARLLNRPTPPVPAMRVSQRAVDEAAALLRAALDAVCSGFHDIATGGDSLLFCRVFLCLWALSIVGSLTDFPTFCYASIVAALTLPALYQKYQDCVDTYMRFAYMNLRMYEMVYERFSMKCFIRVRDCVTEVLKDP

SEQ ID NO: 43003 - DNA, 689 bp, Panicum virgatum
  misc_feature: Ceres CLONE 2014560
  misc_feature: Encodes the peptide sequence at SEQ ID NO. 43004
aatcgaaagcgacggatatggtgtagcatgaacgcctcctacggtctcacgccggcattccttgtcggctcgccgagcgtgagccctttcctggcaatgatgctcaacgctgccttcgtgtccccgttcctcggcctcggcgcatggctccagcagggggagcagctgccggagcagccgtcgtcccttttcgagatggcgcacgggaagaagccgtgggacttggccagccgcgacccggccttcggctcgctcttcaacgacggcatggtcgccgacagcggcttcatcatggacatcgtcgtcaaggagtgcggcgaagtcttccgagggctgacctcgctggtcgacgtcgccgcccaagccatctctaaggcgttccccagcatcaagtgcagcgtgctggatctcccgcacatcgtggccgatgctcctgccggcaccgacgtcaagtacatcgccggtgacatgttcgagagcattccgcccggaaacgctatctttctcaagtgggttttgcacgattggggtgatgccgagtgtgtcaaaatattaaagaactgcaggaaggctataccatctagagaagagggcgggaaggtgataatactggatatggtggttggagcaggatcatctgacctaaagcataaagagacgcaggtcctgttcgatctcttcatcatggt

SEQ ID NO: 43004 - protein, 229 aa, Panicum virgatum
  misc_feature: Ceres CLONE 2014560
  misc_feature (10)..(228): Pfam Name: Methyltransf_2 Pfam Description: O-methyltransferase
  misc_feature: SWISSPROT Homolog: EC 2.1.1.128 (RS)-norcoclaurine 6-O-methyltransferase
NRKRRIWCSMNASYGLTPAFLVGSPSVSPFLAMMLNAAFVSPFLGLGAWLQQGEQLPEQPSSLFEMAHGKKPWDLASRDPAFGSLFNDGMVADSGFIMDIVVKECGEVFRGLTSLVDVAAQAISKAFPSIKCSVLDLPHIVADAPAGTDVKYIAGDMFESIPPGNAIFLKWVLHDWGDAECVKILKNCRKAIPSREEGGKVIILDMVVGAGSSDLKHKETQVLFDLFIM

SEQ ID NO: 43005 - DNA, 1219 bp, Panicum virgatum
  misc_feature: Ceres CLONE 2014578
  misc_feature: Encodes the peptide sequence at SEQ ID NO. 43006
aagtgtacccgcggtcggagccactcgcatggccctggcctccctcgcggcctcgctccccgccgccgccgccgccgccgcgagattccggctacgagtccgcttccgcgccatggcctccgcatccgccgccggtggtgggacggcgagggtgggcgtggtccagatgacctccgtgggggacgtcgacgccaactacgccacctgctcccgcctcaccaaggaagcagctgcttctggcgtgaaattcctctgtttccctgaggccttctcgttcattgggtccaagtatggcgagtctgttaagctagctgaaccgctagatgggccaataatgcagagatattgctcacttgcaaaagaatcaggcatgtggttgtctcttggggggtttcaggagaagggacctgatgattctcaccagtacaatactcatgtcttaattgatgattctggaaacgttaggagctcatatcgaaaaatacatttgtttgatgttgatgtacctggcaatatggtgtacaaggaaagtggtttcacaactgcaggtgatacaattgttgctgcggatagcccttttggacggttggggcttactgtttgctatgatttgagattcccagagctttatcaaattttgcgttttaagcatcaagcacaggtattactagtaccctctgcattcacaaaggtgaccggggaggcacactgggaaattctcctccgtgctcgtgcaattgagacacaatgttatgttatagctgcggcacaagctggaaaacataatgagaaaagacaaagctacggtgactctataattatcgacccatggggagcagtggtagctcgacttccagatcggttctccactggatttacagttgcagatcttgatttgtcaaaagttgaggctgtgagaactcgaatgccaatctcagagcatcggaagttcgacagcgattggaaatcctcaactaagcaatagctgagagctggtctcatatttcctatgtttgtacatttacatttggcatattcctttatatgcacaattgccacaggtttagtgaatagtttgtttgggaccctccagtaggacaatgttgttgaacaaaataagctgcaatatgatggcattgggtcgagatggatatatgagtaaaacactcgtgcaaaatggaaatgtaaaataagctgccatgatgatggcattggctac

SEQ ID NO: 43006 - protein, 318 aa, Panicum virgatum
  misc_feature: Ceres CLONE 2014578
  misc_feature (41)..(218): Pfam Name: CN_hydrolase Pfam Description: Carbon-nitrogen hydrolase
  misc_feature: SWISSPROT Homolog: EC 3.6.1.29 Bis(5'-adenosyl)-triphosphatase
MALASLAASLPAAAAAAARFRLRVRFRAMASASAAGGGTARVGVVQMTSVGDVDANYATCSRLTKEAAASGVKFLCFPEAFSFIGSKYGESVKLAEPLDGPIMQRYCSLAKESGMWLSLGGFQEKGPDDSHQYNTHVLIDDSGNVRSSYRKIHLFDVDVPGNMVYKESGFTTAGDTIVAADSPFGRLGLTVCYDLRFPELYQILRFKHQAQVLLVPSAFTKVTGEAHWEILLRARAIETQCYVIAAAQAGKHNEKRQSYGDSIIIDPWGAVVARLPDRFSTGFTVADLDLSKVEAVRTRMPISEHRKFDSDWKSSTKQ

SEQ ID NO: 43007 - DNA, 1169 bp, Panicum virgatum
  misc_feature: Ceres CLONE 2014580
  misc_feature: Encodes the peptide sequence at SEQ ID NO. 43008
aacacgctgcgcacaatcgagagatcgagatcgagagagtgagagagagatggcccagaaggaggacaccattagccacttctcccacccagggcacgagctcgtgaagcggcactacatcgggccgtcgttcctctgcgacatgtgctgggagcacctgtccggccccggctacggctgcagcgccggctgcgacttcggcatccacgagtcatgcgccggccacccgcagacgcacagctcccaggcgcaccacgcgcacccgctcgtgctcgtccagacccgccgcgacgtcgtggctcacatctgcgacgtctgtgccgggcgctgcgccgcgggctgcttcctctaccgctgcccgccgtgcgggttcgacatgcacccgcgctgcgcgcggctgccccaggtcgtgcgcagctcgcggcactcgcagcacgacctcacgctggtcgtcgccgacggccgctgtgccgccgcgtgcggcggcggcgcggggcgcgcgtggtactaccgctgcaccgcgtgcaacgtcgacttccacgtgtcgtgtgcggcgaccgccggcgacaacaacgatggcgctcgtcaagacgccgacaccgttgttgagcagatacatcaggcaagtgcggcgcaaatgagaattcaggctgcgatgatgcaagcaaggctccgagtgcagggttccagaaacgcgttggacctagtcagcccttcctatcctgagtcgtatacgatacggagagactacttcttctagatccgaaactctcgacgcatttgcttggaaaagccgacgtgaataaagtgcttcagcaacatttcgtcacaaaatctatagcatgcatgcagaggcggagccaggaatttgttttttttttcattattagggggctcaaccatgctaatttatataaaaatttaatcaaaattcaaatgttcaatacaaatttgggaaccataacggggccacgcccctgcccccgtctccgcccctgcatgcatgtatcagattgggtgtgtttattatgtttacagcttgaggcgtcattgttctctgtctgtctacgtgcgtgtttcttttctcattgaaattgtaaccccctctgttctttccccctgtcatgttgtaatcctagttaatcatgaatgttaaacgtctcaattat

SEQ ID NO: 43008 - protein, 236 aa, Panicum virgatum
  misc_feature: Ceres CLONE 2014580
  misc_feature (28)..(57): Pfam Name: C1_3 Pfam Description: C1-like domain
  misc_feature (85)..(115): Pfam Name: C1_3 Pfam Description: C1-like domain
  misc_feature (138)..(168): Pfam Name: C1_3 Pfam Description: C1-like domain
MAQKEDTISHFSHPGHELVKRHYIGPSFLCDMCWEHLSGPGYGCSAGCDFGIHESCAGHPQTHSSQAHHAHPLVLVQTRRDVVAHICDVCAGRCAAGCFLYRCPPCGFDMHPRCARLPQVVRSSRHSQHDLTLVVADGRCAAACGGGAGRAWYYRCTACNVDFHVSCAATAGDNNDGARQDADTVVEQIHQASAAQMRIQAAMMQARLRVQGSRNALDLVSPSYPESYTIRRDYFF

SEQ ID NO: 43009 - DNA, 582 bp, Panicum virgatum
  misc_feature: Ceres CLONE 2014580-R
aggctgagagccttgatgaggagacacagtagcctaagcaggtgcagatgagaccctcgggttcgagaatgcgatcagaactccggaagcagggaagcagacagccaaggcttcccacaaggcgatgttatccagagtcaaccatatcagagagaaattgtttgagaacgatctgttattttggacacggtcgtgcgtaaaaggcgagatgaactaagagtgttaagatcaacccgcctcgacatagcaggcagggagaaggagcagaatccaaatccatctttatggaaggtcaacaggaagggtcagagcaggcttaatcatatgtaattataatcaaaaagaaaatattcgatacgtcaccgagacctagaagcgagaacccccgtgatcccaatgtccgggcgaacccagagctgtcagagagggagtgtttcaggattatgcggattccggtcacaaggttttttctttgtacatcaaaatgcaatgtttttcatccaaatggaaaccccatcaaatctttccccatgtcacggtgtgataatagagaaacaaccatttttaaagtagcaatagtgg

SEQ ID NO: 43010 - DNA, 1230 bp, Panicum virgatum
  misc_feature: Ceres CLONE 2014587
  misc_feature: Encodes the peptide sequence at SEQ ID NO. 43011
gaccccaagccaaaagccgcaactgctgcaagctgaggtcgccaccacgccccccgagagccgcgcgccatgcccccgaccccgacccccgccgccgccgcacccggcgccgccgtggcgccggagcaggcggcgttccgcctcgtgggccaccgcggcttcgtccgcgtcaacccgcgctcggaccgcttccacgcgctcgcgttccaccacgtcgagctctggtgcgccgacgcggcgtcggccgccggccgcttctccttcgggctcggcgcgccgctcgccgcgcggtccgacctctccacggggaactccgcgcacgcctcgctcctgctccgctcgggctccctcgcgttcctcttcaccgcgccctacgcgcgcggcgccgaccccgccaccgcgaccctgccctccttctccgcgcccgccgcgcggcgcttcgcggccggccacggcctcgcggtgcgcgccgtcgcgctccgcgtcgccgacgccgaggacaccttccgcgccagcgtcgccgccggcgcgcgcccggcggtcgagctctacggcgacgtcgtgctccgctacgtcagctacccggacgccgcgggcgcgcccttcctgccgggcttcgaggacgtgagcaaccccggggcggtggactacgggctcatgcggttcgaccacatcgtcggcaacgtcccggagctggcgccggtggccgcgtacgtcgccgcgttcacgggtttccacgagttcgccgagttcaccgcggaggacgtcggcacggcggagagcgggctcaattcggtggtgctcgccaacaactccgagaacgtgctgatcccgctcaacgagcccgtgcacggcaccaagcgccggagccagatacagacgttcctggatcaccacggcggcccgggcgtgcagcacatcgcggtggccagcaacgacgtgctcaggacgctgcgggagatgcaagcacgctccgccatgggcggcttcgagttcatggcgcctccgccgcccaactactacgacggtgtgaggcggcgcgccggggacgtgctctcggaggagcagatcaaggagtgccaagaactgggggtgctggtggacagggatgaccagggggtgttgctccaaatcttcaccaagccagtgggggacaggtaaaaaaaagtcatctttttttcagcgtttgcattgcatgctgcatgtcgaattgcaaaaggaacacctcgc

SEQ ID NO: 43011 - protein, 363 aa, Panicum virgatum
  misc_feature: Ceres CLONE 2014587
  misc_feature: SWISSPROT Homolog: EC 1.13.11.27 4-hydroxyphenylpyruvate dioxygenase
  misc_feature: Functional homolog of the protein sequence given in SEQ ID NO 51578
  misc_feature: Useful for making plants with altered tocopherol content
MPPTPTPAAAAPGAAVAPEQAAFRLVGHRGFVRVNPRSDRFHALAFHHVELWCADAASAAGRFSFGLGAPLAARSDLSTGNSAHASLLLRSGSLAFLFTAPYARGADPATATLPSFSAPAARRFAAGHGLAVRAVALRVADAEDTFRASVAAGARPAVELYGDVVLRYVSYPDAAGAPFLPGFEDVSNPGAVDYGLMRFDHIVGNVPELAPVAAYVAAFTGFHEFAEFTAEDVGTAESGLNSVVLANNSENVLIPLNEPVHGTKRRSQIQTFLDHHGGPGVQHIAVASNDVLRTLREMQARSAMGGFEFMAPPPPNYYDGVRRRAGDVLSEEQIKECQELGVLVDRDDQGVLLQIFTKPVGDR

SEQ ID NO: 43012 - DNA, 650 bp, Panicum virgatum
  misc_feature: Ceres CLONE 2014611
  misc_feature: Encodes the peptide sequence at SEQ ID NO. 43013
aaagatttgcagttaggaactctctaggccaagcagtggttgagggcactggagatcattgctgcgagtacatgactggtggctgtgtagttgtacttggcaaggttgggaggaacgttgcagctggaatgactggtggccttgcctacattctcgatgaggatgatacacttgtcccaaaggttaacaaggaaatagtcaagatgcagagagtgaacgctccagctgggcagatgcagctgaagggcttgattgaggcttatgttgaaaaaacgggcagtgagaaaggtgccacaattttgagggaatgggaggcctatttgcctctcttctggcaactggtaccgcccagtgaagaagactcacctgaggcttgtgcagagttcgagagagtgctcgccaggcaagcaaccacccaactgtctgcgaagtgatcaaatcagacatctggaaggtgttatctctctgacactccttgcaaagtgatcttcctctgactgcatcaacaaagacgtaaccggcatatgtgaagcaatgaagtgcttttcgataaaagaagcaatgaagtgctgcctcgaagacagcaattttgtggaggctcagccaaagtcatcttttggagttgagctggcagaaccgtcgagggttct

SEQ ID NO: 43013 - protein, 143 aa, Panicum virgatum
  misc_feature: Ceres CLONE 2014611
  misc_feature (1)..(83): Pfam Name: GXGXG Pfam Description: GXGXG motif
  misc_feature: SWISSPROT Homolog: EC 1.4.7.1 Glutamate synthase (ferredoxin)
RFAVRNSLGQAVVEGTGDHCCEYMTGGCVVVLGKVGRNVAAGMTGGLAYILDEDDTLVPKVNKEIVKMQRVNAPAGQMQLKGLIEAYVEKTGSEKGATILREWEAYLPLFWQLVPPSEEDSPEACAEFERVLARQATTQLSAK

SEQ ID NO: 43014 - DNA, 1034 bp, Panicum virgatum
  misc_feature: Ceres CLONE 2014624
  misc_feature: Encodes the peptide sequence at SEQ ID NO. 43015
aatcccatcgcaaactgctcggttcttttccccttccgccgccccgccaccacctggcttcggaaccagccgcatccccctgccaggctgccacattccttcctctctctccaaggctccaactcccaatccccctcttcgtctccgtagctgcaactcttcacggcttcgtcgatctgcaacgtctcccgcaacctccatggccggcaaagctgcagacaccgggagcaacgacggcggcggcgccaccacggggcagtcctcttcctcctcctcctccatggcggacgtgtacaagggcgagctcacgccgctgcagcgccacgccgccttcttcgaccgcgacaaggacggcgtcatctacccctccgagacgtacaaagggttccgcgcgatcggctgcggggtggcgctgtcggccgccagcgccgtcttcgtcaacgccgcacttgggcccaacaccaaaccggagaaccagaagactccgcctttaaagttccccatttatgtgaagaacattcacaagggcaagcatggaagcgattcaggcgtgtatgatgccaatggaagatttgtttctgaaaagtttgaggagatattcaagaagtatgcccacaccaagcctgatgctctcacaggaaaagagctgcaggagatgctccaagcaaacagggaacccaaagacttcaaaggatggctgggtggcttcacggagtggaaggtgctgtattctctgtgcaaagacaaggatgggtttctccacaaggatactgtcagggcggtctatgatggcagcctgtttgaaaggttggagcaagagaggaaggctaagaaggaattgagaaagaagaagtgataaaaacatcgcaaacactctcttgtgtggacggatttgtaaattgtggtgtgaatgtgggtcagcgaattataacggtagtttgattggttctgtatgtttgtcaattcagcttttctgtaataagagccttcatgtaaagaaactgcaagtatttatggcttaagttgagtgagat

SEQ ID NO: 43015 - protein, 218 aa, Panicum virgatum
  misc_feature: Ceres CLONE 2014624
  misc_feature (31)..(206): Pfam Name: Caleosin Pfam Description: Caleosin related protein
MAGKAADTGSNDGGGATTGQSSSSSSSMADVYKGELTPLQRHAAFFDRDKDGVIYPSETYKGFRAIGCGVALSAASAVFVNAALGPNTKPENQKTPPLKFPIYVKNIHKGKHGSDSGVYDANGRFVSEKFEEIFKKYAHTKPDALTGKELQEMLQANREPKDFKGWLGGFTEWKVLYSLCKDKDGFLHKDTVRAVYDGSLFERLEQERKAKKELRKKK

SEQ ID NO: 43016 - DNA, 309 bp, Panicum virgatum
  misc_feature: Ceres CLONE 2014634
  misc_feature: Encodes the peptide sequence at SEQ ID NO. 43017
catctacttgtgctctcactacgctaaaaccaaacccacacgctcctccccttctcttccccttctgcatccccatcagctgcgtctccgatctcctccggacactctggaatgggctgcctggcctctgagatgacagcggtggggtgggccgcccgggatgccccccggcacctttcccccaacccctaccccgtcgggaaccaaccgggcggacgtgggcatctcgactacaccgcttcggcgccgccacccatctatcccgtcctgcacaagtacctaccacacttgctgttctagagccacgat

SEQ ID NO: 43017 - protein, 62 aa, Panicum virgatum
  misc_feature: Ceres CLONE 2014634
  misc_feature: SWISSPROT Homolog: EC 1.1.1.195 Cinnamyl-alcohol dehydrogenase
MGCLASEMTAVGWAARDAPRHLSPNPYPVGNQPGGRGHLDYTASAPPPIYPVLHKYLPHLLF

SEQ ID NO: 43018 - DNA, 579 bp, Panicum virgatum
  misc_feature: Ceres CLONE 2014657
  misc_feature: Encodes the peptide sequence at SEQ ID NO. 43019
atgcaagtcatgtcgtcgtttctatcatgcatctccgggctgaagcgcaccgggaagagctgccgtctccgctggctcaactacctccgccccgacgtgaagcgcggcgacctcaccgccgacgagcagctgctcatcctcgacctccactccagatggggaaaccggtggtccaagatcgcgtcgcatctgccggggcggacggacaacgagatcaagaactactggcggacgcgggtgcagaagcacgccaagcagctcaactgcgacgtcaacagcaagcgcttcaaggacaatatgcgcttcctctggatgccccgactggcagagcgcgccgcgtcagccgccgccgcccaccactcatcgccggcgtcgtccctgcagcatcagcgccagcagcaggccgccgccgccgccggcggctgcttcggcttcgagatggcgacggccaacgccgccgccgaccgctcccccagcagcgtggtcaccaccaccgccaccaacaggctcgccctgcagctcgcggacgacgtcctccggcgcctccaccgccgccaccgccaaacgacgacgactgct

SEQ ID NO: 43019 - protein, 189 aa, Panicum virgatum
  misc_feature: Ceres CLONE 2014657
  misc_feature (32)..(77): Pfam Name: Myb_DNA-binding Pfam Description: Myb-like DNA-binding domain
  misc_feature: Functional homolog of the protein sequence given in SEQ ID NO 50240
  misc_feature: Useful for making plants with modulated drought sensitivity
  misc_feature: The sequence is a functional homolog of SEQ ID NO 2178 in the 10/374,780 US patent application
  misc_feature: The sequence is a functional homolog of SEQ ID NO 1563 in the 10/374,780 US patent application
  misc_feature: Functional homolog of the protein sequence given in SEQ ID NO 50945
  misc_feature: Useful for making plants with modulated biomass
  misc_feature: Useful for making plants with modulated flowering time
  misc_feature: Functional homolog of the protein sequence given in SEQ ID NO 50733
  misc_feature: Useful for making plants with altered cell wall content and/or composition
MSSFLSCISGLKRTGKSCRLRWLNYLRPDVKRGDLTADEQLLILDLHSRWGNRWSKIASHLPGRTDNEIKNYWRTRVQKHAKQLNCDVNSKRFKDNMRFLWMPRLAERAASAAAAHHSSPASSLQHQRQQQAAAAAGGCFGFEMATANAAADRSPSSVVTTTATNRLALQLADDVLRRLHRRHRQTTTT

SEQ ID NO: 43020 - DNA, 669 bp, Panicum virgatum
  misc_feature: Ceres CLONE 2014663
  misc_feature: Encodes the peptide sequence at SEQ ID NO. 43021
gaaaacccgcacatctcgaaagcacacctgctcaccgatcccaagagttccccggccggcgactacatccatcaccatcagcaggccatcgacatcaatcaatactactatgaccaagctgagcgtccccgcccaccaccgtgatctcccccggacgctcagccaccgcttccttgggcgccacgagatgaagctggccccggaggacggcgtcaagttccagtgcgacgggtgcaggctgcccggcaggggcctgcgctaccagtgcggcgcaggctgcaacgtcgacctccacgtcggctgcgcgctggcgcctccctgccgggagatcggcggcagcaggttcgtgctccgcgacaagccgccggcccccgcgggccgccggcactgcgacgcgtgcggcggccccgcgcgcgggttcgtctaccactgccccgagctcgaccacgacgtccacccgtgctgtgccgacctgccggaccgcttcaaggtggccggcctctccttcaagctgcacatgaagaggtcgccgcgccgctgcgtcctctgcgcggacgacgaagagggctggtgctcgcgctgcgtctactggtcctaccgctgcgacgtcggcgacggcggcgggccggtgttcctgcacgtggcgtgcgccggggacctggtggcctc

SEQ ID NO: 43021 - protein, 160 aa, Panicum virgatum
  misc_feature: Ceres CLONE 2014663
  misc_feature (12)..(40): Pfam Name: C1_2 Pfam Description: C1 domain
  misc_feature (67)..(94): Pfam Name: C1_2 Pfam Description: C1 domain
MKLAPEDGVKFQCDGCRLPGRGLRYQCGAGCNVDLHVGCALAPPCREIGGSRFVLRDKPPAPAGRRHCDACGGPARGFVYHCPELDHDVHPCCADLPDRFKVAGLSFKLHMKRSPRRCVLCADDEEGWCSRCVYWSYRCDVGDGGGPVFLHVACAGDLVA

SEQ ID NO: 43022 - DNA, 624 bp, Panicum virgatum
  misc_feature: Ceres CLONE 2014678
  misc_feature: Encodes the peptide sequence at SEQ ID NO. 43023
atgtacacaggtaaggctaaggcaaagtgtaatagctaccttgttcctatcaggctggatcaagttcatcatcaaggatgtaaataaaccagctgaaattggattattaatccacaaccggcaagggaacgaagagcagccagactggtgccccttctcggtgaccatcgctgaaactggaatccaacatcgaagcaagcaacaacgttagcatggtgacagtgagggaggagatgcgcaaggggccgtggacagagcaggaggacatgcaactgattaagcagcaatcaattaaacagcaacacgtaccatcctgtctgaacaaacctcttcaggcttcacttcacaggaagagctgccggctccggtgggtgaacaacctccaccccagccgcaagcatggacgcttgtcgccgcaggaggaacgcattgtcatcgagctccatgctcgctggggtaacagttggtctaggatagcccgcaggctgccgggacgtaccgacaacgatatcaagaactactggaagacgcgcatgagaatgaaagcacaggagagggagctgagcatgtcaccttcgtcgtcatccttctcactaatgtaccaatccagctgcctccctgaca

SEQ ID NO: 43023 - protein, 137 aa, Panicum virgatum
  misc_feature: Ceres CLONE 2014678
  misc_feature (63)..(108): Pfam Name: Myb_DNA-binding Pfam Description: Myb-like DNA-binding domain
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 126 in the 10/412,699 US patent application
  misc_feature: The sequence is a functional homolog of SEQ ID NO 1572 in the 10/374,780 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: Functional homolog of the protein sequence given in SEQ ID NO 50477
  misc_feature: Useful for making plants with altered alkaloid content
  misc_feature: Useful for making plants with modulated nitrogen use efficiency
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1002 in the 11/435,388 US patent application
  misc_feature: The sequence is a functional homolog of SEQ ID NO 1073 in the 10/374,780 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: Functional homolog of the protein sequence given in SEQ ID NO 50733
  misc_feature: Useful for making plants with altered cell wall content and/or composition
MVTVREEMRKGPWTEQEDMQLIKQQSIKQQHVPSCLNKPLQASLHRKSCRLRWVNNLHPSRKHGRLSPQEERIVIELHARWGNSWSRIARRLPGRTDNDIKNYWKTRMRMKAQERELSMSPSSSSFSLMYQSSCLPD

SEQ ID NO: 43024 - DNA, 697 bp, Panicum virgatum
  misc_feature: Ceres CLONE 2014700
  misc_feature: Encodes the peptide sequence at SEQ ID NO. 43025
gtatctcttcatgcttagatctatcacaagtcgtgtcataagcagcagttatccatcaactgtcactcgccgtttattggctaatcaagctacatcttccacatcagccatctcgtttaaaaagcatatccgtcagcgtcgttatggacctgttcctgctgcacctccacctactgccgaagatgctgtaaccaacattttgtacaatacacctgctcctagtaaagaacctgaaagtcgtcacatcttgaattgcttagtccaaaatgaacctggtgttcttagtcgcgtctctggtatcttagctggtcgtggattcaacattgaatcattggttgttgcaaaaacagaggtaccggatctctctcgtatgactgttatctttgatggttataatgtacaaattgaacaagcaagacgtcaattggaagatttggttcctgtttgggcagttttggattacacaaaaacaaaattggtagagcgggagcttttgttgattaaagagtctattctcggtcctgagcacttgcacgaacaattgcctactactaaattggataataaggttgaatatgaagatgaaaacattaatcgacatgaaaatgaaaaacacattgctccttccgatacccttcgcgagacattctcgcatttgcgcgctttgactgaattgactcgtctctttgatggaaag

SEQ ID NO: 43025 - protein, 228 aa, Panicum virgatum
  misc_feature: Ceres CLONE 2014700
  misc_feature (78)..(144): Pfam Name: ACT Pfam Description: ACT domain
  misc_feature: SWISSPROT Homolog: EC 2.2.1.6 Acetolactate synthase
MLRSITSRVISSSYPSTVTRRLLANQATSSTSAISFKKHIRQRRYGPVPAAPPPTAEDAVTNILYNTPAPSKEPESRHILNCLVQNEPGVLSRVSGILAGRGFNIESLVVAKTEVPDLSRMTVIFDGYNVQIEQARRQLEDLVPVWAVLDYTKTKLVERELLLIKESILGPEHLHEQLPTTKLDNKVEYEDENINRHENEKHIAPSDTLRETFSHLRALTELTRLFDG

SEQ ID NO: 43026 - DNA, 1199 bp, Panicum virgatum
  misc_feature: Ceres CLONE 2014702
  misc_feature: Encodes the peptide sequence at SEQ ID NO. 43027
gcgaaaagcaaactgggacggcgcgccgcaactcggtcggtgccggggatgagctcgtcgacgtccgcccgcgacgatgacgcgccggacctcgtgtgccagatcgactgcgtccacggcatggtcgacgcgctctcctccgtccgctggaagcgccaccaggacgcggtgatggagctgtcggcgcacgggatcgtgctcaccgtcgaggagagcggctgcctccaggccaaggtcttcctcaagcgcgagctgttcgtggagtacgagtatgcgggggaagggcgggagcgcttcgggctcagcttggggctcttcgtcgactgcctcaacatcttctcagcaccggggcatgcgtccgcggtcgagatccggtaccctggacctgacatgcagcttctcctcaaatcagtggattcccaagatgcatgtctatatgcagaaatcagaacccgaattccagatacaatctcctgggattacaattttgagcatgagggaaatactccagtcacctttaccgttaagtctgctgtcctgaaagaagcgctcgatgatcttgagtggccaggttccagcattcagattcgaatgcaaccagatcctccaacagttgtattcaaaggtgaaggtcatggtgacttgcaggtcgaattcccctattatgcaaacaccgaccttctaattgtgttccaatgtgaccgtgaagtgtcatacaggtacaaatacaaatttcttcgagcaactacctcgaatatccccagtagtgtcatgaaggagaatcgtaggactaaggtcacaattgggaggggagggatgctgaaaatccaacacctggtttcacttgccaggccaggtatgccatacttccgtaatattggtggaggaactgaacagacaagccgaatcgctcatatagaattctttgtgaagccagaagaagatgataatgatgcctagcatttgtagagtgtgttattgctctgtatcatctagtagagctagtttgtcgtcacattaattactaatttcagctcttgtttgagaaacaccttgtttgagtgtcaggtcttagtttctgaacttgctactgtcagacaggcatcctgttactagtcatgtgaatcctgttacaatcagacagacaacatgttgttctgaatcatgtgaatcacaagtttctgttttttgattcgcag

SEQ ID NO: 43027 - protein, 303 aa, Panicum virgatum
  misc_feature: Ceres CLONE 2014702
  misc_feature: SWISSPROT Homolog: EC 3.1.11.2 Exodeoxyribonuclease III
MSSSTSARDDDAPDLVCQIDCVHGMVDALSSVRWKRHQDAVMELSAHGIVLTVEESGCLQAKVFLKRELFVEYEYAGEGRERFGLSLGLFVDCLNIFSAPGHASAVEIRYPGPDMQLLLKSVDSQDACLYAEIRTRIPDTISWDYNFEHEGNTPVTFTVKSAVLKEALDDLEWPGSSIQIRMQPDPPTVVFKGEGHGDLQVEFPYYANTDLLIVFQCDREVSYRYKYKFLRATTSNIPSSVMKENRRTKVTIGRGGMLKIQHLVSLARPGMPYFRNIGGGTEQTSRIAHIEFFVKPEEDDNDA

SEQ ID NO: 43028 - DNA, 682 bp, Panicum virgatum
  misc_feature: Ceres CLONE 2014712
  misc_feature: Encodes the peptide sequence at SEQ ID NO. 43029
atccatcttcgctcctcagtcatctatcacagaagatcagcagcaggtagctagcaagaagaagcagcaggcgatcgagagagatatggaggggaaggaggaggatgttcgtcttggcgcgaaccgttactcggagcgtcagccgatcggcacggcggcgcagggcacggatgagaaggactacaaggagcccccggcggcgccgctgttcgaggcggaggagctgacgtcgtggtccttgtaccgcgcgggcatcgccgagttcgtggcgacgttcctgttcctgtacatcagcatcctgacggtgatgggcgtgagcaagtcgtcgagcaagtgcgccacggtgggcatccagggcatcgcctggtccttcggcggcatgatcttcgcgctcgtctactgcacggcgggcatctcggggggccacatcaacccggcggtcaccttcggtctctttttggcgcgcaagctgtcgctcacgagggcgctcttgtacatggtgatgcagtgccttggcgccatctgcggcgccggcgtcgtcaaggggttccagcaggggctctacatgagcgccggcggcggcgcaaacgccgtcaacccgggatacaccaagggcgacggcctcggcgccgagatcgtcggcaccttcgtcctcgtctacaccgtctttctcgccaccgac

SEQ ID NO: 43029 - protein, 198 aa, Panicum virgatum
  misc_feature: Ceres CLONE 2014712
  misc_feature (46)..(198): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANRYSERQPIGTAAQGTDEKDYKEPPAAPLFEAEELTSWSLYRAGIAEFVATFLFLYISILTVMGVSKSSSKCATVGIQGIAWSFGGMIFALVYCTAGISGGHINPAVTFGLFLARKLSLTRALLYMVMQCLGAICGAGVVKGFQQGLYMSAGGGANAVNPGYTKGDGLGAEIVGTFVLVYTVFLAT

SEQ ID NO: 43030 - DNA, 1389 bp, Panicum virgatum
  misc_feature: Ceres CLONE 2014717
  misc_feature: Encodes the peptide sequence at SEQ ID NO. 43031
caccgccctccccgtcgccgccgaccgaccgagccgccgttcacccacccccacgagctcccgcgcgggttcatgtccatctccccacgcgaacgcaccggaggatcctattacccgcgcgcgcccaaccctacccctagcccgcagcatggcagccaacgacgccgtcacggccgccgctcccctccggcaattgtctcgccgcccggcgccgcggcagcggcgcccggagccggaggcagtggcgcgagctccgacccagctgacccagctattagaaaatctatcaatgctcccgaaaaggtagttggatttagaatctctggggaagagaatgatatatgtactcaagagggtggcaatatttcagaatgccactcgtctgaacaggggaatttgggtttccctatagacagtgttggctctgttggggcatatcctgagagaaccgaaatggtgggatctcttcagcctgaccatttggcttcaggttctactggacctcagggtaatgggactcagatggctgctaggaagagtcaagccgtgaatgctaatcatctactgaactttcagtatgatcctatttctcggccgcagcccagaggccctagaatgtatcctcccagaagacaaaggaagatcaaaccatacaacaaagacctgttcctccaagcaaactataaatttgttgtgttggataccgggaattaccagattgaatcaatggatcctgataagatgcttcagtgggaagatgttatctgtgtaagattctatagcccttctgaggtacaatgccctatttgcttggagagcccattgtgcccacagatcacatcatgtggacatatatactgctttccgtgcattttacgttatctaacaatgggcaaagaggatttcaaaggtgaatgctggaagaagtgtcctctgtgtttcatgatggtgtcaacaaaggagttgtataccatacatattactcaagttcagaatttccgtgctggtgacattgctacatttacacttctgagccggtcaagaaattctctcacaccgtctattaaaagcacctccagtgaatgttcttcagcaggtgaagatcaatgtaatgttttctcaaagtttattttgacatctgatgtggagttatctgttcgagaggcaaaatcagatcttattaattggttgcatatggctgactcgggccttgttgatgacatggagaaacttccatatgtttctgctgctttggaacaactggaagaaaggatgaaatattggactgagtacagaaattatggttgtagccctccatcgaaagatagcttctctcctggatctagttacaagtctagaaactcctttgatgtgaatacttctcaactg

SEQ ID NO: 43031 - protein, 438 aa, Panicum virgatum
  misc_feature: Ceres CLONE 2014717
  misc_feature (243)..(289): Pfam Name: zf-C3HC4 Pfam Description: Zinc finger, C3HC4 type (RING finger)
MSISPRERTGGSYYPRAPNPTPSPQHGSQRRRHGRRSPPAIVSPPGAAAAAPGAGGSGASSDPADPAIRKSINAPEKVVGFRISGEENDICTQEGGNISECHSSEQGNLGFPIDSVGSVGAYPERTEMVGSLQPDHLASGSTGPQGNGTQMAARKSQAVNANHLLNFQYDPISRPQPRGPRMYPPRRQRKIKPYNKDLFLQANYKFVVLDTGNYQIESMDPDKMLQWEDVICVRFYSPSEVQCPICLESPLCPQITSCGHIYCFPCILRYLTMGKEDFKGECWKKCPLCFMMVSTKELYTIHITQVQNFRAGDIATFTLLSRSRNSLTPSIKSTSSECSSAGEDQCNVFSKFILTSDVELSVREAKSDLINWLHMADSGLVDDMEKLPYVSAALEQLEERMKYWTEYRNYGCSPPSKDSFSPGSSYKSRNSFDVNTSQ

SEQ ID NO: 43032 - DNA, 685 bp, Panicum virgatum
  misc_feature: Ceres CLONE 2014717-R
gagtgatatagtacctccaagctcattagctccattcttggatgaaatcaagaagcgtgagaagcaaagaaaacgagctgccaagaaggaagaaagtgagagagtgaaagctgaagttgctgccgctgtgcaggcatcagctatgcggtttgagtttacaaatttctcacaaagtcacaatgatgtcatgttctctctagatgacttcgaagctctaggtaacaatgctgggtcatccacgagtccgccagccggtgaaagaaagcttttctctgatgtaacacgcctgggttttgcatcagcccaagactcgcctcccctgagaattgaaattggggatgcaagtggtaaaaatgatagtgctagagaccaagggccatcagcagcacctgcattatcatttgccagcatcatatcttccagtagagctgccactgtgaccgacaacaactcggagatgcagaaagcgaatggcgctgggaagaagggcaagaaaccaactagagtgctcttgtcaactggtggtggccgtcgatactgaaggattagatacactggaagcgaacagtttggttgtttccattgtagatcaaagctatgtttgtatagtgcataaactgtactactttgtaacacccaagtagctttagaaaaaacacacccaaatagcatttgtttccccctc

SEQ ID NO: 43033 - DNA, 1254 bp, Panicum virgatum
  misc_feature: Ceres CLONE 2014734
  misc_feature: Encodes the peptide sequence at SEQ ID NO. 43034
acaccatcctgttccctgtttctctccaatccgaaatacaatcgacgcgatattacgatccaaggtctatctgatagccatttcaactttttactcaacaacatcaaccgatttaaccgatccacttacacatcaatcaccatgccttccaagaagaccgagaccaagcccgagggcgctgccgctgcgaagcccaaggcctccggctcgcaacacacataccaggacatgatcactgatgccatcgtcgcgctcaaggatcgcaatggttctagccgccaatcgctcaagaagtatgtgcgcgccaacaacacaatcaatgtcaccgagaagatgttcgactcgctcttcaacaaggccttgaagaacggtgtcgacaagggtgcctttgagcagcccaagggtccttccggcggcaccaagctcgccaagaaggcctccaagcctgctgcccccaagaaggcggcggctcctaagaaggaggcggcagccaagaaggagaccaaggaggccaaggagaagaagcctgccaccaagaaggctgctcctaagaaggagactgccgccaagaaggagaccaaggagaagaaggctcccgcagtcaagaaggccgctgctcctaagaaggctgccgcgcctaagaaggcccctgctgcccctgctgttgtcgacaagcccacagtcctgaccaagaccaagtcgggtcgcgtcgcaaagactgctgctaagcccgcagcgcctaagaaggcggcacctaagaaggctgcggcgaagaaggagaaggcctcggcatgatgcgcctatatcttcgctttgtcatgatgtctttttccttattggggcgcgagggttcggtttctgtctagtacggcgttcgggtggtattggggaatcattttgggggacggcatgggcgctgccgcggctcgacaccggcgcgcggagggggcacaggccgttttgcacattggatcgacactaccttctgggtacgtggccggctggaattctgcttcaataaccgctacacacattgggctcgctatatggtatccgcgttcttgggagcaccagtgtcaaacacacgagatcaccacggttcggaacgggtcagcgcacgaggcgtctcctaaggtagaactgggggatcatgtgggcgttgggatcacgcgggcggcgaaatttcgaatgggcttaaacttacggtgtttgtggattgtaattatacctgcaaatgaactgttttgcactccg

SEQ ID NO: 43034 - protein, 217 aa, Panicum virgatum
  misc_feature: Ceres CLONE 2014734
  misc_feature (23)..(97): Pfam Name: Linker_histone Pfam Description: linker histone H1 and H5 family
MPSKKTETKPEGAAAAKPKASGSQHTYQDMITDAIVALKDRNGSSRQSLKKYVRANNTINVTEKMFDSLFNKALKNGVDKGAFEQPKGPSGGTKLAKKASKPAAPKKAAAPKKEAAAKKETKEAKEKKPATKKAAPKKETAAKKETKEKKAPAVKKAAAPKKAAAPKKAPAAPAVVDKPTVLTKTKSGRVAKTAAKPAAPKKAAPKKAAAKKEKASA

SEQ ID NO: 43035 - DNA, 442 bp, Panicum virgatum
  misc_feature: Ceres CLONE 2014741
  misc_feature: Encodes the peptide sequence at SEQ ID NO. 43036
aacgctcgatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcaggggggtcacatcgctgagcagaagtacggtggcggcggcggcggatacggtggtggcggtgggtacggcggcggaggtggtggtggtgggtatggaggcggcggcggctacacgcccggctactccggcaccggaacctgcgactactggaagagccacccggacgccatcatctcgggcatcgggtcgctgggcagcatcctggggtcctttggtgacgtgtgca

SEQ ID NO: 43036 - protein, 102 aa, Panicum virgatum
  misc_feature: Ceres CLONE 2014741
  misc_feature (2)..(72): Pfam Name: GRP Pfam Description: Glycine rich protein family
MMSGKALLVAVLLVGVASRCSGSRGLQGGHIAEQKYGGGGGGYGGGGGYGGGGGGGGYGGGGGYTPGYSGTGTCDYWKSHPDAIISGIGSLGSILGSFGDVC

SEQ ID NO: 43037 - DNA, 705 bp, Panicum virgatum
  misc_feature: Ceres CLONE 2014743
  misc_feature: Encodes the peptide sequence at SEQ ID NO. 43038
gttgatatgctgcgccaccaagctgtccagattgtggctgctcgacttagccggatggagccacctttgagaaaggaagttgttgaatacatgacagatttcgattctcacttgtggagcatgaggaaaagcaaagcaaacttcttcagactcatgacagttttctcaggcttgtttgctgttagcaagtggttcagtggtgtctgtgcatggaagaatcctattaccactgtgctagttcacattctctatataatgctggtgtgctttccggagctcatactcccaacagtgttcttgtacatgtttcttattgggatttggaacttccgttaccgaccccgctatcctccacacatgaataccaagatctctcatgcagaagctgttcatcccgatgaacttgatgaagagtttgatacgttccctaccagccgcaatcctgagattgtaaggatgaggtatgacagactgaggagtgttgctggaaggattcaaacagtggttggcgatgtagcaacacaaggggagagggttcaagcattgcttagctggagggaccctcggaccacagcagtctttgtcctgttttgtttgatagcagcagtagtactgtatgttacaccacttcaagttcttgctgcactaggagggttctatgtcatgaggcacccaaggttcagacataggttaccatcagtacca

SEQ ID NO: 43038 - protein, 234 aa, Panicum virgatum
  misc_feature: Ceres CLONE 2014743
  misc_feature (95)..(234): Pfam Name: PRT_C Pfam Description: Plant phosphoribosyltransferase C-terminal
VDMLRHQAVQIVAARLSRMEPPLRKEVVEYMTDFDSHLWSMRKSKANFFRLMTVFSGLFAVSKWFSGVCAWKNPITTVLVHILYIMLVCFPELILPTVFLYMFLIGIWNFRYRPRYPPHMNTKISHAEAVHPDELDEEFDTFPTSRNPEIVRMRYDRLRSVAGRIQTVVGDVATQGERVQALLSWRDPRTTAVFVLFCLIAAVVLYVTPLQVLAALGGFYVMRHPRFRHRLPSV

SEQ ID NO: 43039 - DNA, 731 bp, Panicum virgatum
  misc_feature: Ceres CLONE 2014758
  misc_feature: Encodes the peptide sequence at SEQ ID NO. 43040
tgatcacacccaaccacattctaacagagtcacagagcagagcctcgcagcagcaagagcagtgatccgatcgacatggccgccgccgccaccatggccctgacctcccgcgcgctctccggcaagccggcggccagcgccagggacgtcttcggcgagggccgcatcacgatgcgcaagaccgcggcgaagcccaagccggcggcggcgtccggcagcccctggtacgggcccgaccgcgtgctgtacctgggcccgctctccggcgagcccccgagttatctgaccggcgagttccccggcgactacgggtgggacaccgcgggtctgtccgccgacccggagaccttcgccaagaaccgcgagctggaggtgatccactgccggtgggcgatgctgggcgcgctggggtgcgtgttcccggagctcctcgcccgcaacggcgtcaagttcggcgaggcggtgtggttcaaggcggggtcgcagatcttcagcgagggcgggctggactacctgggcaacccgagcctggtgcacgcgcagagcatcctggccatctgggcgtgccaggtggtgctcatgggcgccgtcgaggggtaccgcgtcgccggcggcccgctcggggaggtggtggacccgctgtacccgggcgggagcttcgacccgctggggcttgccgacgacccggaggcgtttcgcgagctcaaggggaaagagatcaagaacggccg

SEQ ID NO: 43040 - protein, 218 aa, Panicum virgatum
  misc_feature: Ceres CLONE 2014758
  misc_feature (65)..(218): Pfam Name: Chloroa_b-bind Pfam Description: Chlorophyll A-B binding protein
MAAAATMALTSRALSGKPAASARDVFGEGRITMRKTAAKPKPAAASGSPWYGPDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLADDPEAFRELKGKEIKNG

SEQ ID NO: 43041 - DNA, 651 bp, Panicum virgatum
  misc_feature: Ceres CLONE 2014790
  misc_feature: Encodes the peptide sequence at SEQ ID NO. 43042
gctatcgatcgagaacaagaaccatctcactgcagtctcatctcatcatggcgttccaacgccaccgttcatggctgctcctcctcgccctcgcttgcttgttgtacctcgctgccacagccgccgaggccaagcggaccggcgagctgacggtgttctggggccggaacaaggacgagggcaccctgcgcgaggcctgcgacaccgggctgtacaacaccgtggtcatctccttcctcagcgtcttcggccacggcaaatactggaccgacctctcgggccacccgctcaagggcatcggcgccgacatcaagcactgccagtccaagggcatcccggtgttcctctccatcggcggcgggggcaccgactactccctcccgtcctcggcgtcgccggaggccgtcgcgaaccacctctggaacgcgtacctcgggggcggcagcggcgacgtgttccgccccttcggcgacgcggcggtcgacggcgtcgacttctacatcgaccatggcgcgccggataactacgacgagctcgcgcgccgcctcgactacttcaacagcatgtactaccacgccacggccaagcacgtgcggctcacggccacgccgcgctgcgcgttcccggaccgccgcctcgagcgcgcgctgg

SEQ ID NO: 43042 - protein, 201 aa, Panicum virgatum
  misc_feature: Ceres CLONE 2014790
  misc_feature (32)..(200): Pfam Name: Glyco_hydro_18 Pfam Description: Glycosyl hydrolases family 18
  misc_feature: SWISSPROT Homolog: EC 3.2.1.14 Chitinase
MAFQRHRSWLLLLALACLLYLAATAAEAKRTGELTVFWGRNKDEGTLREACDTGLYNTVVISFLSVFGHGKYWTDLSGHPLKGIGADIKHCQSKGIPVFLSIGGGGTDYSLPSSASPEAVANHLWNAYLGGGSGDVFRPFGDAAVDGVDFYIDHGAPDNYDELARRLDYFNSMYYHATAKHVRLTATPRCAFPDRRLERAL

SEQ ID NO: 43043 - DNA, 660 bp, Panicum virgatum
  misc_feature: Ceres CLONE 2014795
  misc_feature: Encodes the peptide sequence at SEQ ID NO. 43044
aacttgactgctgcaaacataatgaaatgcgatgatgatacatttgttagggtagatgtggttctgagacacatcaagctgaacaacggtggcaaaccgttgtatgtggggaacctgaacctcttgcacagaccattgagaactggaaaatgggcagttacagatgaggaatggcctgaagatatctacccgccttatgcaaacggaccgggctatgtaatttctggcgacatagcaaaattcatcgtatctcagcatgccaaccagagtttaagagtgagtctgcaatgcagcctgctacagatatcatttcacataaactctgtatcctaatgttccagctggtcaattttttcctggtgcctgcagctatttaagatggaagatgtaagtatgggtctatgggttgaaaaattcaattccacgacacctgttcagtattcccacagctggaggttctgccagtacggttgcctggagaactactacacggcccactatcagtcgcctaggcagatgctgtgcttgtgggataagttgatccgcggtcgggcatcctgctgtaactacagatagcgcggcgaaagattggcataccacataccccactatcccagccaggtttagtttggttggctggtgttttcattttctgacacg

SEQ ID NO: 43044 - protein, 110 aa, Panicum virgatum
  misc_feature: Ceres CLONE 2014795
  misc_feature: SWISSPROT Homolog: EC 2.4.1.62 Ganglioside galactosyltransferase
  misc_feature: Functional homolog of the protein sequence given in SEQ ID NO 50128
  misc_feature: Useful for making plants with altered carbohydrate content
NLTAANIMKCDDDTFVRVDVVLRHIKLNNGGKPLYVGNLNLLHRPLRTGKWAVTDEEWPEDIYPPYANGPGYVISGDIAKFIVSQHANQSLRVSLQCSLLQISFHINSVS

SEQ ID NO: 43045 - DNA, 662 bp, Panicum virgatum
  misc_feature: Ceres CLONE 2014802
  misc_feature: Encodes the peptide sequence at SEQ ID NO. 43046
atcccaacacagcagcagcagtagctagccatctcttctctcgcctctcgagcaatggctgcttccaccatggcgatctcctccacggcgatgatggccggcacccccatcaaggtgggttctttcggcgagggccgcatcaccatgcgcaagaccgcggccaagcccaaggtggcggcgtccggcagcccgtggtacggccctgaccgcgtcaagtacctcggccccttctccggcgagcccccgagctacctcaccggcgagttccccggcgactacggctgggacaccgctggcctgtccgctgaccccgagaccttcgccaagaaccgcgagctggaggtgatccactcccgctgggccatgctcggcgcgctcggctgcgtcttccccgagctgctcgctcgcaacggcgtcaagttcggcgaggccgtctggttcaaggccggctcccagatcttcagcgagggtggcctcgactacctcggcaaccccagcctgatccacgcgcagagcatcctcgccatctgggcctgccaggtcgtcctcatgggcgccgtcgagggctaccgcattgccggcggcccgctcggcgaggtcgtcgacccgctctaccccggcggcagcttcgaccccctcggcctggccgacgaccccgaggc

SEQ ID NO: 43046 - protein, 197 aa, Panicum virgatum
  misc_feature: Ceres CLONE 2014802
  misc_feature (57)..(197): Pfam Name: Chloroa_b-bind Pfam Description: Chlorophyll A-B binding protein
MAISSTAMMAGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPE

SEQ ID NO: 43047 - DNA, 613 bp, Panicum virgatum
  misc_feature: Ceres CLONE 2014804
  misc_feature: Encodes the peptide sequence at SEQ ID NO. 43048
acaggcgcacagccacgaaccacccgccgagcccgagcacactcgacgacgagtcgacgactcccatttcacacccagcatggaagccgcggcggtcaagcccgtcctccgcgtcgccgccatctgcggctccctccgcaaggcctccttcaaccgcggcctcctccgcgccgccgcggaggtgtgcgacgactccatcccggggctgcgcgtccaccacctcgacatctccgacctgcccatcatcaacaccgacctcgagaccgacggcgccttcccgcccgccgtcgaggccttccgcgccaaggtctcccaggccgactgcttcctcttcggcgcgcccgagtacaactactccatcgcaacccccctgaagaatgcacttgactgggcatctagaggaaagaactgttgggcagacaaacctgctgcgattgtcagtgcaggaggtggctttggaggagggagatcacagtaccatctgcgccaggttggggtattcttggatcttcatttcatcaacaagccagaattattcgtccaagcatttcagcagccaccgaagtttgacagtgatggaaatctgattgacgatcaaatcagagagaggctg

SEQ ID NO: 43048 - protein, 177 aa, Panicum virgatum
  misc_feature: Ceres CLONE 2014804
  misc_feature (10)..(176): Pfam Name: FMN_red Pfam Description: NADPH-dependent FMN reductase
  misc_feature: SWISSPROT Homolog: EC 1.6.5.2 NAD(P)H dehydrogenase (quinone)
MEAAAVKPVLRVAAICGSLRKASFNRGLLRAAAEVCDDSIPGLRVHHLDISDLPIINTDLETDGAFPPAVEAFRAKVSQADCFLFGAPEYNYSIATPLKNALDWASRGKNCWADKPAAIVSAGGGFGGGRSQYHLRQVGVFLDLHFINKPELFVQAFQQPPKFDSDGNLIDDQIRER

SEQ ID NO: 43049 - DNA, 693 bp, Panicum virgatum
  misc_feature: Ceres CLONE 2014813
  misc_feature: Encodes the peptide sequence at SEQ ID NO. 43050
agaacagaagacaaccagacttctgatccacaacaccacacttgctaggtagcgagacctgtcgagaggaaccaccgactggtgcgacatggagcaggggcagcacggccacggaaccaccggccgcgtcgaccagtacggcaacccggtcggcggcgtcgggcacggcaccgggaccgggaccgggaccgggaccggcggcatggggtacggtggtaccgccggaaccggcggcatgggccagctgggggagcacggtggcgccggcatgggtggcggccagttccagcctgcgagggaggagcacaagaccggcggcgtcctgcaccgctccggcagctccagctccagctcgtccgaggacgacggcatgggcgggaggaggaagaagggcattaaggagaagatcaaggagaaattgcccggaggccacaagaaggacgaccagcacaccacggccaccggcggtgcctacgggcagcagggacacaccggcaggaccggcatgggaaccggcggcgccgcatacaccgagggcaccggcgagaagaagggcatcatggacaagatcaaggagaagctgcccggacagcactaagcgcggcctgcgtagtacgcgcgagaagccgtgtgcttgtctgccccggcgttccgagataataaaatgaacccagcaggaatgaagtgtccttc

SEQ ID NO: 43050 - protein, 169 aa, Panicum virgatum
  misc_feature: Ceres CLONE 2014813
  misc_feature (11)..(169): Pfam Name: Dehydrin Pfam Description: Dehydrin
MEQGQHGHGTTGRVDQYGNPVGGVGHGTGTGTGTGTGGMGYGGTAGTGGMGQLGEHGGAGMGGGQFQPAREEHKTGGVLHRSGSSSSSSSEDDGMGGRRKKGIKEKIKEKLPGGHKKDDQHTTATGGAYGQQGHTGRTGMGTGGAAYTEGTGEKKGIMDKIKEKLPGQH

SEQ ID NO: 43051 - DNA, 632 bp, Panicum virgatum
  misc_feature: Ceres CLONE 2014821
  misc_feature: Encodes the peptide sequence at SEQ ID NO. 43052
gctagggatagggcaagctatgatccccaactcgtcgtcccctcctctcctcgtattctgaatctcgttcgcaatcgaattcggattcgattgggagggcaccccaccccgctgccgcctacatactatggttcacgccccgcgccgcccatcgccgtcgtcctcctcgccgatgctccacaggaacctccgcgccctcggccccggcttgaatcccttcgctcccttcggcatgggcaactactccctcgcttcctcctcccgctaatcatcttccgcgaatcctcctctcctccgattccgatctctccccgatggctgctgctgctaaatcccgtcccggctcgcgaatcgcctccccccatctgtttccttgctccattggtttggatctgagagccgacgcgggctacaagaatagcatggtgcaggtgcgcaggtcgctcagcatgacccgcctccggggctgccacgccgctgatgaccgtggctggaacccgctccatgttgccgctcgcaagggagacctcaaggaggttcgacgtctcctggatgaggggatggatgtcaatgcacctgcatggggaccgaaatctccgggtgctaccccactccatctggctgctcggggt

SEQ ID NO: 43052 - protein, 69 aa, Panicum virgatum
  misc_feature: Ceres CLONE 2014821
  misc_feature (22)..(54): Pfam Name: Ank Pfam Description: Ankyrin repeat
  misc_feature: SWISSPROT Homolog: EC 2.7.11.1 Non-specific serine/threonine protein kinase
MVQVRRSLSMTRLRGCHAADDRGWNPLHVAARKGDLKEVRRLLDEGMDVNAPAWGPKSPGATPLHLAAR

SEQ ID NO: 43053 - DNA, 672 bp, Panicum virgatum
  misc_feature: Ceres CLONE 2014830
  misc_feature: Encodes the peptide sequence at SEQ ID NO. 43054
agcagccgacgccggcgacagcagagagccccggtgtactcgtcgtcgcaagaatggccaagagtggcatcgtgtacgccgtggtggacgccttcacggcggagccgttcaagggcaacccggccgcggtctgcctcctccaggacgccgccaaggccgcggacgagcggtggatgcagtccgtcgccgccgagttcaacctctccgagaccgccttcctgctccgcgactcctcctcccccgccgccgccgccccgcggttccagctccgatggttcacccccgccgccgaggtcgagctctgcggccacgcgacgctggcctccgcccacttcctcttcacatccattctcgcggagcacgaggcgctcgttgaattcgcgaccaaatcggggattctcgccgccaagaaggtccctgcaccggcgagtgcggcggattcaggtgagggcaagctgttcatcgagctggatttccccatgattgacctcgtcgattgccatcctgccgagctgccgtccatccccgagaccctgaacggagcctctgttgtcagcgtccacaaatcggcgacagctggtgacctcattgtggagctttcatcaagaaaggaggttgccgatatcgtccctaagattcatgaaatttaggagtgttctggcagaggagtta

SEQ ID NO: 43054 - protein, 198 aa, Panicum virgatum
  misc_feature: Ceres CLONE 2014830
  misc_feature (5)..(197): Pfam Name: PhzC-PhzF Pfam Description: Phenazine biosynthesis-like protein
MAKSGIVYAVVDAFTAEPFKGNPAAVCLLQDAAKAADERWMQSVAAEFNLSETAFLLRDSSSPAAAAPRFQLRWFTPAAEVELCGHATLASAHFLFTSILAEHEALVEFATKSGILAAKKVPAPASAADSGEGKLFIELDFPMIDLVDCHPAELPSIPETLNGASVVSVHKSATAGDLIVELSSRKEVADIVPKIHEI

SEQ ID NO: 43055 - DNA, 515 bp, Panicum virgatum
  misc_feature: Ceres CLONE 2014842
  misc_feature: Encodes the peptide sequence at SEQ ID NO. 43056
ggggagaggcagggggtgatccaggagcggccgttcaagcacggcgagacactgcgcggggacgacgcgcggctgcggctggagctggacgtcgacgccgagctccggctggccagggactaccagctgcagctcgccggcgacgacgccgagcagaagaacgagaggaaggccatgaaggagctcggcctcgccagggcccgggagttcgggtggcccaacacgtacgtgttcaccaaggcgctgggggagatgacgctggcgcaggagctcggcggcggcggcgtgcccgtggccatcgtgcggcccagcatcatcaccagcatccagaaggacccgctgccggggtggatcgaggggacccggaccatcgacgccatcctcatcggctacgccaagcagaacctctcctgcttcctcgccgacctcgacctcaccatggatgtcatccccggggacatggtggtgaacgcgatgatggccgcggtggcggcgcacgcctcgccgccggcggc

SEQ ID NO: 43056 - protein, 171 aa, Panicum virgatum
  misc_feature: Ceres CLONE 2014842
  misc_feature (2)..(159): Pfam Name: NAD_binding_4 Pfam Description: Male sterility protein
GERQGVIQERPFKHGETLRGDDARLRLELDVDAELRLARDYQLQLAGDDAEQKNERKAMKELGLARAREFGWPNTYVFTKALGEMTLAQELGGGGVPVAIVRPSIITSIQKDPLPGWIEGTRTIDAILIGYAKQNLSCFLADLDLTMDVIPGDMVVNAMMAAVAAHASPPA

SEQ ID NO: 43057 - DNA, 683 bp, Panicum virgatum
  misc_feature: Ceres CLONE 2014868
  misc_feature: Encodes the peptide sequence at SEQ ID NO. 43058
ggagggagaaaaaaaaggaaggaaaatcgcgcgcgctgcttcccggatttttgtcgatttttttttcgggcccaaccgagctagaaagattcgccaagtacatctgatcttgtagcatagtaccctgtccttccatgccccaacagtgaaactgtctccgcccctttgctttgccgagaccagcagtaatggccgattcttgattgcccaaggcacgaccactcgaattttaaaaatgcaatcttagtgagcaaatgaacacacacccatccttatcgcagcatctcctcacgagaattcagcagcctcgttctcacaaatttcccccgctctcattgcagactctgcagaagctgacaagtcctccaagaattcaggcgcatcacgccagcaacaagacgacgaagcggcggaggtaaagggagaggggaggagcgagcgcatcggtttccgtcatggagggcggcgagacgacgctgtcggggttcggcggcggcggcggcggcggcgcggggcccggcggggacaccaaggtgctgcacgcgttccagacgagcttcgtgcaggtgcagagcctgctggaccagaaccgcgtcctcatcaacgagatcaaccagaaccacgagtccaaggtgcccggcgacctctcccgccggcggcggccgcgcggcgtccgagggcgg

SEQ ID NO: 43058 - protein, 75 aa, Panicum virgatum
  misc_feature: Ceres CLONE 2014868
  misc_feature: Functional homolog of the protein sequence given in SEQ ID NO 50381
  misc_feature: Useful for making plants with altered lignin content
MEGGETTLSGFGGGGGGGAGPGGDTKVLHAFQTSFVQVQSLLDQNRVLINEINQNHESKVPGDLSRRRRPRGVRG

SEQ ID NO: 43059 - DNA, 699 bp, Panicum virgatum
  misc_feature: Ceres CLONE 2014870
  misc_feature: Encodes the peptide sequence at SEQ ID NO. 43060
tgaagcgagtcgcccccgtttcatcacccccagaaaaaggcgagaaatccccaacggaaggagcagcagcgccagcagcagcagcagcagcagcgcaaattctttcctcctcatcttcgccgcgcttgcccacccggatcgaaacccctagggtttcgcatccgcctcccaccgcgtactacttcctctccccgtctccctccgccgcgcgcgcgcgcggggagccaccaaaccctaggacggcaaatccggtgcgatcgcccacggtggaggcctcgtcggcggccgagaggagccgctcagggctcgggtcagggttccggtacctcgccggcgccgcctccgggtggttggaccggtggatggtcatgggagccagcggctccaagctggagaaggccctcggcgaccagttcccggaaggcgagcgctacttcggcctcgagaacttcggcaacacctgctactgcaacagtgtcctccaggcactttatttttgcattccattcagggagcagttactggaatattacgcaaataacaaaaatccaggagacgcagaggaaaatcttttgacttgtttggctgacctttttatgcagataagccaagcaaagaaaaaaactggtgttattgctccaaaacgttttgttcagagagtgaagaaacagaatgagttgtttcgtagctacatgcacc

SEQ ID NO: 43060 - protein, 112 aa, Panicum virgatum
  misc_feature: Ceres CLONE 2014870
  misc_feature: SWISSPROT Homolog: EC 3.1.2.15 Ubiquitin thiolesterase
MVMGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYMH

SEQ ID NO: 43061 - DNA, 617 bp, Panicum virgatum
  misc_feature: Ceres CLONE 2014903
  misc_feature: Encodes the peptide sequence at SEQ ID NO. 43062
gatgcaggtcattatatatggagaatgcattgctccgacactggacacactaaagcgcgcgatcaggtccggtgatggcaccatcttagcaacctccccaccttacacccggttcctcaagtccagcattgattttgctattgtatctgccggcatgccaagcgtggacgcatgggtacaggagttcgtgaggcataacatcccgtgcatcagcgcagattacctggtggagtatgtgtgcaagcccgggcaccccctgagcaagcatgtcctcttcagcatgcacgatctagcagagaagtccctgcagaagctactgaagaaccaagaagacgtgatggatgctgacactggagagaacagcgaggctgatgtaggttgttctacctgcggatcacaggaccaggaagggcttatggtaacatgcagcagcggtggaaaccaggccggctgtggtgtccgcgtgcacgtgggttgctgcaaccctcccgttgaagcagccataggtggtgagtggctgtgcggcaagtgcgacaagcaaaaatctgcaaagaagtctgctgggaaaccaagagtgctcaaaacctgatgatttttcagggggtatcacaagcccc

SEQ ID NO: 43062 - protein, 195 aa, Panicum virgatum
  misc_feature: Ceres CLONE 2014903
  misc_feature (126)..(180): Pfam Name: PHD Pfam Description: PHD-finger
MQVIIYGECIAPTLDTLKRAIRSGDGTILATSPPYTRFLKSSIDFAIVSAGMPSVDAWVQEFVRHNIPCISADYLVEYVCKPGHPLSKHVLFSMHDLAEKSLQKLLKNQEDVMDADTGENSEADVGCSTCGSQDQEGLMVTCSSGGNQAGCGVRVHVGCCNPPVEAAIGGEWLCGKCDKQKSAKKSAGKPRVLKT

SEQ ID NO: 43063 - DNA, 402 bp, Panicum virgatum
  misc_feature: Ceres CLONE 2014909
  misc_feature: Encodes the peptide sequence at SEQ ID NO. 43064
acaccatcccacacacaaaccagacagcagaaggtggtgccaagcaccagctagagctgctcatacagcctgaagctcatccttctggctactgcaagcatggacgccgcgctcttctccttcagggccgtggcgctcgccgcactcctactcgccatgatcgccgcctgcggcgcccgcgcccagctgcagcccaccaacgcctccgccgactcccaggagagatcctcgctgtcctacagccgcggctggatccctgccaatgccacctggcgacggtgcgcccaccggcgccggctccgacgacaacgggggcgcgtgcggcttcaagcacaccaaccagtaccccttctccaccatgacgacctgcagcaacgagcccatctacgaagacggcaaggg

SEQ ID NO: 43064 - protein, 46 aa, Panicum virgatum
  misc_feature: Ceres CLONE 2014909
  misc_feature: Functional homolog of the protein sequence given in SEQ ID NO 51402
  misc_feature: Useful for making plants with altered carbohydrate content
MPPGDGAPTGAGSDDNGGACGFKHTNQYPFSTMTTCSNEPIYEDGK

SEQ ID NO: 43065 - DNA, 631 bp, Panicum virgatum
  misc_feature: Ceres CLONE 2014914
  misc_feature: Encodes the peptide sequence at SEQ ID NO. 43066
atatccagttttgcgagttgccgagacccccaacaacaacaagttgtctccctctccatagggcgtatcggccgccactaactgcagacccccaccgccgccgctagggtttagaagggagaggatcaccgctgatgtcgacgcctgcgaggcgcggctccttccgccgcggccccccaccccccggcaccggctacgtgcgccgcggcccccccgccgacgccgccaagtcccgcggccccgccgcgccggtgcccctgcgcaagcccgtcttcaccaccatcgaccggctgcgcccccagacgcacggccacaccctcaccgcccgcgtcctctccgcccgcgccgtcctcgagaagcactccccgcacctcggacgcacccgcgtcgccgagtgcctcgtcggagaccacaccggcaccatgctcgtcacgacgcgcaacgaccagattgaccttgtgaagccggatacgacagtcatcttccgcaacgcctagattgacatgttcgaggggaccatgaggctggcagtcgacaagagggggaggattgaggtgactgacgctgctgatttgaaggtgaaggaagacaactgcatgtcgctggtggagtacgagctggtggacgtggc

SEQ ID NO: 43066 - protein, 42 aa, Panicum virgatum
  misc_feature: Ceres CLONE 2014914
  misc_feature: Functional homolog of the protein sequence given in SEQ ID NO 50161
  misc_feature: Useful for making plants with modulated drought sensitivity
  misc_feature: Useful for making plants with modulated water use efficiency
MFEGTMRLAVDKRGRIEVTDAADLKVKEDNCMSLVEYELVDV

SEQ ID NO: 43067 - DNA, 656 bp, Panicum virgatum
  misc_feature: Ceres CLONE 2014921
  misc_feature: Encodes the peptide sequence at SEQ ID NO. 43068
ctcatcaaccatccagatgagatgcgcaagctccaagaggagatacgcaccaccatctatggcggcggtgacaaccagcaaatcaccgaggaccacctcggcaagctgcgccgcctcaagccggtgctcaaggagacgctccgtctgcacatgccgtcgccgctcgtgctgcgggagacggtcgaggacaccgagctgctcggctactacgttccggcacgcacccgtgtcatcatcgacgtcggggccatcgcacgggaccccgccacctgggagcgcgccgaggagttcttgccggagcggtggttcggggacgatggcgggcccctggccactgcggcggtggcggggcaggacttcacattcttgccgttcggtggcgggcggagagggtgccctggtgctgcgtttggcatggcgagcgtcgacctggtgctgacgagcctgctgtaccacttcgactgggagctaccggccggtggggcgtccacggtcgacatggatgaggtgggtggattggccgtgcggttgaagaaacctctgtgtccggtcgctaagccatggtctccttagtaagatccatcatggtgtggtctatcctactcataatcatcaggaaattaaataaagagcttaattatccgcacgggccacgt

SEQ ID NO: 43068 - protein, 190 aa, Panicum virgatum
  misc_feature: Ceres CLONE 2014921
  misc_feature: SWISSPROT Homolog: EC 1.14.13.68 4-hydroxyphenylacetaldehyde oxime monooxygenase
LINHPDEMRKLQEEIRTTIYGGGDNQQITEDHLGKLRRLKPVLKETLRLHMPSPLVLRETVEDTELLGYYVPARTRVIIDVGAIARDPATWERAEEFLPERWFGDDGGPLATAAVAGQDFTFLPFGGGRRGCPGAAFGMASVDLVLTSLLYHFDWELPAGGASTVDMDEVGGLAVRLKKPLCPVAKPWSP

SEQ ID NO: 43069 - DNA, 629 bp, Panicum virgatum
  misc_feature: Ceres CLONE 2014937
  misc_feature: Encodes the peptide sequence at SEQ ID NO. 43070
ggattacctgtacaagtttatgcttcggatgaaagatgaatcgggtgctttcagaatgcatgatggtggtgaaattgatgttcgggcttcctatactgctatatcgatgtcaaacttatgaaggtggtattgctggggagcctcatgctgaagctcatggtacacgttctgtggattggctgctttgatcctgcttaatgaggcagagaaacttgacttgccttgcttgatcgactgggtggcatttcgtcaaggagtggaatgtggatttcaaggacgaactaataaattggttgacggttgctactccttttggcagggtgctgccattgctttaacacaaaagctggttatgattattgacgagcaattgaaattatcatactcctgcaaaaagccatcaggagaggatgcatgtggcactagttcatctgggtgcacttcagaaaaatcttcctctgctgtcgattatgcaaagtttggatttgattttatacaacggagcaaccaaattggcccactgttccacaacattgccctgcaacaatacatcctgctttgtgctcaggttctagagggaggattgagggataagcctggaaagaacagagatcactaccactcgtgct

SEQ ID NO: 43070 - protein, 39 aa, Panicum virgatum
  misc_feature: Ceres CLONE 2014937
  misc_feature: SWISSPROT Homolog: EC 2.5.1.58 Protein farnesyltransferase
  misc_feature: The sequence is a functional homolog of SEQ ID NO 12 in US patent 7109391
  misc_feature: Functional homolog of the protein sequence given in SEQ ID NO 51662
  misc_feature: Useful for making plants with modulated water use efficiency
DYLYKFMLRMKDESGAFRMHDGGEIDVRASYTAISMSNL

SEQ ID NO: 43071 - DNA, 579 bp, Panicum virgatum
  misc_feature: Ceres CLONE 2014942
  misc_feature: Encodes the peptide sequence at SEQ ID NO. 43072
gagcccgctcgcacaggcgcgagatggcctgtatcgagcggccccgccgccgccctccgccggaccccgtcgccgtgctccgcggccaccgcgccgccgtcaacgacgcctgcttccacccctccctcccgctcctcttctccggcgcggccgacggggagctcagggcctgggataccgcgagccaccgcaccgcctcctcggtctgggctcatgccggaacggccggggtgtactcggtggctgctgctgccggactgggaaacaagatcatcagccagggtagggatggaacttgtaaatgctgggtgattgaagaagctggcctttcacggaggcccatatttacagtcaaaacaagcacataccatttctgcaagatgtcacttgtaaagtctccttcctttacccattccgtgagattgagctcaagctgtgaaactagtgatgtagagccaccaagagaaggcactgaagaaaatacagaatctcatgttgtaaagcctacagaagatccccaagaacatggagaaggctttacctctagtggacaaactatgatggcaattgctggtcaaa

SEQ ID NO: 43072 - protein, 185 aa, Panicum virgatum
  misc_feature: Ceres CLONE 2014942
  misc_feature (13)..(51): Pfam Name: WD40 Pfam Description: WD domain, G-beta repeat
MACIERPRRRPPPDPVAVLRGHRAAVNDACFHPSLPLLFSGAADGELRAWDTASHRTASSVWAHAGTAGVYSVAAAAGLGNKIISQGRDGTCKCWVIEEAGLSRRPIFTVKTSTYHFCKMSLVKSPSFTHSVRLSSSCETSDVEPPREGTEENTESHVVKPTEDPQEHGEGFTSSGQTMMAIAGQ

SEQ ID NO: 43073 - DNA, 1396 bp, Panicum virgatum
  misc_feature: Ceres CLONE 2014949
  misc_feature: Encodes the peptide sequence at SEQ ID NO. 43074
gggcggcagtctgcttcacgcttcaatccttcatcgaccgaaacagagttgtggcttgtggggggtcagaccgacagaggccatggagagctcgccgcccaccatcaccgtccaggtcaagttcgccgggcggaccatccccgtcgaggtaccggccgccgcgaccaccgcggagctgaagcgcctcctccagccgctcaccaacgtcctcccccgcggccagaggcttgtctgcaaaggcaaagtgctccaggacgccgcgagcctgagctcgatgcaggtggtagacggatccaaggtcatgctcatcgcctcgcagggtctccatcagggggatggccccatcaccaagaatagcagcagttctgcaacaagtgtaacaagagcctcgaatgttaaggaacgtcaaacacaaaaaccagaggcagttgttggcaaaagccgagctgagcgatggaaattgatgggcgttgttgcactgcatgactgcgacttgaaggcagtgccagaagaagtctgggactgtggcccctcagtacggatattagatgccagcaacaactgtataaaggaaattccgcataaaattgctgctcttaaatctctaaataaagtgctcctaactgccaatgatatagatgatgagaacatcagctgggaaggtctatcatgccttcaaaaattgttaaacctgtctttaagccagaaccgactggttagcttaccatcaactttgggctcactgacttctctgcgtgaacttcgtattgcaaacaacaggcttgataacttgcctatcgaaataggatcgctgaagcatctccagattctgatagcaaataacaataggatagccacattgccttcatctataggagattgtgaatctctcactgaggttgacttgtcatcaaatctcttaactgaactgccagaggcctttggtaagctttacaatctcaaggttttgcatctaaggaacaatggtcttacatccctaccttcgacgttatttaaaaagtgtatgcagcttattacacttgatctccatggaacagaaatcacaaatgatattcttcggcaggtggaggggtgggaggagttcgacgagcgtcggcggcagaaacatcagaagcagctagacttccgtgtaggctcatctggtgtgttcgatgaaggcgccgatgacgataacaggcgtaggtagtaatttattgcctgttgcgagcaagatcatctgctctgtatctggcttttgtcccagataaactgtacaactcagaacacagttttagtgctcgacatgaaaagctttgttactcagtcacaggatagatgttcttaagaaatgcatgacgctgctgaatatttttttgtagcactcagcctagacccc

SEQ ID NO: 43074 - protein, 374 aa, Panicum virgatum
  misc_feature: Ceres CLONE 2014949
  misc_feature (13)..(80): Pfam Name: ubiquitin Pfam Description: Ubiquitin family
  misc_feature: SWISSPROT Homolog: EC 2.7.11.1 Non-specific serine/threonine protein kinase
MESSPPTITVQVKFAGRTIPVEVPAAATTAELKRLLQPLTNVLPRGQRLVCKGKVLQDAASLSSMQVVDGSKVMLIASQGLHQGDGPITKNSSSSATSVTRASNVKERQTQKPEAVVGKSRAERWKLMGVVALHDCDLKAVPEEVWDCGPSVRILDASNNCIKEIPHKIAALKSLNKVLLTANDIDDENISWEGLSCLQKLLNLSLSQNRLVSLPSTLGSLTSLRELRIANNRLDNLPIEIGSLKHLQILIANNNRIATLPSSIGDCESLTEVDLSSNLLTELPEAFGKLYNLKVLHLRNNGLTSLPSTLFKKCMQLITLDLHGTEITNDILRQVEGWEEFDERRRQKHQKQLDFRVGSSGVFDEGADDDNRRR

SEQ ID NO: 43075 - DNA, 667 bp, Panicum virgatum
  misc_feature: Ceres CLONE 2014983
  misc_feature: Encodes the peptide sequence at SEQ ID NO. 43076
gatgagtaggagggcgcggcggccgctgcaaaacccggggcgcgagcctgggcggagcggccgtcggtgcagatcttggtggtagtagcaaatattcaaatgagagatctgtatcctcagcgagtggctaccatcgcaactcctgcctagtcagctcgtcccggcaacctcccttcccaccgccacaatgtcgggcaacatcgccttcggccggtttgatgactccttcagcgcggcctcaatcaaggcctacatcgccgagttcatctccaccctcgtcttcgtcttcgccggcgtcggctccgccatcgcctacaccaagttgtccggtggcgcgcctcttgacccttcgggtctgatcgccgtggcggtgtgccacgggttcgggctcttcgtcgcggtcgccatcggcgccaacatctccggcggccacgtcaaccccgccgtcaccttcggcctcgccctcggcggccagatcaccatcctcaccggcatcttctactggatcgcccagctcctcggtgccatcgtcggcgccgtcctcgtccagttctccaccggcgtggcgaccccgacccacggcctctccggcatcggcgcgttcgagggcgtcgtgatggagataatcgtcaccttcggcctcgtctacaccgtgtacgccaccgcg

SEQ ID NO: 43076 - protein, 159 aa, Panicum virgatum
  misc_feature: Ceres CLONE 2014983
  misc_feature (12)..(159): Pfam Name: MIP Pfam Description: Major intrinsic protein
MSGNIAFGRFDDSFSAASIKAYIAEFISTLVFVFAGVGSAIAYTKLSGGAPLDPSGLIAVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYAT

SEQ ID NO: 43077 - DNA, 577 bp, Panicum virgatum
  misc_feature: Ceres CLONE 2014989
  misc_feature: Encodes the peptide sequence at SEQ ID NO. 43078
atctcctgtacgtgtatccaatagaaaggcaaaatggctttggaggtacaagtcatagagtcttcgtttgtagcgccgagcgaggcaatgccgcagaagggcctacggatctcctccctcgacgccagtctggccgacagaggccacattccaacaatctacttctaccgctccgctgttgccgccactgtcaacttgttcgacgcgagcgtcagactcaaggagtccttggccaaggccctggtggctttctaccccttcgccggccgccttgacgtcgacgaccatggcataacacagatcaactgcaacagtgagggcgcgctctttgttgtcgctcgctctgagcttgccgctgatgacgtcatcgactcgatgccatcgacggagctgaggaggcggtttgttcctcacattgagcctccgtctactatactggccatacaggtgacgtttctgaagtgcggtgggatagtgatggggacggccctccaccatgtctccatggatgcccttggagcctttcacttctgtccagacgtggtcggccttctccagagacggcgacggagctgcc

SEQ ID NO: 43078 - protein, 181 aa, Panicum virgatum
  misc_feature: Ceres CLONE 2014989
  misc_feature: SWISSPROT Homolog: EC 2.3.1.144 Anthranilate N-benzoyltransferase
MALEVQVIESSFVAPSEAMPQKGLRISSLDASLADRGHIPTIYFYRSAVAATVNLFDASVRLKESLAKALVAFYPFAGRLDVDDHGITQINCNSEGALFVVARSELAADDVIDSMPSTELRRRFVPHIEPPSTILAIQVTFLKCGGIVMGTALHHVSMDALGAFHFCPDVVGLLQRRRRSC

SEQ ID NO: 43079 - DNA, 634 bp, Panicum virgatum
  misc_feature: Ceres CLONE 2014998
  misc_feature: Encodes the peptide sequence at SEQ ID NO. 43080
gatgaaggtatttcatatcacagtctttctgggaggcacaagagtctgtacagtatatactccaagatgataaagaagaacttaacaatggatgatgtccatgacatccatggcctgcggcttgtggttgagacagatcaagattgttatagagcacttgacattgtccacaaactgtggcctcgagtcactggaagattcaaagattatatatcacatccaaagctgaatgggtatcgatcattgcgcactgtcatcatgtgtgagggtgtccatccatttgagatccagatccgaacaaaggaaatgcatctgcaggcagaatatggatttgctgcacactggaggtacaaagaaggtggttgcaggcactcctttgtgctccaaatggttgaatgggcaaggtgggtgctcacgtggcaatgcgaggcaatgagcaaagagtggccctcagctttagccagctctgttggggttaggccaccatgtcctttccccctgcattcagaggattgcccttattcttacagccggcagtgtaatcatgaaggtcccatatttgtgatcatgcttgaacatgataagatgtctgtccaagagctcccggcaaactcgactgtagttgatctaatgg

SEQ ID NO: 43080 - protein, 211 aa, Panicum virgatum
  misc_feature: Ceres CLONE 2014998
  misc_feature (11)..(121): Pfam Name: RelA_SpoT Pfam Description: Region found in RelA / SpoT proteins
  misc_feature: SWISSPROT Homolog: EC 2.7.6.5 GTP diphosphokinase
DEGISYHSLSGRHKSLYSIYSKMIKKNLTMDDVHDIHGLRLVVETDQDCYRALDIVHKLWPRVTGRFKDYISHPKLNGYRSLRTVIMCEGVHPFEIQIRTKEMHLQAEYGFAAHWRYKEGGCRHSFVLQMVEWARWVLTWQCEAMSKEWPSALASSVGVRPPCPFPLHSEDCPYSYSRQCNHEGPIFVIMLEHDKMSVQELPANSTVVDLM

SEQ ID NO: 43081 - DNA, 651 bp, Panicum virgatum
  misc_feature: Ceres CLONE 2015000
  misc_feature: Encodes the peptide sequence at SEQ ID NO. 43082
gtctcagcttggcatgtggttcatctgatgggaacatttcagtcttcactgctcgttctgatggaggttgggacacgacacgcattgatcaggggcatccagtaggagtgacctcagtctcttgggctccggcgatggcacccggtgctctaatcagtgcaggaccttctggccaatatgaatatgttcagaaactcacgtctggtggctgcgacaacacggtcaaggtgtggaagctcaccaacggaagctggaggatggattgtttccctgcactgcaaatgcacaaggactgggtgagagattttgcgtgggcgccaaatcttggcctcccaaagtccaccatcgccagcgcctctcaggatggaacggtggttatctggacatcagcgaaagaaggtgagcagtgggaaggtcgggtcctgtatgatttcagaacccctgtgtggaggctgtcgtggtcgctgacagggaatatactggctgtgtctgatggcaacaacaatgtgaccctgtggaaggaagctgtggatggtgaatggcagcaagttactactgttgagccatagatttctggagctcttctctcatatattattgcaataatgtagttttcctgtaatctgagtctatggcacagtagcagttagc

SEQ ID NO: 43082 - protein, 188 aa, Panicum virgatum
  misc_feature: Ceres CLONE 2015000
  misc_feature (23)..(78): Pfam Name: WD40 Pfam Description: WD domain, G-beta repeat
  misc_feature (86)..(128): Pfam Name: WD40 Pfam Description: WD domain, G-beta repeat
LSLACGSSDGNISVFTARSDGGWDTTRIDQGHPVGVTSVSWAPAMAPGALISAGPSGQYEYVQKLTSGGCDNTVKVWKLTNGSWRMDCFPALQMHKDWVRDFAWAPNLGLPKSTIASASQDGTVVIWTSAKEGEQWEGRVLYDFRTPVWRLSWSLTGNILAVSDGNNNVTLWKEAVDGEWQQVTTVEP

SEQ ID NO: 43083 - DNA, 695 bp, Panicum virgatum
  misc_feature: Ceres CLONE 2015016
  misc_feature: Encodes the peptide sequence at SEQ ID NO. 43084
atcagcatctctaccgtactagaaagtgaacgaaatggcttccgtccacctcctcccgctcgtcgtcctcctactcgcggccgctgccgacgcggccaccttcaccgtgaccaacaactgcccgtacaccgtgtgggcagcggccgtgccgggcggcgggcagcagctggacaacggggcgacgtggagcatcgacgtgccggcggggacaacgggcggccgcgtgtgggcgcgcacgggctgctccttcgacggcagcggcaacgggcggtgccagacgggggactgcggcggcgtgctgcgctgcacgcagtacgggcagccgcccaacacgctggccgagttcgggctgaaccagttccaggggctcgacttcatcgacatctccctggtggacggcttcaacgtgcccatggacttcctgcccgccggcggcggctccgggtgcgccaagggcgggccgcggtgcgacgccgacgtcgcggcgcagtgccccgccgcgctgcaggcccccggcggctgcgacaacccgtgcaccgtgttcaagaccgacgagtactgctgcaccggcccggcggcgaacagctgcgggcccacggactactccaggttcttcaaggggctgtgcccggacgcctacagctaccccaaggacgacgacaccagcacctacacttgccccggcggcaccaact

SEQ ID NO: 43084 - protein, 220 aa, Panicum virgatum
  misc_feature: Ceres CLONE 2015016
  misc_feature (27)..(220): Pfam Name: Thaumatin Pfam Description: Thaumatin family
MASVHLLPLVVLLLAAAADAATFTVTNNCPYTVWAAAVPGGGQQLDNGATWSIDVPAGTTGGRVWARTGCSFDGSGNGRCQTGDCGGVLRCTQYGQPPNTLAEFGLNQFQGLDFIDISLVDGFNVPMDFLPAGGGSGCAKGGPRCDADVAAQCPAALQAPGGCDNPCTVFKTDEYCCTGPAANSCGPTDYSRFFKGLCPDAYSYPKDDDTSTYTCPGGTN

SEQ ID NO: 43085 - DNA, 698 bp, Panicum virgatum
  misc_feature: Ceres CLONE 2015017
  misc_feature: Encodes the peptide sequence at SEQ ID NO. 43086
atcagcgtagcaggcaacagcaatctcgaggagcaggtagtagagcgctaagcttccggtgcgtggatcgaatagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgctcgctccttcggccccgccgtcgccgcgggcaacttcgccggcaactgggtctactgggtc

SEQ ID NO: 43086 - protein, 203 aa, Panicum virgatum
  misc_feature: Ceres CLONE 2015017
  misc_feature (11)..(203): Pfam Name: MIP Pfam Description: Major intrinsic protein
MVKLAFGSVGDSFSATSIKAYVAEFIATLLFVFAGVGSAIAYGQLTHGGALDPAGLVAIAIAHALALFVGVSIAANISGGHITILTGLFYWVAQLLGASVACLLLKFVTHGKAIPTHGVAGISALEGVVFEIIITFALVYTVYATAADPKKGSLGTIAPIAIGFIVGANILAAGPFSGGSMNPARSFGPAVAAGNFAGNWVYW

SEQ ID NO: 43087 - DNA, 654 bp, Panicum virgatum
  misc_feature: Ceres CLONE 2015065
  misc_feature: Encodes the peptide sequence at SEQ ID NO. 43088
gagaggacccgtggaagcagaatcaaggaggtggagcgccatggcgggctccgatccccccctcgcgcgtccagaggttgcgatctgaattgaccgctcatctgaattccaaaacgcagcacacctgctgtagtgaacaagccaagaatgggatgcatccagtagccactgctgctaacaagcagaggttgggattggatggttgctacttgctaactgatcttttgggaaaacttgggttgcaggattagccatcgtgatcatgggagtcagcggctgcggcaaatcaaccgtcgcggcactgcttgctgaagccctgggttgcagcttcatcgaagcagacgactaccattcccaggaaaacaaagcgaagatgagcaagggcatcccgctctccgacgccgaccgcacgccatggctggaatccctccaagacgccatccgggagcgactcgacggcggtgagaacgtggccgtcagttgctcggcgctgcggctcaagtacagggaggtcatccgggcggctgaccggagctacaagccgggggactacgccacctgcagggtgaagttcgtgtgcctgaggacgtcggcagaggtgatcaccgagaggatgcagaggaggtcaagcgaagggaaacacttcatgccggc

SEQ ID NO: 43088 - protein, 130 aa, Panicum virgatum
  misc_feature: Ceres CLONE 2015065
  misc_feature (4)..(130): Pfam Name: SKI Pfam Description: Shikimate kinase
  misc_feature: SWISSPROT Homolog: EC 2.7.1.12 Gluconokinase
MGVSGCGKSTVAALLAEALGCSFIEADDYHSQENKAKMSKGIPLSDADRTPWLESLQDAIRERLDGGENVAVSCSALRLKYREVIRAADRSYKPGDYATCRVKFVCLRTSAEVITERMQRRSSEGKHFMP

SEQ ID NO: 43089 - DNA, 636 bp, Panicum virgatum
  misc_feature: Ceres CLONE 2015133
  misc_feature: Encodes the peptide sequence at SEQ ID NO. 43090
agaaatggccgcgtcccactgaacccgactgctgccgctctagctcacgggcaccgcaatggccacggccgtcgccgcatccgctttcctctcctcgtccttcgccccccgccaccatcaccgccgcttggccaggcccgtgacgcgccgcgccgccactgcgggactggccgtgcggtgcgagcagagcgacaagcagaagaggcagccgctcgccgcgctcgtgccccgcgagcagcgcttcatgttcgagggcgacgagctctgcggccccgacatatggaataccacatggtatcctaaggctgcagatcatgtaaccacagagaagacatggtatgttgttgatgcaacagataagattctaggcaggctagcatccaccattgcagtacatatcaggggaaagaatgaacccacgtacactcccagtgtggacatgggcgcttttgttattgtggtcaatgcagagaaggttgctgtttctggtaaaaagcggtcgcagaagctctataggaggcactctggacggcctggagggatgaaagaagaaacttttgaccaacttcagaaaaggattccagaaagaatcatcgaacatgcagtgcgtggcatgcttcccaagggcaggctggg

SEQ ID NO: 43090 - protein, 192 aa, Panicum virgatum
  misc_feature: Ceres CLONE 2015133
  misc_feature (93)..(192): Pfam Name: Ribosomal_L13 Pfam Description: Ribosomal protein L13
MATAVAASAFLSSSFAPRHHHRRLARPVTRRAATAGLAVRCEQSDKQKRQPLAALVPREQRFMFEGDELCGPDIWNTTWYPKAADHVTTEKTWYVVDATDKILGRLASTIAVHIRGKNEPTYTPSVDMGAFVIVVNAEKVAVSGKKRSQKLYRRHSGRPGGMKEETFDQLQKRIPERIIEHAVRGMLPKGRL

SEQ ID NO: 43091 - DNA, 1148 bp, Panicum virgatum
  misc_feature: Ceres CLONE 2015142
  misc_feature: Encodes the peptide sequence at SEQ ID NO. 43092
aaacaagccaagaatccaccaccaccaccaccggcgccggcaagcaaggagccaggtttcgcttccgtcgctccgtgcatatctctccgattcagcgccggcagggaggcagcggcgcagccaaagccatggcggtggacctcatgtcctgcggcagcggcggcggcggcgcgtacgagcacctcgcgttccaggaggccgccgcggcggggctccgcagcctggagctgctggcgtcctcgctctccccgcgcgccgccgggcgcgccgagtccccgccgctgggccagatcgccgaccaggcggtctcccgcttccgccgcgtcatcaacctgctcgaccgcacgggccacgcccgcttccgccgcgcgccggccgcgccgcccgcgacgccccccgagtctcctcgcccggcgcccgtctcgcagcccccggcggcggttgccccgcggacgacgagcctcacgctggacttcaccaagccggcgccccctgcgccggcggcgtccgcgacgtcgacgtccttcctgtcgtccgtgacggcgggcggcgagggcagcgtgtccaaggggtgcagcctggcggccgtgtcctccggcaagccccccctgccaaagcgcaagcaccccgcctccgccgccgcccccgccgcgcaccaccaccacgccgaacccggcgccgcgcggtgccactgctcgaagaagccgaagcggagccggcacgggctgtcctgccgcacggtgcgcgtgcccgccgccgcgggggcccacgcgccgtcgtcctccgacatccccggcgacgagtactcgtggcgcaagtacgggcagaagcccatcaaggggtccccgttcccgcgcggctactaccggtgcagcaccgccaaggggtgccccgcgcggaagcacgtggagcgcgccgccgacgaccccgccacgctcgtcgtcacctacgagggcgaccaccgccacgacgccgccgccggcgccgcgcagtgaaggatcaccggaccggatcaccgttagtcctagcagtagctctagcacgcttgttcgatttgttctttgggttagcggtagacggtcgcgctcgtgctgtcttcttctttctttgtaaagaaaaccaccaatcaaatcaaagagagcctctcc

SEQ ID NO: 43092 - protein, 288 aa, Panicum virgatum
  misc_feature: Ceres CLONE 2015142
  misc_feature (222)..(282): Pfam Name: WRKY Pfam Description: WRKY DNA -binding domain
  misc_feature: The sequence is a functional homolog of SEQ ID NO 528 in the 10/374,780 US patent application
  misc_feature: The sequence is a functional homolog of SEQ ID NO 676 in the 10/412,699 US patent application
MAVDLMSCGSGGGGAYEHLAFQEAAAAGLRSLELLASSLSPRAAGRAESPPLGQIADQAVSRFRRVINLLDRTGHARFRRAPAAPPATPPESPRPAPVSQPPAAVAPRTTSLTLDFTKPAPPAPAASATSTSFLSSVTAGGEGSVSKGCSLAAVSSGKPPLPKRKHPASAAAPAAHHHHAEPGAARCHCSKKPKRSRHGLSCRTVRVPAAAGAHAPSSSDIPGDEYSWRKYGQKPIKGSPFPRGYYRCSTAKGCPARKHVERAADDPATLVVTYEGDHRHDAAAGAAQ

SEQ ID NO: 43093 - DNA, 705 bp, Panicum virgatum
  misc_feature: Ceres CLONE 2015146
  misc_feature: Encodes the peptide sequence at SEQ ID NO. 43094
gccacctcggtcgttgagccgtacaactccatcctgaccacccacaccaccctcgagcacgccgactgctccttcatggtcgacaacgaggccatctacgacatctgccgccgcaaccttggtctcgagcgccccaacttcgagaacctcaaccgcctgattgcccaggtcgtttcctccatcaccgcgtcgctgcgcttcgacggctcgctcaacgtcgacctgaacgagttccagaccaacctggtcccctacccccgtatccacttcccccttgtcgcctacgcgcccgttgtctcggccgccaaggccgcccacgaggccaactcggtccaggagatgaccatgtcctgcttcgagcccaacaaccagatggtcaagtgcgacccccgtcacggcaagtacatggccacctgtctgctgtaccgcggcgacgtcgtccccaaggacgcccacagcgccgtcgcgaccctcaagaccaagcgcaccatccagttcgtcgactggtgcccgactggtttcaagctcggtatctgctaccagccccctcaccaggtccccaacggcgacctcgccaaggccaaccgcgcggtgtgcatgctttccaacaccactgccattgccgaggcctggtctgccctttccagcaagttcgatctcatgtactcgaagcgcgctttcgtgcactggtacgtcggcgagggt

SEQ ID NO: 43094 - protein, 234 aa, Panicum virgatum
  misc_feature: Ceres CLONE 2015146
  misc_feature (71)..(216): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
ATSVVEPYNSILTTHTTLEHADCSFMVDNEAIYDICRRNLGLERPNFENLNRLIAQVVSSITASLRFDGSLNVDLNEFQTNLVPYPRIHFPLVAYAPVVSAAKAAHEANSVQEMTMSCFEPNNQMVKCDPRHGKYMATCLLYRGDVVPKDAHSAVATLKTKRTIQFVDWCPTGFKLGICYQPPHQVPNGDLAKANRAVCMLSNTTAIAEAWSALSSKFDLMYSKRAFVHWYVGE

SEQ ID NO: 43095 - DNA, 873 bp, Panicum virgatum
  misc_feature: Ceres CLONE 2015151
  misc_feature: Encodes the peptide sequence at SEQ ID NO. 43096
atcagggccagccagcgcacgcgaacgtacacctacctcgtcgagcgaacgcaagaggcccaatcgaactcgaagcaacgagaccaccagccatggccgcggcggctccccgccacgccgcgctcctgctcgccctgctgctgctcggcatcctctccaccgccgccctcgccgcgcgcgcccgcgccgtggacgccgagctcgtcacgtccgccaagaagcccgcccccgcggggcccaccaagaagccagccgtcaggccgccgcccgcggtgcccagccccggcgcgggcgcgggaggcgtcggcggcgcgatcccgaccatcccgggcttcggcggcggcatccccgggatgggcgggttcgggaacggcatccccgggatggccggcgggtggggcggcggctacggcgggccggcgggcgggtacgcccgcggcggcgtggtggcgcccacggtcacctgcaccgagaaggggccctgctacaggaagaaggtcacctgccccaagaagtgcttctcctcctacagcggcgccggcaaggggtacggtggcggcggcggcgggggcagctgcaccgtcgactgcaaggtcaagtgcacggcgtactgttgatcggctcacctcgcccgtcgccgcgcagcagggagcttcgtggccagcttgctgctggtgtgaccgcgcgcgtcggtgggctgagttgttattgttaactgcagggttgtaacagtactagcgtacttccgggctccatgtttggttgagatgctctgcttatggtgcgtaatcgtctacattatgctcctgtacttctcgtaaagttgtccgtatgaaatccactatgaatcaataaagagcttcataaacatac

SEQ ID NO: 43096 - protein, 174 aa, Panicum virgatum
  misc_feature: Ceres CLONE 2015151
  misc_feature (1)..(162): Pfam Name: GRP Pfam Description: Glycine rich protein family
MAAAAPRHAALLLALLLLGILSTAALAARARAVDAELVTSAKKPAPAGPTKKPAVRPPPAVPSPGAGAGGVGGAIPTIPGFGGGIPGMGGFGNGIPGMAGGWGGGYGGPAGGYARGGVVAPTVTCTEKGPCYRKKVTCPKKCFSSYSGAGKGYGGGGGGGSCTVDCKVKCTAYC

SEQ ID NO: 43097 - DNA, 679 bp, Panicum virgatum
  misc_feature: Ceres CLONE 2015182
  misc_feature: Encodes the peptide sequence at SEQ ID NO. 43098
aggcactgccgcggcgggcatgccaagctgggaggcgcagtgaagtaaccaggtggtgctggtttgtgaggaggaggaggtgcggccggcgggggaggaaggaagcaaggaagtcggccagggggagagatgagtgcggcggcggcgagctcggtcgccaagttcatcaagtgcgtcaccgtcggggacggtgccgtggggaagacctgcatgctcatctgctacacctgcaacaagttccccacggattacatccccactgtattcgacaacttcagtgccaatgtctcggtggatgggagcatcgtcaacttgggcctctgggacacggcaggtcaggaggattacagcagattgaggcctcttagctacaggggtgcggatgtgttcatcctctccttctctctggtcagcagggcaagctatgagaatgtcttgaagaagtggatgccagagcttcgccgattttcacctaccattcctgtagttcttgttggaaccaaactagatctccgtgaagacagatcttatcttgctgaccatcctgccgcttctatcatcactactgaacagggagaggaactcagaaagcagataggtgctgtggcctatatagaatgcagctcaaagacacagcggaacataaaagctgtgttcgacactgcgattaaagtagtgc

SEQ ID NO: 43098 - protein, 183 aa, Panicum virgatum
  misc_feature: Ceres CLONE 2015182
  misc_feature (14)..(183): Pfam Name: Ras Pfam Description: Ras family
  misc_feature (14)..(127): Pfam Name: Miro Pfam Description: Miro-like protein
  misc_feature: Functional homolog of the protein sequence given in SEQ ID NO 50617
  misc_feature: Useful for making plants with modulated nitrogen use efficiency
MSAAAASSVAKFIKCVTVGDGAVGKTCMLICYTCNKFPTDYIPTVFDNFSANVSVDGSIVNLGLWDTAGQEDYSRLRPLSYRGADVFILSFSLVSRASYENVLKKWMPELRRFSPTIPVVLVGTKLDLREDRSYLADHPAASIITTEQGEELRKQIGAVAYIECSSKTQRNIKAVFDTAIKVV

SEQ ID NO: 43099 - DNA, 328 bp, Panicum virgatum
  misc_feature: Ceres CLONE 2015186
  misc_feature: Encodes the peptide sequence at SEQ ID NO. 43100
gctgaccattcccctcccccttctaggtggagagagagagaagaaaagataagctcagctcagctcgcaagcaagaggtggagatgcggagcccacgaggaggaggacgcgcccatgagcacgtcgacctgatcccgggcatccccgacgacgtcgccgtcgactgcctggcgcgcgtgccccacgcgtgccaccgcgcgctgcgccgtgtctgccgcggatggcggagcgtcagcgccggtcccggcttcaccgaggcacgcgcccccgctggcgccacaaaagagctcgtgtacatgatccggtcgacgcccccctcgaccgcggc

SEQ ID NO: 43100 - protein, 81 aa, Panicum virgatum
  misc_feature: Ceres CLONE 2015186
  misc_feature (15)..(62): Pfam Name: F-box Pfam Description: F-box domain
MRSPRGGGRAHEHVDLIPGIPDDVAVDCLARVPHACHRALRRVCRGWRSVSAGPGFTEARAPAGATKELVYMIRSTPPSTA

SEQ ID NO: 43101 - DNA, 459 bp, Panicum virgatum
  misc_feature: Ceres CLONE 2015190
  misc_feature: Encodes the peptide sequence at SEQ ID NO. 43102
aaccaatcagcccgatcatttccgtccttcgtcttcgctagctagctttgatctgctgctcgtttggcgacaatcaatggcgtacggcaagaggtcgaggcagcaggccgaggagatgatctggctgcccgagggcgccgacgtcgcgcgcttcctgctgctcttctcgggccaccaccagcacctcgcgtcgccggacccggccttggcgccggagcgggtgttcgagtgcaagacctgcaaccgccagttcccgtccttccaggcgctcggcgggcaccgggccagccacaagaagccccgcctggcggacggcggcgtcgacggcgccgcacccgagccgcccaggcccaaggtgcacggctgttccatctgcgggctcgagttcgccatcggccaggcgctcggcggccacatgcgccgccaccgggccgccgatcaggcggacggcgccagccc

SEQ ID NO: 43102 - protein, 127 aa, Panicum virgatum
  misc_feature: Ceres CLONE 2015190
  misc_feature: Functional homolog of the protein sequence given in SEQ ID NO 51241
  misc_feature: Useful for making plants with modulated biomass
  misc_feature: The sequence is a functional homolog of SEQ ID NO 1480 in the 10/666,642 US patent application
  misc_feature: The sequence is a functional homolog of SEQ ID NO 2150 in the 10/374,780 US patent application
  misc_feature: The sequence is a functional homolog of SEQ ID NO 276 in the 10/714,887 US patent application
  misc_feature: The sequence is a functional homolog of SEQ ID NO 276 in the 11/435,388 US patent application
MAYGKRSRQQAEEMIWLPEGADVARFLLLFSGHHQHLASPDPALAPERVFECKTCNRQFPSFQALGGHRASHKKPRLADGGVDGAAPEPPRPKVHGCSICGLEFAIGQALGGHMRRHRAADQADGAS

SEQ ID NO: 43103 - DNA, 370 bp, Panicum virgatum
  misc_feature: Ceres CLONE 2015190-R
gggatcgggatcgggccggaagacgacggcggcaagaaggccgcgccgtcggccgagcttgcgctcgacctaaacgccgtgccggagctgcaggaggagccggatcgcgccaagctggggctctcggctgtcgaattccctgtagcagtagttgacttcttacgttaagaacgtggattattagactgatcttctcggttacatttttgaattacacgatttacacattaaaccaccccggaggtcaacctttgaaacattagaaagtccaggatacaggtttttttctctcagaaaggtaggaggatatttctagtgttcaagggggaaggctctctctatacacttaaatatatacagtacgctttaa

SEQ ID NO: 43104 - DNA, 1424 bp, Panicum virgatum
  misc_feature: Ceres CLONE 2015191
  misc_feature: Encodes the peptide sequence at SEQ ID NO. 43105
accgcttcgttccaagccagcgccaacagaagcctgctgcctcgtcagggccaggccacggatggcgaccacgcccaaccccaagagggagccgctgcgtccacggagcagcaacgcccccgcggctccggcgccggcgaggcgcgggccggcctccgcggagaaggagaacctcgggaacggggaagaggagatggggaaggggaaggcttggaccgcggttgctactgagccgtcgaagcccgcgaggccggcaccggcgggagcgcctccgcctccgccgccgcctctgaagccgtcgtcgctgcagctccgcatgaaggacgagtcggcggaggcggcgcccgtgctcgtggggccgaggggcagggagctgctcccgcccccgtcctcgtcctacgaggcgtgggacctctctgacagcgagtccgcgccggcctcctcctgggccacgctccccaacagggcgctcttgtgccggccgctgccgcaggacgtcgggcggtgcacctgcgtcatcgctagggaggcggccgccggagccagaggagtcgcgctctactccctctacaccaatgaggggcaggggcggcaggaccggaagctggcggtggcgcggcaccggaggaggaggggaaggtcggagttcgtcgtggcgcagaaccaggacggcatcttctgcatctccgacaagaacttcctcggcacggtcgccgccaacctcgtcggatccaagtaccaaatcctgggccaggggaaccaggtggatgagatgaagagccactccaagcggcttcttggcgttgtcgcgtttgcgcccaccatcaccacgcttacagggagtcacagaagcatgagggcttggataccgaagaaccaatccatgcagctcaagaccaacaattctgctcagattcagcacatcagtgggctcccaaaggactggcaggagaagaagagcagagctgaccaactatgctcaagagcccctttctacaaccatatgacaaagcgatatgaactggacttcagggagagggcaggaaggatggggtacaaggttcagacctcagtgaagaacttccagatgaccctggaggaaaacgggaggcacacggtcttgcagcttggtagggttgggaaatccaagtacataatggacttcagatacccattgactggctaccaagcgttctgcatttgcctgccatcgatcgactccaagctgtgctgcaccctgtgaaagaggcatgcgtggaagaagtctttcgttttcgcagcttatgcttagtttttagtgattgtgtatttccagccttctcatcttgagaaggggcttgaataatagagcaagccaatatggcgattatccatctggcatcagcaacttttgtggctaataataattaatattttcattatat

SEQ ID NO: 43105 - protein, 393 aa, Panicum virgatum
  misc_feature: Ceres CLONE 2015191
  misc_feature (141)..(386): Pfam Name: Tub Pfam Description: Tub family
MATTPNPKREPLRPRSSNAPAAPAPARRGPASAEKENLGNGEEEMGKGKAWTAVATEPSKPARPAPAGAPPPPPPPLKPSSLQLRMKDESAEAAPVLVGPRGRELLPPPSSSYEAWDLSDSESAPASSWATLPNRALLCRPLPQDVGRCTCVIAREAAAGARGVALYSLYTNEGQGRQDRKLAVARHRRRRGRSEFVVAQNQDGIFCISDKNFLGTVAANLVGSKYQILGQGNQVDEMKSHSKRLLGVVAFAPTITTLTGSHRSMRAWIPKNQSMQLKTNNSAQIQHISGLPKDWQEKKSRADQLCSRAPFYNHMTKRYELDFRERAGRMGYKVQTSVKNFQMTLEENGRHTVLQLGRVGKSKYIMDFRYPLTGYQAFCICLPSIDSKLCCTL

SEQ ID NO: 43106 - DNA, 644 bp, Panicum virgatum
  misc_feature: Ceres CLONE 2015202
  misc_feature: Encodes the peptide sequence at SEQ ID NO. 43107
aaaatcccggagacgtgaggtggcagcactaatcatgtggccgtcgctacataagccagtcgcccacgcccagctgcgtctcctcctcgcagtctccgcctgctccggtccactccgcttcggcaacaccagcgcagttgcggcggcggttacgacccgaggcccgagcccaagcaggggcgtcgcgaccaccgcgatgccttcgtcgtcctcttcgccgccgccgccaatcgaggagacgaccgccgccgccgcctcccccgcgggtgggttccgcctcaccgagccctccttcctcgagtcgctgatgccgaagaaggagatcggcgtcgaccgcttcctcgccgcgcaccccgagtacgatgggcgcggcgcgctcatcgccatcttcgattccggagttgatccagctgctgctgggttgcagactacttcagatggaaagcctaaaatccttgacgttattgattgcaccggtagtggcgatgttgacacatccaaagtggtgaaagctgatgctgatggtgctatagttggtgcttcaggtgctcgtttggttgtaaactcctcgtggaagaacccttctcaagagtggcatgttggctgtaaattaatatatgaactgtttactgatacacttacat

SEQ ID NO: 43107 - protein, 149 aa, Panicum virgatum
  misc_feature: Ceres CLONE 2015202
  misc_feature: SWISSPROT Homolog: EC 3.4.14.10 Tripeptidyl-peptidase II
MPSSSSSPPPPIEETTAAAASPAGGFRLTEPSFLESLMPKKEIGVDRFLAAHPEYDGRGALIAIFDSGVDPAAAGLQTTSDGKPKILDVIDCTGSGDVDTSKVVKADADGAIVGASGARLVVNSSWKNPSQEWHVGCKLIYELFTDTLT

SEQ ID NO: 43108 - DNA, 568 bp, Panicum virgatum
  misc_feature: Ceres CLONE 2015210
  misc_feature: Encodes the peptide sequence at SEQ ID NO. 43109
actgatgccatcctcgccgcgctcatgtgcacgccgcgcagcatccaatcatgggacattgtcgtccagcgcgtgggcaacaagctcttctttgacaagcgtgatggctcccagcttgacctgctcacagtcaatgagactgcacaggagcagctccctgagaacaaggaggacatcaactcagcgcactcactcgctgttgaggccacctacatcaaccagaacttctcgcagcaggtgttgcaccgtgaaggtgagaaggttacctttgatgagcctaacccttttgcttctgcgggtgaggaagcagcatctgttggctaccgatatcgccgctggaagctggatgatgagatcagccttgttgctcgttgtgaggtgcatgctgtcaatgctgatccaagtggtggtcgccagttccttacgctcaatgctctcaatgagtttgatcctaagattactggtgttgactggaggcagaagcttgagacccagcgtggggctgtccttgctacagagctcaagaacaatgcgaacaaacttgctcgctggactgcccaggctttgc

SEQ ID NO: 43109 - protein, 189 aa, Panicum virgatum
  misc_feature: Ceres CLONE 2015210
  misc_feature (1)..(189): Pfam Name: eIF-3_zeta Pfam Description: Eukaryotic translation initiation factor 3 subunit 7 (eIF-3)
TDAILAALMCTPRSIQSWDIVVQRVGNKLFFDKRDGSQLDLLTVNETAQEQLPENKEDINSAHSLAVEATYINQNFSQQVLHREGEKVTFDEPNPFASAGEEAASVGYRYRRWKLDDEISLVARCEVHAVNADPSGGRQFLTLNALNEFDPKITGVDWRQKLETQRGAVLATELKNNANKLARWTAQAL

SEQ ID NO: 43110 - DNA, 674 bp, Panicum virgatum
  misc_feature: Ceres CLONE 2015223
  misc_feature: Encodes the peptide sequence at SEQ ID NO. 43111
aggagaccgcagggcgatgggcgcgccgaagcagaagtggacgtcggaggaggaggaggcgctccgccgtggcgtgctcaagcacggagcgggcaagtggcggaccatccagaaggatcccgagttcagcccagtcctctcgtcccgctccaacatcgacctcaaggacaaatggaggaatctaagtttcagtgcaagtggaatgggttcaagggacaaaacaaggggtccaaggacaactggaccctcatgttccccattgtctacctcacaggcttcctcacaggcttcggttgccccagtggcaaataaagttgctgaagctccaccaggagctgagaaaaagcaacaggaagtgaaacctcatccaaagtatggtgccatgatcctggaagctctttcggagttgaatgagccaaatggtacagaacttactgaaatctgcagcttcatagaggttgatactaagtcctataggctcgccgattcctttgcgacgagaactccagctccaataaaagcttcagctccaaaacagaaggatccatccaagccatcgaaggtgtcaaagaacctaggattgtttgccacctccagccctgcactagaggcagccatggccgcagcagccaaagtagctgatgcagaggtgaaagcacatgatgcacatgatc

SEQ ID NO: 43111 - protein, 219 aa, Panicum virgatum
  misc_feature: Ceres CLONE 2015223
  misc_feature (5)..(57): Pfam Name: Myb_DNA-binding Pfam Description: Myb-like DNA-binding domain
  misc_feature: Functional homolog of the protein sequence given in SEQ ID NO 50221
  misc_feature: Useful for biocontainment applications
MGAPKQKWTSEEEEALRRGVLKHGAGKWRTIQKDPEFSPVLSSRSNIDLKDKWRNLSFSASGMGSRDKTRGPRTTGPSCSPLSTSQASSQASVAPVANKVAEAPPGAEKKQQEVKPHPKYGAMILEALSELNEPNGTELTEICSFIEVDTKSYRLADSFATRTPAPIKASAPKQKDPSKPSKVSKNLGLFATSSPALEAAMAAAAKVADAEVKAHDAHD

SEQ ID NO: 43112 - DNA, 942 bp, Panicum virgatum
  misc_feature: Ceres CLONE 2015226
  misc_feature: Encodes the peptide sequence at SEQ ID NO. 43113
gctttctcacgctcttccacctcggttccgaaaccatacaaccaccacctcctccaaccgctacctcaaacaaacataacccacccccatccaacatggcctctgaagaaatggagctcgacgagcccgtccagcaaggacccgacgacgccccctccaacaatggcaacagctccgccaagctagccgccatgcagacgctcaccaaagccaccgccgtgcgctccatcgagggctggattgtcatggtgaccaacgtacacgaggaggccgacgaggaggccatccacgacaagttcggcgagtttggcgagatccgcaacgtgcacctgaacctcgaccggcggacgggctacgtcaagggctacgcactaatcgagtacacgacgctcgaggaagcgcgcgccgccatcgacggcgccaacgacaccgagctcctcgaccagaacgtgcaggtggactttgcctttgtgcgcccgccgccgggaaagcaggctaacaacgggcggctcggcggcgggtcaggcggcgggggtggcggtggcggacagcgcgggtcgaatcgcggggcgcgtagcgggaggagtcgcagccgtagtcccggggcggggaaggatgattgagggtttggtcgttagatggggtggctacattcacttcacctgaccatatcttgtttgtgatgggatcgttgctggccgcgctgggttgggctagaccctggggatgagggcgcaagaaaaggccatgcggcgtgggggattagccgatgtgtctgtcatatggggagattaaggcacgtcggcatcttgccatggcagtttaataaatgaggtatactgcgtgttgtatactagccgaagatctattccaggaaccatcccaggctctaccatcatccggctgatatagttatactcaacagtgaaaaaaggttgacag

SEQ ID NO: 43113 - protein, 175 aa, Panicum virgatum
  misc_feature: Ceres CLONE 2015226
  misc_feature (50)..(121): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASEEMELDEPVQQGPDDAPSNNGNSSAKLAAMQTLTKATAVRSIEGWIVMVTNVHEEADEEAIHDKFGEFGEIRNVHLNLDRRTGYVKGYALIEYTTLEEARAAIDGANDTELLDQNVQVDFAFVRPPPGKQANNGRLGGGSGGGGGGGGQRGSNRGARSGRSRSRSPGAGKDD

SEQ ID NO: 43114 - DNA, 1066 bp, Panicum virgatum
  misc_feature: Ceres CLONE 2015227
  misc_feature: Encodes the peptide sequence at SEQ ID NO. 43115
aaccaagaaccaactcttcacaagaccgtgcaccaaacagagcagagcagcgccgaatcacacagcgcgtggccctctctcctccggtccgccatggcgaccgccggggcgtcgaggagcgcggcggcggaggaggacaagagcgacccggcgaggcccctcgcgctcgcctccccgacggtgtacccggcggccggggacgcggaggaggaggcgacgcagacggcgaccgggtggccctccgtgtcgtacctccggaagcggcgccggtgcctgctgtgctgcggcggctgctgcgtcaccaccacggtggtcgtcggcatcatcatcctggtgctcgcgctcaccgtcttcaaggtcaaggacccgcgcataaccatgaacaacgtctggctcacggccatcagctcggggtccgggacgggggtcacgagccccgtcgccaccaacgccaccatcaccgccgacgtctccatcaagaaccccaacgccgcggcgttccggttctcgcgctccgcgacggacgtctactacaaggggcagacgatcagcgtggcgtacgtgcccgccggcaaagtcggcgccgaccggacgctgaggacgaacgtgaccgtcgacctcctcgccgaccgcctcgccagcgccatgaacaccacgggcctcatcttcggccaggagtacgacatcaccacccacacggagatgaacgggagggtcagtatattggggatcatcaagaagcacatcgggatcaagctcaactgcaccatcgtcatcgaggtcgggggcgcggccgcggcgatccagtcaggggtcccctccaccatgcagagcaagggcgtggattgtattgcagatgtgtccatgtgagtcgattagcgaactgcgagtatgcttttaatgtctattttcttccttatagtggtcttactccttttcattttcgctctattctgctggcaaccggcagcagtggccccagccagccgaacaaagcgtttatagatcagttctacactgttatttaggttgtataaataccatgtatgttatgttttcatgcttg

SEQ ID NO: 43115 - protein, 258 aa, Panicum virgatum
  misc_feature: Ceres CLONE 2015227
  misc_feature (84)..(224): Pfam Name: Hin1 Pfam Description: Harpin-induced protein 1 (Hin1)
MATAGASRSAAAEEDKSDPARPLALASPTVYPAAGDAEEEATQTATGWPSVSYLRKRRRCLLCCGGCCVTTTVVVGIIILVLALTVFKVKDPRITMNNVWLTAISSGSGTGVTSPVATNATITADVSIKNPNAAAFRFSRSATDVYYKGQTISVAYVPAGKVGADRTLRTNVTVDLLADRLASAMNTTGLIFGQEYDITTHTEMNGRVSILGIIKKHIGIKLNCTIVIEVGGAAAAIQSGVPSTMQSKGVDCIADVSM

SEQ ID NO: 43116 - DNA, 426 bp, Panicum virgatum
  misc_feature: Ceres CLONE 2015229
  misc_feature: Encodes the peptide sequence at SEQ ID NO. 43117
cacagccacaccacgcacagagagacgcagcagcagcagcagggcactacgactcgtactagctagctagctagctactcgtagcagctgctagctgcaggtaaccatggcgaagaagaaagccgccgtggtcgccacgctcctggccctgaacctcctcttcttcgccttcgccaacgcctgcggctgcaagtgcggcgcctgccctagtccaggcggcggcggaaggggaggaggaggcagtgggggtggtggatctggcggcgggggaggcagcggcggtggtggcagcggccgcggaggcgggggaggcagcggtggaggcggcagcggcggcggcggcggagggagcagcggcggaggaggaggcacaggcggcggctgcggaagggggggacgaggaggaagtattgggggtggtggctt

SEQ ID NO: 43117 - protein, 106 aa, Panicum virgatum
  misc_feature: Ceres CLONE 2015229
  misc_feature (1)..(99): Pfam Name: GRP Pfam Description: Glycine rich protein family
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50702
  misc_feature: Useful for making plants with altered lignin content
MAKKKAAVVATLLALNLLFFAFANACGCKCGACPSPGGGGRGGGGSGGGGSGGGGGSGGGGSGRGGGGGSGGGGSGGGGGGSSGGGGGTGGGCGRGGRGGSIGGGG

SEQ ID NO: 43118 - DNA, 1393 bp, Panicum virgatum
  misc_feature: Ceres CLONE 2015231
  misc_feature: Encodes the peptide sequence at SEQ ID NO. 43119
gctcaccaggccgccggagcgcagacctccggaaaagctcgtttcgaaccctccaatccaaatctgctctcccaacccgcagaactcgccgccggccactgctccgacgatctccctgctcccccttttctccacccccaaaccccacgccagcccaacaccgcccgaccatgtcgcgcaaaaacttccgcaagcggaccatcgagccggacgccgacgaccactccgacgacgaggacacccgccgcgtcgccctggaggagatcaagtacatgcagaagctgcgggagaggaagctgggcatccccgccgaccccgccgccgcctccaccaacgggtcctccgcccgcggacgggtgggtgtcgggggagcggccgtcggcgaggccgagaaggaggacctcgtcctccaggacaccttcgcgcaggagaccgccgtcaccatcgaggatcccaatatgttgaagtatgtggagaccgagctggcgaagaagaggggtaagatggttgatgtgggacaaaaggaggagatggaccatgtggacgagctctacaccgtgccagaccacctcaaggtgaaaaagaagaactcggaggagagctcgacacagtggaccactggcattgctgaagttcagctgcctattgagtacaaattaagaaacattgaagaaactgaggcagctaaaaagatgctgcaagagaaaaggcttgctggtaaaccaaaatcagattcaaatattccatcaagttacagtgctgattatttccatcgcggcaaagaatatgatgagaaattgcgaagagagaatcctgggctgtacaaagataaagattctcgggctaatgaaagtgcagggggcaaaatagcagatagtaaaaacccagatggtgccgctgcaggacggagagaagctgctagtgatcagttcatgctcgagcgtttccgcaagagagaaaaatttcgtgtcatgcgaaggtagccagagctgactggctgctagactgctgccattgacccgttgcctttgaagctcgaacatgttgttgtgatcacatggaggcctcaatatatcctgtccattttagtgtgaattttgctatagagttgcatccttggttgttgactctgcttttgcagctgctaagggcaaggagcagagtaaacccttattacagaggtgatttggggcaatagatttgaggggagggctatcaaaaattcgtgcaagctcggaggctcggatgtctgaggggggccttgcagtggttgatgacataggagctgtaactggccaggatcttgccaaaaactccatgttcatcggcacaggaagagacaaaggtgtgctctctttggccaatataaatgagctgctgcgttatctattgg

SEQ ID NO: 43119 - protein, 270 aa, Panicum virgatum
  misc_feature: Ceres CLONE 2015231
  misc_feature (97)..(187): Pfam Name: Hep_59 Pfam Description: Hepatocellular carcinoma-associated antigen 59
MSRKNFRKRTIEPDADDHSDDEDTRRVALEEIKYMQKLRERKLGIPADPAAASTNGSSARGRVGVGGAAVGEAEKEDLVLQDTFAQETAVTIEDPNMLKYVETELAKKRGKMVDVGQKEEMDHVDELYTVPDHLKVKKKNSEESSTQWTTGIAEVQLPIEYKLRNIEETEAAKKMLQEKRLAGKPKSDSNIPSSYSADYFHRGKEYDEKLRRENPGLYKDKDSRANESAGGKIADSKNPDGAAAGRREAASDQFMLERFRKREKFRVMRR

SEQ ID NO: 43120 - DNA, 690 bp, Panicum virgatum
  misc_feature: Ceres CLONE 2015239
  misc_feature: Encodes the peptide sequence at SEQ ID NO. 43121
tcagtgagttctgaccaacgccactacactgaccagcaggaactagggggtcgccggagaagggcgcgctatggagccggcggtagagaagaaggaggccgaacaggaggagcagcagctaccgcaagcgcgcaaggaagacgcgcccgccgccgccgctgcagaggaggacgaggcagattcggaggagaccgagcgccgcaaccgcgacctcaaggccgtccttcacccccttaggcgcaagctcgttctctggtacacgcgtcggacgcctggggcgaggtcgcagtcgtacgaggacaacatcaagaagatcattgatttcagcactgtcgaatcattctgggtttgctactgccacctcgcgcgcccgtcttctctgccgagccccactgatcttcatctcttcaaggatggcatccggcccctctgggaggaccctgcaaatcagaatggtggcaagtggataattaggttcaagaaggctgtttcaggtcgtttctgggaagatttggtgctggtgctagtaggcgaccaacttgaatatagtgatgatgtttgtggtgttgtgcttagtgtccgttttaatgaagacattttaagtgtttggaatcggaacgcatctgaccaccaggctgtgatgacattaagggattcaatcaagagacaccttaagctgccacacagcta

SEQ ID NO: 43121 - protein, 206 aa, Panicum virgatum
  misc_feature: Ceres CLONE 2015239
  misc_feature (25)..(205): Pfam Name: IF4E Pfam Description: Eukaryotic initiation factor 4E
MEPAVEKKEAEQEEQQLPQARKEDAPAAAAAEEDEADSEETERRNRDLKAVLHPLRRKLVLWYTRRTPGARSQSYEDNIKKIIDFSTVESFWVCYCHLARPSSLPSPTDLHLFKDGIRPLWEDPANQNGGKWIIRFKKAVSGRFWEDLVLVLVGDQLEYSDDVCGVVLSVRFNEDILSVWNRNASDHQAVMTLRDSIKRHLKLPHS

SEQ ID NO: 43122 - DNA, 1162 bp, Panicum virgatum
  misc_feature: Ceres CLONE 2015243
  misc_feature: Encodes the peptide sequence at SEQ ID NO. 43123
acacaacactgccaagtgccaaacacacctattcgcctccctcccattcccaactgagcgtctgagccactgagcagaccgtctcgtctcgagagccttctcctcccaatggccaagcaccagcacgttgcctccctcctgctgctactgatggcggtcgccgtaaccacggccccgccgtcagcggcgttcctggtccaaccccagccgaacctcctcacgtaccacaacggcgccgtgctgagcggcgacatccccgtctccatcctatggtacggccgcttcacgccggcgcagaaggccgtcgtctccgacttcctcctctccctctccgccgcgccgcgggggacgacgccgtcgtcccacgccccgtccgtcgcgcagtggtggagcagcatcaaccggctctacctctccaagacggcggccgtcggcaagaacggcgcacgcggcggcgccgccgccgggaacgcgagggtggtcctggccgggcaggtctcggacgaggcgtgctcgctggggaagagcctgaagatgtcccagctcccggcgctggcggccgcggcgcgccccgccaaggccggcggcatcgcgctggtgctcacggcgcgggacgtggcggtggagggcttctgcgcgagccggtgcgggcaccacgggtcgtacggcggcggcggcgcggggtcgtcgtcccacgcggcgtacgcgtgggtggggaaccctgcggaccagtgccccgggcagtgcgcgtggccgttccaccagccgacgtacggtccccaggcgccgccgctggtgccgccgaacggggacgccggcatggacggcgcggtgatcagcgtggccggcatggtggccggcgcggtgaccaacccgttcggggacgggttctaccagggcgaccgcggcgcgccgctggaggccgccacggcgtgcgcgggcgtctacggcagtggcgcctaccccgggtacgccgggcggctgctggtggacgcggcgacgggcgccagctacaacgcgctcggcgcgcgcgggaggaagtacctgctcccggcgttgttcgaccccgacacgtcggcgtgctccacgctggtgtagccgccgtagaccacccgatcgtgccgaggcgacggacctccaaattaaaaagaaactgtttctc

SEQ ID NO: 43123 - protein, 329 aa, Panicum virgatum
  misc_feature: Ceres CLONE 2015243
  misc_feature (37)..(329): Pfam Name: Phi_1 Pfam Description: Phosphate-induced protein 1 conserved region
MAKHQHVASLLLLLMAVAVTTAPPSAAFLVQPQPNLLTYHNGAVLSGDIPVSILWYGRFTPAQKAVVSDFLLSLSAAPRGTTPSSHAPSVAQWWSSINRLYLSKTAAVGKNGARGGAAAGNARVVLAGQVSDEACSLGKSLKMSQLPALAAAARPAKAGGIALVLTARDVAVEGFCASRCGHHGSYGGGGAGSSSHAAYAWVGNPADQCPGQCAWPFHQPTYGPQAPPLVPPNGDAGMDGAVISVAGMVAGAVTNPFGDGFYQGDRGAPLEAATACAGVYGSGAYPGYAGRLLVDAATGASYNALGARGRKYLLPALFDPDTSACSTLV

SEQ ID NO: 43124 - DNA, 685 bp, Panicum virgatum
  misc_feature: Ceres CLONE 2015278
  misc_feature: Encodes the peptide sequence at SEQ ID NO. 43125
gtctcctccctttcccctcccaaggccaggcttgccctcccctctccgcgtcgcctcccgtccaggtgagccgacccgccccgcttgattcgacgccgctccgcccgattggaacggatctgaccgcttcctcggttgtctccgcaggaatccgccatgaagggggccaaatccaagggcgccgccaaggccgatgccaagttggcggtgaagagtaagggggcggagaagccggccaagggcaggaagggaaaggccggcaaggaccccaacaagcccaagagagcgcccagcgccttcttcgtcttcatggaggaattccgcaaggagttcaaggagaagaaccctaaaaacaagtctgttgctgcggtggggaaagctgccggtgacaggtggaaatccctgaccgatgcggacaaggctccttatgtagccaaggctaataaactcaagcttgagtacaacaaggctattgctgcctacaacaagggcgagagcactgctgccaagaaggctcctgccaaggaggaagaggaggaggaagaagaggagtctgacaagtcaaagtctgaggtcaacgacgaggatgatgaagagggtagtgaggaggatgaagacgatgacgagtaagctcaggtcaagctgatgatgctccatggaacaatggagtggcgaatgcaaaggc

SEQ ID NO: 43125 - protein, 157 aa, Panicum virgatum
  misc_feature: Ceres CLONE 2015278
  misc_feature (41)..(110): Pfam Name: HMG_box Pfam Description: HMG (high mobility group) box
  misc_feature: Functional homolog of the protein sequence given in SEQ ID NO 50396
  misc_feature: Useful for making plants with altered alkaloid content
  misc_feature: Functional homolog of the protein sequence given in SEQ ID NO 50397
  misc_feature: Useful for making plants with altered lignin content
  misc_feature: Useful for making plants with altered terpenoid content
MKGAKSKGAAKADAKLAVKSKGAEKPAKGRKGKAGKDPNKPKRAPSAFFVFMEEFRKEFKEKNPKNKSVAAVGKAAGDRWKSLTDADKAPYVAKANKLKLEYNKAIAAYNKGESTAAKKAPAKEEEEEEEEESDKSKSEVNDEDDEEGSEEDEDDDE

SEQ ID NO: 43126 - DNA, 518 bp, Panicum virgatum
  misc_feature: Ceres CLONE 2015301
  misc_feature: Encodes the peptide sequence at SEQ ID NO. 43127
accactcctcgggccctgacactcccctctgccagtgccaccccatcccttcccttctccgatccacaatctccagctagcctcatcctgctccgccacacctcaccgcgccaggataggccgcgcgctgcgcttacttggccgaacgacgagaccacccacgacatcagccggggggagtccccggccgcggccctccggcggatcctcgccatgcccggcgagcacgaggagaccggctgcatccacgcggtcaccacgggcatcaacaagggcgccgggtacgggatcggcttcatgagcggtttctgtgtttctgccagcaggcttgggttgcctgacgctggcctcgcctccgatggagaaatggcagagcacgggcgcctactcaaggaagcagtatcgatctcagtgcttggtgacggcgaccatggctatggaaacttcatgggcatccagagaaaaatcaaagggtacgtcagagatggttgagctggactcgcgcttgaagatcaggt

SEQ ID NO: 43127 - protein, 163 aa, Panicum virgatum
  misc_feature: Ceres CLONE 2015301
  misc_feature: SWISSPROT Homolog: EC 2.7.8.23 Carboxyvinyl-carboxyphosphonate phosphorylmutase
TTPRALTLPSASATPSLPFSDPQSPASLILLRHTSPRQDRPRAALTWPNDETTHDISRGESPAAALRRILAMPGEHEETGCIHAVTTGINKGAGYGIGFMSGFCVSASRLGLPDAGLASDGEMAEHGRLLKEAVSISVLGDGDHGYGNFMGIQRKIKGYVRDG

SEQ ID NO: 43128 - DNA, 680 bp, Panicum virgatum
  misc_feature: Ceres CLONE 2015302
  misc_feature: Encodes the peptide sequence at SEQ ID NO. 43129
ggcaccaaggagataaggagtttttagttgaagtggaaatgctgagcagattgcaccaccgaaatcttgtgaaactcattggttactatagcagccgtgagttatcacagaaccttctctgttacgagcttgttcccaatggaagcctagaggcttggcttcacggcgcactaggtgctaactgccccttggattgggacaccaggatgaggatagctcttgatgctgccaggggattagcatacctccatgaggattcgcagccctgtgtaatccacagggatttcaaagcttctaatatattgcttgagaatgattttcatgctaaagtgtccgattttggtttggcaaaacaggcgcctgaaggtcgggctaattatctttcaactcgtgtcatgggaactttcgggtatgttgcacccgagtatgccatgacaggacacttgcttgtaaaaagtgatgtatatagctatggagtcgttcttcttgaactactaactgggaggaggcctgttgatatgtcacagccgtcgggacaggaaaacctagtgacatggacacgaccgattcttcgagatcaagatagattagacgaactatctgaccccaggcttggcggccagtacccgaaagacgattttgtgcgggtgtgcacaattgcagcagcttgtgtttcacca

SEQ ID NO: 43129 - protein, 225 aa, Panicum virgatum
  misc_feature: Ceres CLONE 2015302
  misc_feature (1)..(204): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50776
  misc_feature: Useful for making plants with altered carbohydrate content
  misc_feature: Functional homolog of the protein sequence given in SEQ ID NO 50301
  misc_feature: Useful for making plants with modulated heat sensitivity
HQGDKEFLVEVEMLSRLHHRNLVKLIGYYSSRELSQNLLCYELVPNGSLEAWLHGALGANCPLDWDTRMRIALDAARGLAYLHEDSQPCVIHRDFKASNILLENDFHAKVSDFGLAKQAPEGRANYLSTRVMGTFGYVAPEYAMTGHLLVKSDVYSYGVVLLELLTGRRPVDMSQPSGQENLVTWTRPILRDQDRLDELSDPRLGGQYPKDDFVRVCTIAAACVS

SEQ ID NO: 43130 - DNA, 730 bp, Panicum virgatum
  misc_feature: Ceres CLONE 2015315
  misc_feature: Encodes the peptide sequence at SEQ ID NO. 43131
gaacgacgagcagtgcaagccaagcattctactcaggcaggctcacggtctctcactctctcttcctcttcctctctagcgatcttctcggcgagttcgtcgtcgttgcatctatccgagatctttttgtggtttcggccatggagatgatcgacgcggagctgcgtctcggtccgcccggcggcgatgttacggtcgtgcagccggcgaggaagccggcggcggcgaaacggtcgtcgtcggcggtgaagagcgaggcctccgggaccggtggccatgacgacgacgccgcgccggcctccaaggtgcaggtggtggggtggccgccggtgagggcgtaccggaagaacgcgttccatgcggcggcggaggcggcggcggcgaggacgacgaagggggagcaggggggcctgtacgtgaaggtgagcatggacggagcgccctacctccggaaggtggacctgcggacgtacggcgggtacagggagctgagggacgcgctcttcggctgcttctcctcggcggccgacggcgcctgccagttcgccatcgcctacgaggacaaggacggcgacctcatgctcgccggcgacgtgccatgggatatgttcatctgttcttgcaagaagctgaggatcatgaggggctctgaagcaagatgatccgagtgtcgaggtccacacatcgcgcgagaatttgttggacgcgtgtggatcagatgtataggtca

SEQ ID NO: 43131 - protein, 173 aa, Panicum virgatum
  misc_feature: Ceres CLONE 2015315
  misc_feature (1)..(173): Pfam Name: AUX_IAA Pfam Description: AUX/IAA family
MEMIDAELRLGPPGGDVTVVQPARKPAAAKRSSSAVKSEASGTGGHDDDAAPASKVQVVGWPPVRAYRKNAFHAAAEAAAARTTKGEQGGLYVKVSMDGAPYLRKVDLRTYGGYRELRDALFGCFSSAADGACQFAIAYEDKDGDLMLAGDVPWDMFICSCKKLRIMRGSEAR

SEQ ID NO: 43132 - DNA, 703 bp, Panicum virgatum
  misc_feature: Ceres CLONE 2015320
  misc_feature: Encodes the peptide sequence at SEQ ID NO. 43133
accacccatccatcccacaccagaaatcacgcgacgcttctcgccctcctcttcgatccacatcgacatggcgatgcttagggtttccccgtcaccggccgccgccgccgccgccaaccatgcctctcgacctgccgtgaccccagcttcctccgtccgggtgccggcgccgcgcgtctcgccgtcggctgcggccgcgtgcagggcggcgggcaagggcaaggaggtgctcaccggggtcgtcttccagcccttcgaggagatcaagggggagctctccctcgtgccccagaccgcggacaagtccctcgcgcgccaaaagttcgtcgacgaatgcgaggccgccatcaacgagcagatcaatgtggagtacaatgcctcctatgcgtaccactctctcttcgcctacttcgaccgcgacaacgtggcgctcaaaggatttgccaagttttttaaggaatcaagtgatgaggagagagagcatgctgaaaagctcatgaagtaccagaacacacgtggaggcagggtcagtctccagtccattgtcacacccttaacagagtttgaccaccctgagaaaggcgatgctttgtacgccatggagctggctctggttctggagaaactggttaatgagaagctgcacaacctgcatgctgtggcgaccaggtgcaacgatcctcagctgacagacttcatcgag

SEQ ID NO: 43133 - protein, 209 aa, Panicum virgatum
  misc_feature: Ceres CLONE 2015320
  misc_feature (89)..(209): Pfam Name: Ferritin Pfam Description: Ferritin-like domain
  misc_feature: SWISSPROT Homolog: EC 1.16.3.1 Ferroxidase
MLRVSPSPAAAAAANHASRPAVTPASSVRVPAPRVSPSAAAACRAAGKGKEVLTGVVFQPFEEIKGELSLVPQTADKSLARQKFVDECEAAINEQINVEYNASYAYHSLFAYFDRDNVALKGFAKFFKESSDEEREHAEKLMKYQNTRGGRVSLQSIVTPLTEFDHPEKGDALYAMELALVLEKLVNEKLHNLHAVATRCNDPQLTDFI

SEQ ID NO: 43134 - DNA, 377 bp, Panicum virgatum
  misc_feature: Ceres CLONE 2015342
  misc_feature: Encodes the peptide sequence at SEQ ID NO. 43135
ccggcgccccgtctcgagatcccgcactcccagcctccgccgccgatggcgacgctcattgtccccgccgccgctcactaccgcggtcgacgactgcgagcagctccactgggcgttccaagggtggggcacaaacgaggcgctcatcatctccgtcctgggccagcgcgacgccgcgcagcgccgcggcatccgccgcgcctacgcggagacgtacggcgaggagctcctccgctccatcgccgaagagatctcgggcgacttcgagagggccgtgatcatgtgtacgctggacccggtggaacgggacgcggtgctcgcctatgatgcgtgccaggaagtggcagcccgggaaccgcgtgctcgtcgagatcgcc

SEQ ID NO: 43135 - protein, 125 aa, Panicum virgatum
  misc_feature: Ceres CLONE 2015342
  misc_feature (30)..(95): Pfam Name: Annexin Pfam Description: Annexin
RRPVSRSRTPSLRRRWRRSLSPPPLTTAVDDCEQLHWAFQGWGTNEALIISVLGQRDAAQRRGIRRAYAETYGEELLRSIAEEISGDFERAVIMCTLDPVERDAVLAYDACQEVAAREPRARRDR

SEQ ID NO: 43136 - DNA, 646 bp, Panicum virgatum
  misc_feature: Ceres CLONE 2015352
  misc_feature: Encodes the peptide sequence at SEQ ID NO. 43137
gctcttcttgcatatggtttgagcagctcaagacgtgccccggatgctctacacccctatggttattcaaaggaaagatttgtatggtcgctaatttctgctgttggaatattttgcttgggttcaggtgctaccattgtgcatggagttcaaaacttatggagttctcagcctccagagaatattcactgggctgcactagtgattggtggctccttcctaattgaaggtgcttcactacttgttgctattaaggctgttaggaaaggtgcagaagcagaaggaatgagtatctgggattacatctggcgtggtcatgatccaacttctgttgctgttatgactgaagatggtgctgctgttacaggccttgctattgctgcagcatctttggtggctgttcaaacaacaggaaatcctatgtatgatccaattggctcaatcatagttggcaatttactgggaatggttgctatttttctcattcagaggaacaggcatgctttaattggccgggccattgatgatcatgacatgcagcgtgtccttgaatttcttaagtctgatccggtgagcttggcgtcataattttggaactgcttagatgcattttcatgaagttgatttcatattttcttgcaggttg

SEQ ID NO: 43137 - protein, 195 aa, Panicum virgatum
  misc_feature: Ceres CLONE 2015352
  misc_feature (1)..(195): Pfam Name: Cation_efflux Pfam Description: Cation efflux family
ALLAYGLSSSRRAPDALHPYGYSKERFVWSLISAVGIFCLGSGATIVHGVQNLWSSQPPENIHWAALVIGGSFLIEGASLLVAIKAVRKGAEAEGMSIWDYIWRGHDPTSVAVMTEDGAAVTGLAIAAASLVAVQTTGNPMYDPIGSIIVGNLLGMVAIFLIQRNRHALIGRAIDDHDMQRVLEFLKSDPVSLAS

SEQ ID NO: 43138 - DNA, 544 bp, Panicum virgatum
  misc_feature: Ceres CLONE 2015369
  misc_feature: Encodes the peptide sequence at SEQ ID NO. 43139
catccactgacgaaccggcaggtgggtgtcgcgccaatttagggtcaacacacgaatgcgcttgatcgcgcggtgagcgacggcacaattgcagcgccgatggtcagaccggtcgggggaaccggtcagaccggttcgccggtgcagaacggcgaaatccgaccaacgctcgctcgggagggaccccgtcagggcaagcacacgtagggttgttctaggatcggcaagccacctagaactccttcagacgtcgcggagacgaaggaggctaagatggacctgctcgaggacgacgacgagttcgaggagttcgagatcgaccaagagtgggacgacaaggaagaaggcaacgaagcacttcagcaatgggaggatgactgggatgatgatgacgtcaatgatgacttctcgctgcagttgaggaaggagctggagagcaatgcgccgaagaactagccagcgtatgcagccttgtattgagttggagagtggtgtgatggtgtccaaggactagttagcttatgcagccttgtatccattattg

SEQ ID NO: 43139 - protein, 60 aa, Panicum virgatum
  misc_feature: Ceres CLONE 2015369
  misc_feature (1)..(56): Pfam Name: DSS1_SEM1 Pfam Description: DSS1/SEM1 family
MDLLEDDDEFEEFEIDQEWDDKEEGNEALQQWEDDWDDDDVNDDFSLQLRKELESNAPKN

SEQ ID NO: 43140 - DNA, 706 bp, Panicum virgatum
  misc_feature: Ceres CLONE 2015371
  misc_feature: Encodes the peptide sequence at SEQ ID NO. 43141
gcctttctagctgaaaactttacccgttcgtcttcctccgatcctcttcttcctcctcgttgctgcttgctgggagagtatactgttcttcacaaggcgaagcgaggcggcggcggtgacagccgatcagaatcgaaggaatgtcgtcccagatcgcggcagcggtggatcatgtgtgctacgttcactgcaacttctgcaacacagttctctcggtgagtgtccctgggaatagcatgctcaacatcgtgacagtccggtgtggacactgcacaaatctattgtcagtgaacctgagagcactgatgcactcactcccagagcaacaggatcagctacagttgttcgattcccatgagaacatcaaggcccatggcatcaatggcagtcatttggagtttggttcttcgtcctcgaagttccgactgcctatgatgtactcgccacaaaatcaacaccacctgctgcaggaacagacgctaaatgctcatcctccagagaagaggcaacgggttccatcggcgtacaacagattcatcaaggaagagatccgcaggataaaagcaaacaaccctgacattagccacagggaagcctttagcacagcagccaagaactgggcacattatccaaatatccattttcgggctagccccggacgggagggtggcaagaagctcgtcgatgaggctgtctcagcctctcc

SEQ ID NO: 43141 - protein, 188 aa, Panicum virgatum
  misc_feature: Ceres CLONE 2015371
  misc_feature (3)..(170): Pfam Name: YABBY Pfam Description: YABBY protein
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSSQIAAAVDHVCYVHCNFCNTVLSVSVPGNSMLNIVTVRCGHCTNLLSVNLRALMHSLPEQQDQLQLFDSHENIKAHGINGSHLEFGSSSSKFRLPMMYSPQNQHHLLQEQTLNAHPPEKRQRVPSAYNRFIKEEIRRIKANNPDISHREAFSTAAKNWAHYPNIHFRASPGREGGKKLVDEAVSAS

SEQ ID NO: 43142 - DNA, 650 bp, Panicum virgatum
  misc_feature: Ceres CLONE 2015391
  misc_feature: Encodes the peptide sequence at SEQ ID NO. 43143
ctctctccgcggccacctcctctctctctcctcccttctcccttctctctcctccccgcctcgcctccccgcgcgcgcgtttttataagggtttcggcggaggcgcccggtccccggcgatggcggacgacggcgggagccacgagggcagcggcggcggcgtccgggagcaggaccggttcctgcccatcgccaacatcagccgcatcatgaagaaggccgtcccggctaacggcaagatcgcgaaggacgccaaggagaccctgcaggagtgcgtctccgagttcatctccttcgtcaccagcgagtgagttgacacgacccgggccagcgacaagtgccagaaggagaagcgcaagaccatcaacggcgacgatctgctgtgggcgatggctacgctcggattcgaggagtacgtcgagcccctcaagatgtacctacataagtacagagagatggagggtgatagtaagttgtctacaaaggctggtgagggctctgtaaagaaggatgcaattagtccccatggtggtaccagtagctcaagtaaccagttggttcaacatggagtttacaaccaaggggatgggctatatggcaccacagtactataatgggggatacctaaaggggaaaaaccggaaaacggc

SEQ ID NO: 43143 - protein, 63 aa, Panicum virgatum
  misc_feature: Ceres CLONE 2015391
  misc_feature (20)..(63): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 791 in the 10/374,780 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 60 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 44 in the 10/675,852 US patent application
  misc_feature: The sequence is a functional homolog of SEQ ID NO 64 in the 10/675,852 US patent application
  misc_feature: The sequence is a functional homolog of SEQ ID NO 38 in the 10/675,852 US patent application
  misc_feature: Functional homolog of the protein sequence given in SEQ ID NO 50465
  misc_feature: Useful for making plants with modulated biomass
  misc_feature: The sequence is a functional homolog of SEQ ID NO 12 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 42 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: Functional homolog of the protein sequence given in SEQ ID NO 50466
  misc_feature: Useful for making plants with modulated drought sensitivity
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 14 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 793 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 62 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 22 in the 10/675,852 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 66 in the 10/675,852 US patent application
  misc_feature: The sequence is a functional homolog of SEQ ID NO 803 in the 10/374,780 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 795 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 788 in the 10/374,780 US patent application
  misc_feature: The sequence is a functional homolog of SEQ ID NO 22 in US patent 7166765
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
MADDGGSHEGSGGGVREQDRFLPIANISRIMKKAVPANGKIAKDAKETLQECVSEFISFVTSE

SEQ ID NO: 43144 - DNA, 660 bp, Panicum virgatum
  misc_feature: Ceres CLONE 2015405
  misc_feature: Encodes the peptide sequence at SEQ ID NO. 43145
gagagagagggatcattgaaagctgcacccatcatcgatccgccccggcccgtttgttcgccaccatttctctcccttcgacgaacccctcccctccctcccgtccctcgctttccccctcgtcggagcaggaatttttatgcgcgctttgggaaagcgcgagttagttttgctctgaagcagcctgctttttatccatccggagccgcgggcgttgggggaggcgaggcgaggcggagctccgtgcgctgctccggccgggcgggcgtgggcaccgaggaggcggcggcgagcgagcgagccagggatctccatgtcgtcggcggaggacgggtactgcagctcggattcgccgcgggcggagtcccccgaggagtcgcaggcggcggcggacgcggagtcgcctcgcaccggggccaagcgcgagcgcgacctctgcgacatccccgcctcgccgtcgtcgccgctgccggcagctaagcgcagccggagatcggtggagaagcgggtcgtgtcggtgccgctcgccgagtgcggggaccggcccaggggcgccagcggggaggggccgccgccgtcggactcgtggacgtggcgcaagtacgggcagaagcccatcaagggctccccctaccctcgggggtactaccgctgcagcag

SEQ ID NO: 43145 - protein, 115 aa, Panicum virgatum
  misc_feature: Ceres CLONE 2015405
  misc_feature (88)..(115): Pfam Name: WRKY Pfam Description: WRKY DNA -binding domain
  misc_feature: Functional homolog of the protein sequence given in SEQ ID NO 50742
  misc_feature: Useful for making plants with modulated biomass
  misc_feature: The sequence is a functional homolog of SEQ ID NO 106 in the 10/412,699 US patent application
  misc_feature: The sequence is a functional homolog of SEQ ID NO 124 in the 10/225,068 US patent application
  misc_feature: The sequence is a functional homolog of SEQ ID NO 32 in the 10/374,780 US patent application
  misc_feature: The sequence is a functional homolog of SEQ ID NO 428 in the 10/225,066 US patent application
  misc_feature: The sequence is a functional homolog of SEQ ID NO 1024 in the 10/412,699 US patent application
  misc_feature: The sequence is a functional homolog of SEQ ID NO 530 in the 10/374,780 US patent application
  misc_feature: The sequence is a functional homolog of SEQ ID NO 1254 in the 11/479,226 US patent application
  misc_feature: The sequence is a functional homolog of SEQ ID NO 510 in the 11/435,388 US patent application
  misc_feature: The sequence is a functional homolog of SEQ ID NO 578 in the 10/412,699 US patent application
  misc_feature: The sequence is a functional homolog of SEQ ID NO 528 in the 10/374,780 US patent application
MSSAEDGYCSSDSPRAESPEESQAAADAESPRTGAKRERDLCDIPASPSSPLPAAKRSRRSVEKRVVSVPLAECGDRPRGASGEGPPPSDSWTWRKYGQKPIKGSPYPRGYYRCS

SEQ ID NO: 43146 - DNA, 628 bp, Panicum virgatum
  misc_feature: Ceres CLONE 2015414
  misc_feature: Encodes the peptide sequence at SEQ ID NO. 43147
aagcaagccactctacttgtagctagctagctagctaagaagagaaggaagaagaagattgctcctctatctaatgagcatgagcatgagcatgatgagatgccggtgccagcaggcgacgactgtcgtcctgctcctcctggccgtgagcgtcagcgcgagcgcgaggcctctaactctgacgactctgggtagtgctagtgccaacgcccacgccaacgccaccaacggcctgtccgtctacttccacctcgactcctgcccgcagctggagaccatcgtccgctcccacgtcgacgccgctctccgccagaacgtccgcctcaccgccggcctcctccgcgtcttcttccacgactgcttcccgcagggctgcgacgcctccatcctcctcgacaacggcgagcgcaacctcccgcccaacgtcggcctccagcaggaggtgctgcagctcatcgaggacgcccgggccaaggtgcacgcccagtgcggcgccaccgtctcctgcgccgacatcaccgtcctcgccacgcgcgacgccgtcaacctcgccggcggccccgccttcacggtgcccctcggccgcctcgacagcctggcgcccgcctccgacaacgacgtcttcaag

SEQ ID NO: 43147 - protein, 184 aa, Panicum virgatum
  misc_feature: Ceres CLONE 2015414
  misc_feature (70)..(183): Pfam Name: peroxidase Pfam Description: Peroxidase
  misc_feature: SWISSPROT Homolog: EC 1.11.1.7 Peroxidase
MSMSMSMMRCRCQQATTVVLLLLAVSVSASARPLTLTTLGSASANAHANATNGLSVYFHLDSCPQLETIVRSHVDAALRQNVRLTAGLLRVFFHDCFPQGCDASILLDNGERNLPPNVGLQQEVLQLIEDARAKVHAQCGATVSCADITVLATRDAVNLAGGPAFTVPLGRLDSLAPASDNDVF

SEQ ID NO: 43148 - DNA, 543 bp, Panicum virgatum
  misc_feature: Ceres CLONE 2015415
  misc_feature: Encodes the peptide sequence at SEQ ID NO. 43149
ggacgcgcactccaccaccggcgccccgtctcgagatcccgcatcccagcctccaccgccgatggcgacgctcaaggtccccgccaccgtcccgaccgccgccgacgactgcgagcagctccgcaaggcgttccaagggtggggcacgaacgaggcgctcatcatctccatcctgggccaccgcgacgccgcgcagcgccgcgccatccgccgcgcctacgcggagacgtacggcgaggagctcctccgctccatcaccgacgagatctcgggcgacttcgagagggccgtgatcctgtggacgctggacccggcggagcgggacgcggtgctcgccaacgaggcggccaggaagtggcagcccgggaaccgcgtgctcgtcgagatcgcgtgcacgcgcggctccgcgcagctcttcgccgtcaggcaggcgtaccacgagcgcttcaagcgctcgctggaggaggacatcgctgcgcacgtcaaaggggacttccgcaagctgttggtgccacttgtaactgcataccgttatgatggacc

SEQ ID NO: 43149 - protein, 160 aa, Panicum virgatum
  misc_feature: Ceres CLONE 2015415
  misc_feature (15)..(80): Pfam Name: Annexin Pfam Description: Annexin
  misc_feature (87)..(152): Pfam Name: Annexin Pfam Description: Annexin
MATLKVPATVPTAADDCEQLRKAFQGWGTNEALIISILGHRDAAQRRAIRRAYAETYGEELLRSITDEISGDFERAVILWTLDPAERDAVLANEAARKWQPGNRVLVEIACTRGSAQLFAVRQAYHERFKRSLEEDIAAHVKGDFRKLLVPLVTAYRYDG

SEQ ID NO: 43150 - DNA, 619 bp, Panicum virgatum
  misc_feature: Ceres CLONE 2015425
  misc_feature: Encodes the peptide sequence at SEQ ID NO. 43151
gacataaaagagaccgcgactgcaaggcaccgtacaagaactcgccaggaagcaacgtagcggaaaaggcaaatccaggggccaagccaagagaagccgctcgcccctgttggattgttccgttcttcgattccctcgcggagcgaaaatgagtgacaacctgatggacaaggttagcgcctttggcgagcgcctcaagatcaccgggacggaggtcagcaagaagatgacggccggcatgagctccatgagcttcaagatgaacgaattgttccaggggcagactccggccgacaagatcgtcgaggacgccacttctgagaaccttgatgggcctgactggaacttgaacttggagatatgtgacatgattaacaccaagaaggttaacagtgtggagctcatccgtggcatcaagaagcggatcatgctgaaggatgcaaggatccactacctctccttgatcctgctcgagactattgtgaagaactgcgagaaggccttctcagaggttgcggctgaacgggttcttgatgagatggttaggatgattaatgatcctcagacagttgtcagtaacacgaacaaggcccttatgctgattgaagcatggggggga

SEQ ID NO: 43151 - protein, 156 aa, Panicum virgatum
  misc_feature: Ceres CLONE 2015425
  misc_feature (42)..(156): Pfam Name: VHS Pfam Description: VHS domain
MSDNLMDKVSAFGERLKITGTEVSKKMTAGMSSMSFKMNELFQGQTPADKIVEDATSENLDGPDWNLNLEICDMINTKKVNSVELIRGIKKRIMLKDARIHYLSLILLETIVKNCEKAFSEVAAERVLDEMVRMINDPQTVVSNTNKALMLIEAWG

SEQ ID NO: 43152 - DNA, 684 bp, Panicum virgatum
  misc_feature: Ceres CLONE 2015429
  misc_feature: Encodes the peptide sequence at SEQ ID NO. 43153
aactaacgctaaaaaagtaacagtttctgtactttattgattggcccctgtgaatttaaaacacacctggaaaaaccatggcagcctcgacgaaaggtcccgcggcgaaaggtgcgtccggaaagggcaagccggagctcaccgaggagcagcgccaggagattaaggaggccttcgatctcttcgacacggacggcagcggttccattgacgcgaaggagctgaaggtggcgatgcgcgccctcggcttcgagccgaagaaggaggagatccgcaagatgatcagcgacatcgacacggacggcagcggcacgatcgacttccacgagttcctggagatgatgaccacgaagatgagcgagaaggacagccgcgaggagatcctcaaggcgttccgcctcttcgacgacgacgaaaccggcaagatctccttcaagaacctgaagcgtgtcgcgaaggagctcggcgagaacatgacggacgaggagctgcaggagatgatcgacgaggccgaccgcgacggcgatggcgagatctccgaggaggagttcctgcgcatcatgaagaagacgtcgctttactagacagacacggatccgacgcccgcctgcgccgtccacacgtagatgctttccccggacgcgccagggcacaccgccatgttcaatacgacggccccgcggg

SEQ ID NO: 43153 - protein, 168 aa, Panicum virgatum
  misc_feature: Ceres CLONE 2015429
  misc_feature (137)..(165): Pfam Name: efhand Pfam Description: EF hand
  misc_feature (28)..(56): Pfam Name: efhand Pfam Description: EF hand
  misc_feature (64)..(92): Pfam Name: efhand Pfam Description: EF hand
  misc_feature (101)..(129): Pfam Name: efhand Pfam Description: EF hand
  misc_feature: SWISSPROT Homolog: EC 2.7.11.1 Non-specific serine/threonine protein kinase
MAASTKGPAAKGASGKGKPELTEEQRQEIKEAFDLFDTDGSGSIDAKELKVAMRALGFEPKKEEIRKMISDIDTDGSGTIDFHEFLEMMTTKMSEKDSREEILKAFRLFDDDETGKISFKNLKRVAKELGENMTDEELQEMIDEADRDGDGEISEEEFLRIMKKTSLY

SEQ ID NO: 43154 - DNA, 628 bp, Panicum virgatum
  misc_feature: Ceres CLONE 2015441
  misc_feature: Encodes the peptide sequence at SEQ ID NO. 43155
acctccacaccacagcttattccgccattgatcactgcgcacaagctcacgcatcgacaggaagagacgacaggggccaagaagcagagatggccggggagaagaagggcctgcagctgctggacttgtgggtgagcccgttcgggcagcgctgccgcatcgcgctggccgagaagggcctcccctacgagtacctggagcaggacctgggcaacaagagcgagctcctcctgcgctccaacccggtgcacaagaagatccccgtgctcctccacgacggccgccccgtctgcgagtccctcatcatcgtccagtacatcgacgaggcgttcccgggcaacgcgccggcgctgctccccgccgacccctacgcgcgcgcgcaggcccgcttctgggccgactacgtggacaagaagctctacgactgcgggacccggctgtggaagctcaagggcgaggcccagcagcaggcccgcaaggagatgctcgacatcctccgcacgctcgacgccgcgctcggcgacgccaagttcttcggcggcgaggccttcggcttcgccgacgtcgcgctcgcgcccttcacggcgtggttcctcacctacgagcgccacggggagttcagcgtgga

SEQ ID NO: 43155 - protein, 179 aa, Panicum virgatum
  misc_feature: Ceres CLONE 2015441
  misc_feature (6)..(79): Pfam Name: GST_N Pfam Description: Glutathione S-transferase, N-terminal domain
  misc_feature: SWISSPROT Homolog: EC 4.4.1.5 Lactoylglutathione lyase
  misc_feature: Functional homolog of the protein sequence given in SEQ ID NO 51079
  misc_feature: Useful for making plants with modulated drought sensitivity
MAGEKKGLQLLDLWVSPFGQRCRIALAEKGLPYEYLEQDLGNKSELLLRSNPVHKKIPVLLHDGRPVCESLIIVQYIDEAFPGNAPALLPADPYARAQARFWADYVDKKLYDCGTRLWKLKGEAQQQARKEMLDILRTLDAALGDAKFFGGEAFGFADVALAPFTAWFLTYERHGEFSV

SEQ ID NO: 43156 - DNA, 840 bp, Panicum virgatum
  misc_feature: Ceres CLONE 2015443
  misc_feature: Encodes the peptide sequence at SEQ ID NO. 43157
aagcattgctctcgtgcgattattcaaaaaaaaaaaaacactgctctcgtgcgattcccccaacccaaaatttcagcgcgaaacgctagatcgggtgggatggcgtccggcggcatcgcccgcagccgcctcgccgaggagcgcaagacgtggcgcaggagccacccccatgggttcgtggcgaagccggagacgctgccggatgggtccgtcaacctcctggtctggaagtgcgtcgtccccggcaaggaaggcactgactgggagggcggatatttcccgctgactctgaattttcctgaagattacccaagcaaccctcctgtctgcaagttcccagcagggttcttccatgtcaatgtctaccctactggagcagtgtgcctatcaatactcagcagtgcatggaaagcttccatcacagttagtcaaatcctcataggcatccaggagttgcttgataatcctaatccagcgtctcctgcacaggatccttgttgtcggctctacaaaaagaataagcatgcgtacaaggatcgtgttcgtcagcaggcaaagcaatatccttcacttctgtaggcgtgtagccatgaaccaattgagggaaagattctggcagctgaccattactcattttggtggagcctgttgctattgcaaaaacctgtaaccctcatgtggtgtggcaaattggcaacatagcagtagttgcattgttgttgctgctagactgcacttggagcacatcgtaaacacctacatcatggcttatctagttatctgcatcctgtgctatctagtgcctagacaggggaaagctttcgttttgctgtggctttt

SEQ ID NO: 43157 - protein, 159 aa, Panicum virgatum
  misc_feature: Ceres CLONE 2015443
  misc_feature (10)..(152): Pfam Name: UQ_con Pfam Description: Ubiquitin-conjugating enzyme
  misc_feature: SWISSPROT Homolog: EC 6.3.2.19 Ubiquitin--protein ligase
MASGGIARSRLAEERKTWRRSHPHGFVAKPETLPDGSVNLLVWKCVVPGKEGTDWEGGYFPLTLNFPEDYPSNPPVCKFPAGFFHVNVYPTGAVCLSILSSAWKASITVSQILIGIQELLDNPNPASPAQDPCCRLYKKNKHAYKDRVRQQAKQYPSLL

SEQ ID NO: 43158 - DNA, 961 bp, Panicum virgatum
  misc_feature: Ceres CLONE 2015448
  misc_feature: Encodes the peptide sequence at SEQ ID NO. 43159
atctccaatcccggctcccgatctcaacgacggcctcaaccctaagcagtgaaggccccgatagctgccatcaccgtcgatctggatacctcccgtattccgaagacagcaagtggccggaaggcggaggcggaggagaaagcaggcgccaggtagccgccgccggagcaggagaagatgatactcccggtggcgaagctcgggacgctgttgctgaagacgatgtcgaagcccatcgcgaccaggctcaaaacggaggccagccgccaccccaagttccggcagctcatcatcaacctcgcccaggcaaatcaccgcatctccacaaacatccagagaagagtctatggtcatgcaactaatgttgagattcgtccgttgaatgaggagaaagctgttcaagctgctgccgatcttattggggagctctttgctttctcggttgctggagctgccgtaatttttgaggtgcaaagaagtgcaaggtcagaggcccgaaaagaggaggctcgtaaaaatgaaattgaggcaataaggcaaaaggaggatcagctggctgaagagatattgactatgaagcagaagcttagtgagttggagcgcctcgccaactctcgaggtctctctggactgttcaggagcagcagtgtccagaccaaataaagcccacatgaccagtttgtttgactggaacaaaattaccgcttcatgcactctaaccaggtgaatcaacaatattcctgctctgttttttgaagctcccaccatgtgggtcacgtgtgttatccccactgaccattttgggagattccatcgatagttcttcaggggttcaaaacaccagtttcattttgcatttatcaacttggtccttgcaagttgtaaatgtgtgacatttactccacgagcttgtcgtggaaattgctgtcaaaatgtttgtagtaacacttattcagatgtc

SEQ ID NO: 43159 - protein, 161 aa, Panicum virgatum
  misc_feature: Ceres CLONE 2015448
  misc_feature (4)..(136): Pfam Name: OPA3 Pfam Description: Optic atrophy 3 protein (OPA3)
MILPVAKLGTLLLKTMSKPIATRLKTEASRHPKFRQLIINLAQANHRISTNIQRRVYGHATNVEIRPLNEEKAVQAAADLIGELFAFSVAGAAVIFEVQRSARSEARKEEARKNEIEAIRQKEDQLAEEILTMKQKLSELERLANSRGLSGLFRSSSVQTK

SEQ ID NO: 43160 - DNA, 580 bp, Panicum virgatum
  misc_feature: Ceres CLONE 2015452
  misc_feature: Encodes the peptide sequence at SEQ ID NO. 43161
aaatctggcaggcgccgcggtggggctgcgggcgcgggggagggcggggggctgagcggacggcgcggagggcggggagggaggggaggactgcgacaggctcaggccctggcgcaggaggctgctcgcgtccatggcgctctcgtggccctcggccatccgcctcgccgtcgccgccaccctgctcgtcgccgtcggagtcgcgctcttcacgctccccgtcgagaagattttaaaggattttctggtttggatcaaggagaacttgggtccatggggtcctttggtgctggcccttgcttacatccctctgacagtcttagctgttccagcatcaattcttacacttggagggggctatcttttcggcttgcctgttgggtttgttgctgattccattggagcaacaattggtgcaactgctgcatttcttcttggcaggacgattgggaggccttatgttctgtccaaatgcaaagattaccccaagtttcaagcagtagctattgcaatccaaaggtctggcttcaagatcgtgttgctactgaggcttgtacctttacttccattcaacatgttg

SEQ ID NO: 43161 - protein, 148 aa, Panicum virgatum
  misc_feature: Ceres CLONE 2015452
  misc_feature (65)..(148): Pfam Name: SNARE_assoc Pfam Description: SNARE associated Golgi protein
MALSWPSAIRLAVAATLLVAVGVALFTLPVEKILKDFLVWIKENLGPWGPLVLALAYIPLTVLAVPASILTLGGGYLFGLPVGFVADSIGATIGATAAFLLGRTIGRPYVLSKCKDYPKFQAVAIAIQRSGFKIVLLLRLVPLLPFNM

SEQ ID NO: 43162 - DNA, 919 bp, Panicum virgatum
  misc_feature: Ceres CLONE 2015454
  misc_feature: Encodes the peptide sequence at SEQ ID NO. 43163
atcccggttttactctgtcctttcccctgccgatccccttcccctccctccctccctcctcctcttcctcttcaccattccacccatcatccatctcgtctggcgatcaatcggttgcccgggcccagtcctcgcccatctcgtcgtattgggctcgattgcagagagccaggtggtgccgcgccgggcgaccaggtccgcatcctcgctcgatctcgaatcgatccatcatccatggggcggctgctgctggtgagcctgccggcgacgggcgccgtcatctaccgctgcaagcactgcgacacgcccctcgcctacgccacagacatcatctccaggatgttctgctgcaagaacggcaaggcgtacctgttcggcaagctggtgaacgtgaacgtcggggagaaggacgaccgggagatgacgacggggatgcacaccgtgtgcgacatcttctgcgtcgcctgcggatgcatcctgggctggaagtacctggccgccgtcgaaaaggatcagcgctacaaggtaggcaagttcatcctcgacaggggcgtgctggtggcggcggcgagtcccgctgctgctgctgccgccgccgcccatgggaatgggaatgggaatgggaatgggatgtggcagcagcagcagcagcagcagcagctgcagacgagcggcgacgaccaggacagcgatgaagaatcttctgaccaccaggattgatcgattcattcattgatgcctgagcatccatccatccatccatgcctgtaaataatacttgtgctactgcttagtccagtctgtcttcctagtgtttctgctgctgcttaatctttcttcttcttctttttgtttccgttccatatcgctggccgacttggcaaatgaaatggaatgcatttctagctggtgctgcttc

SEQ ID NO: 43163 - protein, 161 aa, Panicum virgatum
  misc_feature: Ceres CLONE 2015454
  misc_feature (1)..(111): Pfam Name: Yippee Pfam Description: Yippee putative zinc-binding protein
MGRLLLVSLPATGAVIYRCKHCDTPLAYATDIISRMFCCKNGKAYLFGKLVNVNVGEKDDREMTTGMHTVCDIFCVACGCILGWKYLAAVEKDQRYKVGKFILDRGVLVAAASPAAAAAAAAHGNGNGNGNGMWQQQQQQQQLQTSGDDQDSDEESSDHQD

SEQ ID NO: 43164 - DNA, 709 bp, Panicum virgatum
  misc_feature: Ceres CLONE 2015464
  misc_feature: Encodes the peptide sequence at SEQ ID NO. 43165
tacaaagattataagccctaatactgatgatgccaaatatgttataaatgtaaaacaaattgcaaagtttgtggttggattgggggataaggtttccccaactgatatcgaggaagggatgagggtcggtgttgatcgtaacaagtaccagattcaaattcctctgccaccgaaaattgacccaagtgttaccatgatgactgtggaggagaaaccggatgtgacatacaatgatgttggtggatgcaaggagcaaattgaaaagatgcgtgaagttgttgaacttcctatgcttcacccagaaaagtttgtcaagcttggtattgaccctccaaagggtgtcctttgctatggtccacctggtactggcaagacacttcttgcaagagctgtagcgaatcgaactgatgcttgtttcatccgagtaattggaagcgagttagttcagaagtatgttggagaaggtgctcggatggttagggaactgtttcagatggcccgctcgaagaaagcatgcattgtcttctttgatgaagttgatgctattggtggtgctcgttttgatgatggggttggtggcgacaatgaggtgcagcgcacaatgttggaaatagtaaatcaacttgatgggtttgatgcaagaggaaacatcaaggttctcatggcaactaacaggcctgataccttggatcctgcacttcttcgtcct

SEQ ID NO: 43165 - protein, 235 aa, Panicum virgatum
  misc_feature: Ceres CLONE 2015464
  misc_feature (113)..(235): Pfam Name: AAA Pfam Description: ATPase family associated with various cellular activities (AAA)
  misc_feature: SWISSPROT Homolog: EC 3.6.4.3 Microtubule-severing ATPase
TKIISPNTDDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLR

SEQ ID NO: 43166 - DNA, 1577 bp, Panicum virgatum
  misc_feature: Ceres CLONE 2015478
  misc_feature: Encodes the peptide sequence at SEQ ID NO. 43167
ggacttgctcttcttcgagaagaacaccccagcctcccgtgccacgtctctttaccttgccacctcatctcactgaccccccccccccaacccccccaaagtcccggagcccatccaatcccaactccatctctcttccccgcggcgcgagcaagggcgacgccggccacgacggcggcgtcggcgggaacccggcttccgctccatctcctcactccccccctctgatcacttctgactcgtgaaaatggtggatgaactgcgttctacgtctgtggtccagaaggttcatgggcagtccgtgttgttgagcagaatctcttcttgttctgccatgaataaccctgtattcaacaatgcgtattctgcctacaatgtgccccggaggtcataccacgggatgaatgcaactgttggactttcctctgtcatggcaccatctcctttctttgcttctgccccaaaagagaaaggtttttcaggatttatgattgactttctaatgggtggagtttctgctgctgtttccaagacagctgctgctccaattgagcgtgtcaagcttttgattcagaaccaggatgaaatgctcaagagcggcaggctttctgaaccgtacaagggtattggggagtgctttacccggacaatcaaagatgagggttttgtctcactgtggaggggcaacacagctaatgtcatccgttacttccccacacaggcattgaactttgccttcaaggaccacttcaagcgtatgttcaactttaagaaggacaaggatggatactggaagtggtttgctggcaacctggcttctggaggagctgctggtgcttgctctctcttctttgtttattctctggactacgctcgtacgcgtttggccaatgatgccaaagctgcaaagaagggtggtgagaggcagttcaatggactcgttgatgtttacaaaaagacccttgccagtgatggtatccgcggcctctaccatggattcaatatctcttgtgtgggaatcattgtctaccgtggtctttactttggaatgtacgactccctcaagccagtgcttcttgttggttccctgcaggataacttcttggccagcttcttgctcggctggggcataaccattggtgctggtcttgcctcgtaccctattgatactgttcgccgccgcatgatgatgacatctggtgaggctgtcaagtacaacagttccttggatgccttcaagcaaattgtcgcaaaggagggtaccaagtccctcttcaagggcgctggcgcgaacatcctccgtgctgttgctggggctggtgtccttgctgggtacgacaagctccaggtgattgtcttcggcaagaagtacgggtctgggggcggctaagagtagatgatgatgatgatgaacaacaaataggatgttttaggttcctttaaataacatacacatggacggcggacaccatttttaaattcagcacttggaagaggttgttgacttggtttgtaatgcggttgtcaccgcttctctttttgcgtgggagattgaaataagttaagttagaaattac

SEQ ID NO: 43167 - protein, 380 aa, Panicum virgatum
  misc_feature: Ceres CLONE 2015478
  misc_feature (79)..(176): Pfam Name: Mito_carr Pfam Description: Mitochondrial carrier protein
  misc_feature (184)..(280): Pfam Name: Mito_carr Pfam Description: Mitochondrial carrier protein
  misc_feature (284)..(374): Pfam Name: Mito_carr Pfam Description: Mitochondrial carrier protein
MVDELRSTSVVQKVHGQSVLLSRISSCSAMNNPVFNNAYSAYNVPRRSYHGMNATVGLSSVMAPSPFFASAPKEKGFSGFMIDFLMGGVSAAVSKTAAAPIERVKLLIQNQDEMLKSGRLSEPYKGIGECFTRTIKDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYKKTLASDGIRGLYHGFNISCVGIIVYRGLYFGMYDSLKPVLLVGSLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 43168 - DNA, 650 bp, Panicum virgatum
  misc_feature: Ceres CLONE 2015483
  misc_feature: Encodes the peptide sequence at SEQ ID NO. 43169
agaatttcagatgggtccttgttctgcttcgctcgctgccgcagtggcggccggcctcctcctcatctccggcggctgcgtcgtcgcccagcagccgccgccggtggcgcaaggcctgtcgttcgacttctacaagcggagctgccccaaggcggagtccatcgtgcggagcttcgtgcaggacgcggtgcgccgggacgtgggcctcgccgcgggcctcctgcgcctccacttccacgactgcttcgtccagggctgcgacgcctccgtcctgctcgacggctccgccaccggccccggcgagaagcaggcgccgcccaacctcacgctccgcccctccgccttcaaggccatcaacgacatccacacccgcctgcagagggagtgcgccgccgccgtcgtctcctgctccgacgtcctcgcgctcgccgcccgcgactccgtcgtcgcgtcgggaggcccgagctaccgggtgcccctggggcggcgcgacagcaccagcttcgcgacgcagcaggacgtgctcggcggcctcccgccgcccaccgccaccgccccggctctcctggccgtgctctccaagctcaacctggacgccgccgacctggtggcgctctccggcgggcacaccatcggcctcggccactgca

SEQ ID NO: 43169 - protein, 213 aa, Panicum virgatum
  misc_feature: Ceres CLONE 2015483
  misc_feature (52)..(212): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51663
  misc_feature: Useful for making plants with altered cell wall content and/or composition
  misc_feature: Functional homolog of the protein sequence given in SEQ ID NO 50376
  misc_feature: Useful for making plants with altered carbohydrate content
MGPCSASLAAAVAAGLLLISGGCVVAQQPPPVAQGLSFDFYKRSCPKAESIVRSFVQDAVRRDVGLAAGLLRLHFHDCFVQGCDASVLLDGSATGPGEKQAPPNLTLRPSAFKAINDIHTRLQRECAAAVVSCSDVLALAARDSVVASGGPSYRVPLGRRDSTSFATQQDVLGGLPPPTATAPALLAVLSKLNLDAADLVALSGGHTIGLGHC

SEQ ID NO: 43170 - DNA, 675 bp, Panicum virgatum
  misc_feature: Ceres CLONE 2015484
  misc_feature: Encodes the peptide sequence at SEQ ID NO. 43171
accgcaacccatctcctcccttcgctcccccagcgaccgccgctctccacgcggtcggcccgtgcgccgccctccacgctcccctgcccagctgcagctccagtccggctgctgcggcagcatcctcccttcccacgacttctctgttctttctctcggcctcggtcttcctttcctagcggcgacgaccgggcaagttgcgctgcccgttgttcgtcaagcgacgggcgcttcgccggcggcgaacatccgacacggtgcaatgcccggtggatcttcagctgctgatggtgatgtggaggcagggtttgcaaagctccagggcgaagatttcgagtactacatgcagacatattcaatcatgctgggccgcaacagcaagaaatcgacagtggatgtggatctctcgagcctcggcgggggtatgaacatctcccgccaccatgcccggatattctacgatttccagcgtcgtcggttcgccctcgatgttattggcaagaatggatgccttgttgagggtgttctgcacctccctggaaacccgcctgttaagcttgattcacaggatctgctgcagattggggacaaaaagttttactttctgctgccaacgcgatctatcttcgcctcaacggctgctgctcgacatgctcccattattcctccacctct

SEQ ID NO: 43171 - protein, 137 aa, Panicum virgatum
  misc_feature: Ceres CLONE 2015484
  misc_feature (33)..(108): Pfam Name: FHA Pfam Description: FHA domain
  misc_feature: Functional homolog of the protein sequence given in SEQ ID NO 50576
  misc_feature: Useful for making plants with altered alkaloid content
  misc_feature: Useful for making plants with altered lignin content
MPGGSSAADGDVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASTAAARHAPIIPPP

SEQ ID NO: 43172 - DNA, 527 bp, Panicum virgatum
  misc_feature: Ceres CLONE 2015488
  misc_feature: Encodes the peptide sequence at SEQ ID NO. 43173
ggccgcgtgtaatggcagcggtggtagctcggaagcaccgccgccggaggaggaggcccgacggagaattcacgtcggccgtgtggcggcagcggccccggagttcctcgtcgggagaccagtgcgcccggcggcggcgttgcgcgacctggactacttgggcttggccatcctcgtcagctttgatcccgccgcccctgctgctccgtggccgccatggcgtcgcccatgctctccgccaccaccgtcccgctccagggcgccggcctcggcgagttcaccggcctccggagctccgcgtcgctgccgctgcgccgcggtaatgccgccgcctccgacgacttcatgtccgccgtctccttcaggaccaacgcggtcgccaccagcggcgggccgcggcgggcgccggcggaggcgaagctcaaggtggcgatcaacgggttcgggcgcatcgggcgcaacttcctgcgctgctggcacgggcgcgacgactcgccgctcgacgtcatcgccatcaacgacaccgg

SEQ ID NO: 43173 - protein, 103 aa, Panicum virgatum
  misc_feature: Ceres CLONE 2015488
  misc_feature: SWISSPROT Homolog: EC 1.2.1.13 Glyceraldehyde-3-phosphate dehydrogenase (NADP(+)) (phosphorylating)
MASPMLSATTVPLQGAGLGEFTGLRSSASLPLRRGNAAASDDFMSAVSFRTNAVATSGGPRRAPAEAKLKVAINGFGRIGRNFLRCWHGRDDSPLDVIAINDT

SEQ ID NO: 43174 - DNA, 1193 bp, Panicum virgatum
  misc_feature: Ceres CLONE 2015496
  misc_feature: Encodes the peptide sequence at SEQ ID NO. 43175
acttccgttctccaccccctccccaaaatcccctcccccccacccctcgccgccggcgctgtcgcgtcctccgccgccagtcatggccgccgcgggtcccgggctctacaccgagatcgggaagaaggccagaggtttgagcggctcctcttgccttgcgagattcgggggctcgcttttgctgggatctcctctacaaggactaccacacggaccagaagttcacgctcaccacctacgcctccaacggagctgccattactgctgcaagcacaaggaaaaatgaagctatcttcagtgaaatccagagccagctgaagcatgaaaatgtgacagtggatgtgaaagcaacttcagaatctactgtgacgactacatttacaattcatgacctgtgcacaccaggtctgaaggcaattttatgcattcctttcccataccagaaatcagcaaaggctgaactccagtacttgcaccaccatgttggtgtcgctgctagtgttggcctgaatgcaaaccctgttattaacttttctggtgtattcgggactaaaactgtcgctgttggtgctgacgcttcatttgatacttcatctggggacttgaccaaatacaatgctggactgagctacactactagtgactttgttgctgcagccactctgaacaacaagggagacagccttgctgcttcctactaccacttggtgaattcaaccacagctgttggaggagagctgactcatagcttctcaagcaatgagaacaccctcacctttgggacacagcatgccctggaccctctgaccactgtgaaggcacgcttcaacaactatggcatggcaagtgcactcatccagcacgaatggaggcccaagtctttggtcaccatctccacggaggtcgacaccaaggccatcgagaagagctccaaggttgggctctccctggtccttaagccctgagggcgccagcttctggttttaggatgttagcttttgttatcagcagctgaagtccagtaaacaagcttggactaaacttgtaggctcagctttggtgccgtggggtctcagatcccacaaactcaattcattgcgtgttaccctgttctagactacttgaggggtttctgcttttaccagttaattcgtggttccaactgctctggccattcacgggctttttggtgg

SEQ ID NO: 43175 - protein, 41 aa, Panicum virgatum
  misc_feature: Ceres CLONE 2015496
  misc_feature: Functional homolog of the protein sequence given in SEQ ID NO 50463
  misc_feature: Useful for making plants with modulated drought sensitivity
MASALIQHEWRPKSLVTISTEVDTKAIEKSSKVGLSLVLKP

SEQ ID NO: 43176 - DNA, 667 bp, Panicum virgatum
  misc_feature: Ceres CLONE 2015497
  misc_feature: Encodes the peptide sequence at SEQ ID NO. 43177
ataccccagcactgtaatcgcctttctcttctagagcatacctggagaacagtttttcaccaagagtacctgtctcaggctaactggtaggcaccatttcacatcacacaaacacacaccttccttttgacttggaggccgggatactacaccatgccgattgagacgcccatgccggccctctccggccacggcctgacggtctgcgtgaccggcgccggaggattcatcgcctcctggctcgtcaagcgcctcctggagaagggctacactgtccgcgttgatcccaagaacgaccacctgagggcgcttgaaggtgccgccgaccgcctcactctcgtccgcgccgacttgctggagcccgacagccttctcgcggccttctccggctgcgagggtgtcttccatgctgcctccccggtcaccgatgatcccgagaagatgatcgagccggcgatccgcggcacaaggcacgtgatgacggtggccgcggacaccggcgtgaagcgcgtcgtgttcacgtcctccatcggcacggtgtacatgaacccataccgcgaccccaacgagcccgtcgacgacacctgctggagcgacctcgagtactgcaagaagaccgagaactggtactgctacgcgaagacggtggcggagcagggcgcgtggg

SEQ ID NO: 43177 - protein, 171 aa, Panicum virgatum
  misc_feature: Ceres CLONE 2015497
  misc_feature (17)..(170): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Functional homolog of the protein sequence given in SEQ ID NO 51664
  misc_feature: Useful for making plants with altered carbohydrate content
  misc_feature: Functional homolog of the protein sequence given in SEQ ID NO 50647
  misc_feature: Useful for making plants with altered cell wall content and/or composition
  misc_feature: Useful for making plants with altered lignin content
MPIETPMPALSGHGLTVCVTGAGGFIASWLVKRLLEKGYTVRVDPKNDHLRALEGAADRLTLVRADLLEPDSLLAAFSGCEGVFHAASPVTDDPEKMIEPAIRGTRHVMTVAADTGVKRVVFTSSIGTVYMNPYRDPNEPVDDTCWSDLEYCKKTENWYCYAKTVAEQGAW

SEQ ID NO: 43178 - DNA, 647 bp, Panicum virgatum
  misc_feature: Ceres CLONE 2015512
  misc_feature: Encodes the peptide sequence at SEQ ID NO. 43179
caccgagtgcaggtgcgacctgtacaatgtgacgatcgatgagcacggccggcgcatccccgaggactacaccggcgggctgtactgctgctatgatgagacccggtgcaaggtgaaggaagggttctccgatggtgaggtgaggaaggtgttcctgcggtacaccgtgacgtggctcgactggagtgatgcggttttgccggtgaagatctacatcttcgatgttactgacagagctctgcttgaggggaaatcagagcctgcttgcaaggtggagtaccaggtcgaggaatgcagctcagagaaccgggccaacaacgactgcgtccatgttcaggcaaccaaacaaatcttgccgcggggaggcgacatcgtgttcggcgttgcgcaccagcattcaggtggcatcgccgcctctctgcacggcgaggacggccggctgctgtgtgaatcggtggcaacctacggcgaagggcaggaggccgggaacgaggcaggctacatcgtcggcatgtcgacctgctacccgaagccgggaagcgtgacggtgcgcgacggcgaggtgctgaccgtggtgtccaactacagcagcgagaggcagcacacgggcgtgatgggccctctctacatcctcgtggccgagcaca

SEQ ID NO: 43179 - protein, 215 aa, Panicum virgatum
  misc_feature: Ceres CLONE 2015512
  misc_feature (1)..(215): Pfam Name: SURNod19 Pfam Description: Stress up-regulated Nod 19
TECRCDLYNVTIDEHGRRIPEDYTGGLYCCYDETRCKVKEGFSDGEVRKVFLRYTVTWLDWSDAVLPVKIYIFDVTDRALLEGKSEPACKVEYQVEECSSENRANNDCVHVQATKQILPRGGDIVFGVAHQHSGGIAASLHGEDGRLLCESVATYGEGQEAGNEAGYIVGMSTCYPKPGSVTVRDGEVLTVVSNYSSERQHTGVMGPLYILVAEH

SEQ ID NO: 43180 - DNA, 1376 bp, Panicum virgatum
  misc_feature: Ceres CLONE 2015515
  misc_feature: Encodes the peptide sequence at SEQ ID NO. 43181
agtctcttcctcttccccagttcacctagcggccacgggccaccgaccgctcgtccgctcttgaacccaatcgccgccaccgccatgactcttgcatccacctcccctctcgcagccgcccccgcccgtcccacgaaactccctcccttctcgcgctgcccccctcgccgcctcctgcgcgtctcctgccaggcgacgccggccgaccccccggcctgcgggggcggcaatgcgtcgaacgcctcgccggcgccgcagcagccgaggtggcgcgccgcgctctccgccgcgcttgccgcggccgtggtcgccgcagcggtgccggcctacgcggacctgaacaggttcgaggccgagcagcggggcgagttcggcatcggctccgccgcgcagttcggctcggccgacctcaagaaggccgtccatgttaacgagaacttcaggcgtgccaacttcacatctgctgacatgagagagtcagatttcagtggttcgacattcaatggtgcttatcttgaaaaggctgttgcttacaaagcaaatttcactggtgctgatttgagtgatacattaatggaccgcatggttctcaatgaagccaaccttacaaatgctgttcttgtacggtcagtcctcacacgtagtgaccttggaggagcgatcattgaaggggctgacttcagtgatgctgttattgacctaccacagaaacaggcattgtgcaaatatgcaagcgggaccaaccccataacaggggtaagcacccgaaaaagccttggatgtggcaatagccgtcgaaatgcatacgggagcccttcatcccctctgttgagtgccccaccacagaaacttcttgaccgcgatggtttctgtgatgaagctactggtatgtgcgatgcaaagtgagacatgattgatccagcatggaaactagtcatggatgcgtatatacattggagatcgagtgaaagagcagaatagtgcagagaactcgtcatttttcttctcctgatgcaattgttgtaagtttgcagcagaatcaggtaaacttcaggatgcagatgagaatatgagatatgggcactgagcactgaacgccatatatagcatagtaagtatatgacatagatcatgtcctgtgttttcagaagccagtatatccaaaacagaagtccaacacgggagtgtctctgtaaataaactttccactccatttcacaaatattgctgatgcatcggcagcgaccagagaactgccgttctgacgatggaccgcacaaatagacgtccatcggcagcttgactatttttacaaattgtcaagtcagttactgaagctccttagcttcagctttcagctagctacataccttatt

SEQ ID NO: 43181 - protein, 273 aa, Panicum virgatum
  misc_feature: Ceres CLONE 2015515
  misc_feature (117)..(156): Pfam Name: Pentapeptide Pfam Description: Pentapeptide repeats (8 copies)
  misc_feature (167)..(206): Pfam Name: Pentapeptide Pfam Description: Pentapeptide repeats (8 copies)
MTLASTSPLAAAPARPTKLPPFSRCPPRRLLRVSCQATPADPPACGGGNASNASPAPQQPRWRAALSAALAAAVVAAAVPAYADLNRFEAEQRGEFGIGSAAQFGSADLKKAVHVNENFRRANFTSADMRESDFSGSTFNGAYLEKAVAYKANFTGADLSDTLMDRMVLNEANLTNAVLVRSVLTRSDLGGAIIEGADFSDAVIDLPQKQALCKYASGTNPITGVSTRKSLGCGNSRRNAYGSPSSPLLSAPPQKLLDRDGFCDEATGMCDAK

SEQ ID NO: 43182 - DNA, 706 bp, Panicum virgatum
  misc_feature: Ceres CLONE 2015524
  misc_feature: Encodes the peptide sequence at SEQ ID NO. 43183
agggtgcaggatggacctactcaagagtgttcgaggccatggcccataactggtgcctgaagctgaatccgagggacaagaagagcggcgacgacaaggaatacgtctctcttaggcttgagttggcaaacagctcagtgaaacctgacactgttgtgaatgcatctttcaagttgctgatatatgaccagtccttcggaaagcacagcgagcatgaagttagccacagctttcagactgcaagcacaagctccggaatctcatgcatgatttcccttagaaaactgaagaaacagtcccctaaatttcttctcagcaattgctgcgtctttggtgttgaatttctcaaagttaccacttcgaaagccaacacgacgtcagagactctgtttgtccaaaaggtgagcatcttcaacgaggccaaaacttacacttgggatattgatgacttcttcgcactgaagaacccgggatactctccggagttcgaagtcggcggatacaaatggaatattataatgtatccgtcttgcgacgggaaccacctctccttgtacctgaaacttaaaaagaccaatgatcagcccaaggacactgcaaaccttgtagaacttactttgtacatcaaagaccaagaaactgacaagcaccggaaaggaacaggccggtgccagtttgcgaagacagtcgtacctggggatggaat

SEQ ID NO: 43183 - protein, 234 aa, Panicum virgatum
  misc_feature: Ceres CLONE 2015524
  misc_feature: SWISSPROT Homolog: EC 3.1.2.15 Ubiquitin thiolesterase
GAGWTYSRVFEAMAHNWCLKLNPRDKKSGDDKEYVSLRLELANSSVKPDTVVNASFKLLIYDQSFGKHSEHEVSHSFQTASTSSGISCMISLRKLKKQSPKFLLSNCCVFGVEFLKVTTSKANTTSETLFVQKVSIFNEAKTYTWDIDDFFALKNPGYSPEFEVGGYKWNIIMYPSCDGNHLSLYLKLKKTNDQPKDTANLVELTLYIKDQETDKHRKGTGRCQFAKTVVPGDG

SEQ ID NO: 43184 - DNA, 1609 bp, Panicum virgatum
  misc_feature: Ceres CLONE 2015531
  misc_feature: Encodes the peptide sequence at SEQ ID NO. 43185
gccgccacgcaccagcccagccatggcgttcgccgcgcggaggagcatcgccgcccgactatcccaccacctcacacgccgggtccatccctgcgtcccccacgcgctcacctcccactcccccgacgagcaggcgagctcgtcgccggcgctcccgaccccgctcccaccgctccacaccccgctccagcgccgttctggagcggcccaaaccctaggcgggctccctttctcgctccacctcgcggggccgacccgccgcagcttctcctcctcagccccggcccccgaccttgagcccaccccagtcgccgaggtcgatgccgcgggcgtccttgcagatgcagcggaggcggcggcggcggcggtgccggcgccgttcccgggggaggtggccgccgcggctgccgactcgttcctccccgtcgccgcgcttcagcacttcattgacgccgtccatacctttaccgggctaaattggtgggcgtgcatcgcgctgacaactttgattatccggaccgcgacaatcccgctgcttgtgaatcaattgaagtccatgacgaagttaaatgcaataaagccagagatggaagccattaaagatcagacggatactatggatctaaaatcagcacaggagggaaaagctaaaatggaggcactattcaagaagcatggtgttagtccatttgctccaatgaaagggcttctgattcaagggccagtattcgtgagctttttcttcgctatatcaaacatggttgagaaggtcccatcaatgaaaggaggcggagcattgtggtttactgatctgacgactccagattctctttacctccttcctgtggtaacaggactgaccgccttcgctacagttgagtttaacttgcaacaaggaatggagggaactcctatgaccggtaaaatgaagaacgttgctagaggaatggcttttatgacagtcccatttacaatgcattttgccaagggaattttttgttactggatcacatcaaacatattttcccttgcatacggtattgttatccgacagccagctgtgaggaagctgttaaatcttcctcctttggaaggtgagccctcgccagcaacaaaaaggccaatcttcaatttatttggtggatctcctgcagcagagtcacccgtagcaatcgcaggagcccagaratctgctctggggcagcctgatgctgctgctcttggatataaggtcaaaaatcttgagaagaaagtgaaatccagggggaaaaggaaaaacaggtgaatttgtgggcgtttgggcacctgatatggtcccaaaagtcggattttgcattaggaggcttcctttcttcatcacttgaggctgtattttcatttttggggttgaaataagccagagtaattttgacacacagaatcggacataaacaaaatgtattccaataacttgtgatagttgatattgctgttcatctcccaaggattgagatgaatatatactccaaaattcagggacaggcaatacccaaaaattctagagggaccgtctgacaatgctagcgactggctagtagctagcctcaaattgtactatttcgtggtatcc

SEQ ID NO: 43185 - protein, 420 aa, Panicum virgatum
  misc_feature: Ceres CLONE 2015531
  misc_feature (152)..(347): Pfam Name: 60KD_IMP Pfam Description: 60Kd inner membrane protein
  misc_feature (389)..(389): Xaa is any aa, unknown, or other
MAFAARRSIAARLSHHLTRRVHPCVPHALTSHSPDEQASSSPALPTPLPPLHTPLQRRSGAAQTLGGLPFSLHLAGPTRRSFSSSAPAPDLEPTPVAEVDAAGVLADAAEAAAAAVPAPFPGEVAAAAADSFLPVAALQHFIDAVHTFTGLNWWACIALTTLIIRTATIPLLVNQLKSMTKLNAIKPEMEAIKDQTDTMDLKSAQEGKAKMEALFKKHGVSPFAPMKGLLIQGPVFVSFFFAISNMVEKVPSMKGGGALWFTDLTTPDSLYLLPVVTGLTAFATVEFNLQQGMEGTPMTGKMKNVARGMAFMTVPFTMHFAKGIFCYWITSNIFSLAYGIVIRQPAVRKLLNLPPLEGEPSPATKRPIFNLFGGSPAAESPVAIAGAQXSALGQPDAAALGYKVKNLEKKVKSRGKRKNR

SEQ ID NO: 43186 - DNA, 877 bp, Panicum virgatum
  misc_feature: Ceres CLONE 2015535
  misc_feature: Encodes the peptide sequence at SEQ ID NO. 43187
agcaacgaagatcgtagcaacacaacagcagcaaaagcatacagccttttagccactgctctctctccgaccgcccgtgcatttccgatggcaaccacggtgatgtcctccatgagctccctcgccttcgccaccagcgtgcgtgccggccgcgtggccccggtgtacggccttgcgccgcgccgtcgcgccctggtcgtcagggcccagactgagccggacgttgagccaacggaggaaacgtcgacgaccacttcagccccttcctcgccgttgccgagcaccccgccgacgcccaagcccaaggccaacaagcccgccaagcccggcctgtgggacgcgctggcgttcagcggcccggcccccgagcgcatcaacgggcgtctcgccatggtgggcttcgtgtccgcgctcgccgtcgaggcgtcgcgcggcggcggcctcctctcgcaggccggcagcgggtccgggctggcctggttcgcggtgaccgcggccgtgctgtcggcggcgtcgctggcgccggtgctgcagggggagagcgcggaggcgcgcagcaaggggttctggagcgccgacgccgagctgtggaacggtcgcttcgccatgctcggcctcgtcgctctcgccgtcaccgagtacatcaccggcgcgcccttcgtcaacgtctgaacggctgaagaacgagtcgtcctcggcttcatgaggaaaagcgtgcgtacgttgaattgtatgtatggacgccgtagtagcttcgtaggatttgtatgtatgtgtgaatgctggctttctgtacgtgcgtgcatacgtactttgcatgtgcgtgcgtccaagaattgtactgccatgatgacacatcaaacattcagctagcacg

SEQ ID NO: 43187 - protein, 194 aa, Panicum virgatum
  misc_feature: Ceres CLONE 2015535
  misc_feature: SWISSPROT Homolog: EC 4.99.1.1 Ferrochelatase
MATTVMSSMSSLAFATSVRAGRVAPVYGLAPRRRALVVRAQTEPDVEPTEETSTTTSAPSSPLPSTPPTPKPKANKPAKPGLWDALAFSGPAPERINGRLAMVGFVSALAVEASRGGGLLSQAGSGSGLAWFAVTAAVLSAASLAPVLQGESAEARSKGFWSADAELWNGRFAMLGLVALAVTEYITGAPFVNV

SEQ ID NO: 43188 - DNA, 1149 bp, Panicum virgatum
  misc_feature: Ceres CLONE 2015545
  misc_feature: Encodes the peptide sequence at SEQ ID NO. 43189
agtacaggaacgaagggcaccttccagccacggcatggagaagagcaaggttcttgtcgtgggtggcgcgggcttcatcggccggcggcttgtcgcggcgagcctggcacagggccacccgactttcgtcctgatgcggtcggagatcggcgtcgacgtggacaaggtccagacgctgctgtccttcaaggccaagggggcgcgcctggtggaggcgtcgctcgacgaccacgcggggctcgtcgccgccgtgaggcaggtggacgtagtcgtgtcggccttgtccgggacgtacatccgcagccaggtcaagctcgtcgaggcgatcaaggaggctgggaacgtcaagcgtttcctaccgtcggaattcggcatggacccgtcgaagatggagcatgctcttgcgccaggaagaattacattcgacgacaagatggaggtacggagggcgatagaggcggcgagcattccccacacctacatttcttgcaattgctttgcggcctacttttgtccgagcctcggccaaatcggcactcttctgcctcccaaagataaggttcgtgtatatggagacggcaatgtcaaagtcatttttgtggatgaagatgatgcggcaacatatataatcaagaccctagatgaccctcgcaccttgaacaagtcaatatacctaaggccatcggaaaacatcctttctcagagtgacctgatcgtgaaatgggaaaacctctctggaaatgttcttgagaaaatctgcattccagctgatgagttcttggcttcaatgaaagataaggattttggcaatcaatttgtaatgggacacatctaccacattttttacgaaggttgcctgacaaactttgacattggggaggacggagcagaagcaactcttctgtacccggaggttgagtacacccgcatggatgattatatgaaaagatatgtgtaacttttaatgtttttggtgacgtatcttatcatatcagaatccgtagacactgtgtcaggaaatataaggtgttacattgcacagtggctgagtggcacatactatactttggtttgtaatcaagctttcataaagaacgtgcatatattgggcatgtagacacttcaataaaaaaatttggtttctagtcc

SEQ ID NO: 43189 - protein, 307 aa, Panicum virgatum
  misc_feature: Ceres CLONE 2015545
  misc_feature (6)..(298): Pfam Name: NmrA Pfam Description: NmrA-like family
  misc_feature: SWISSPROT Homolog: EC 1.3.1.45 2'-hydroxyisoflavone reductase
MEKSKVLVVGGAGFIGRRLVAASLAQGHPTFVLMRSEIGVDVDKVQTLLSFKAKGARLVEASLDDHAGLVAAVRQVDVVVSALSGTYIRSQVKLVEAIKEAGNVKRFLPSEFGMDPSKMEHALAPGRITFDDKMEVRRAIEAASIPHTYISCNCFAAYFCPSLGQIGTLLPPKDKVRVYGDGNVKVIFVDEDDAATYIIKTLDDPRTLNKSIYLRPSENILSQSDLIVKWENLSGNVLEKICIPADEFLASMKDKDFGNQFVMGHIYHIFYEGCLTNFDIGEDGAEATLLYPEVEYTRMDDYMKRYV

SEQ ID NO: 43190 - DNA, 638 bp, Panicum virgatum
  misc_feature: Ceres CLONE 2015556
  misc_feature: Encodes the peptide sequence at SEQ ID NO. 43191
ccatccggcaccgcaacatcgtgcggctcctcgggtgggccgccaacggcggcacccggctgctgttctacagctacctccccaacggcagcctgagcgggctgctccacggcggcggcctcgcgggggccaagggcgcgcccgcggacgggtggggcgcgcgcttcgacgtcgcgctcggcgtcgcccacgccgtcgcgtacctccaccacgactgcgtgccggccatcctccacggcgacgtcaagtccatgaacgtgctgctcggcccggcctacgagccgtacctcgccgacttcggcctcgcccgcgtcctctccgccgccacctccaagctcgacgccggcaagcagacgcgcatcgccggctcctacggctacatggcaccagagtacgcgtcgatgcagcggatcagcgagaagagcgacgtgtacagcttcggcgtggtggtgctggagatgctgacggggcggcacccgctggacccggcgctgcccggcggcgcgcacctggtgcagtgggtgcgcgagcacatgcaggccaagcgcgatgcgtgggagctcgtggacgcgcggctccgggcgggcgcctccgaggcggacgcgcacgagatgcggcaggtgctgtccgtgggcgcg

SEQ ID NO: 43191 - protein, 211 aa, Panicum virgatum
  misc_feature: Ceres CLONE 2015556
  misc_feature (1)..(205): Pfam Name: Pkinase Pfam Description: Protein kinase domain
  misc_feature: SWISSPROT Homolog: EC 2.7.11.1 Non-specific serine/threonine protein kinase
IRHRNIVRLLGWAANGGTRLLFYSYLPNGSLSGLLHGGGLAGAKGAPADGWGARFDVALGVAHAVAYLHHDCVPAILHGDVKSMNVLLGPAYEPYLADFGLARVLSAATSKLDAGKQTRIAGSYGYMAPEYASMQRISEKSDVYSFGVVVLEMLTGRHPLDPALPGGAHLVQWVREHMQAKRDAWELVDARLRAGASEADAHEMRQVLSVG

SEQ ID NO: 43192 - DNA, 703 bp, Panicum virgatum
  misc_feature: Ceres CLONE 2015581
  misc_feature: Encodes the peptide sequence at SEQ ID NO. 43193
gatgcgatcataccagcactaaagcaccggatcccatcagaactccgaagttaagcgtgcttgggcgagagtagtactaggatgggagagcaccgccgccagccagccacaaactccgccacgggaaggacctgacctgacttgctcgctcgtcacaaggcaggctatggcgctcgcgtccacctccgccgccgcccctgcggccgtgctcaagaccccgttcctcggggcccggcgcgcgcttgccaatgccgcctccgtcgccgccaggcccgcgccgcgccgcgcgctcgtcgtcgccgcggccgccgccaagaagtcgtggatccccgccttcaagagcgacgccgagttcatcaacccgccgtggctcgatggctcgctccccggcgacttcggcttcgacccgctgggcctgggcaaggacccggcgttcctcaagtggtaccgcgaggcggagctgatccacgggcggtgggcgatggccgccgtgctgggcatcttcgttggccaggcgtggagcggcatcccgtggttcgaggccggcgccgacccgggcgccatcgcgcccttctccttcggctccctcctcggcacgcagctgctgctcatggggtgggtggagtcgaagcggtgggtggacttcttcaacccggactcgcaggccgtcgagtgggccaccccctggtcgcgcaccgccgag

SEQ ID NO: 43193 - protein, 178 aa, Panicum virgatum
  misc_feature: Ceres CLONE 2015581
  misc_feature (64)..(178): Pfam Name: Chloroa_b-bind Pfam Description: Chlorophyll A-B binding protein
MALASTSAAAPAAVLKTPFLGARRALANAASVAARPAPRRALVVAAAAAKKSWIPAFKSDAEFINPPWLDGSLPGDFGFDPLGLGKDPAFLKWYREAELIHGRWAMAAVLGIFVGQAWSGIPWFEAGADPGAIAPFSFGSLLGTQLLLMGWVESKRWVDFFNPDSQAVEWATPWSRTA

SEQ ID NO: 43194 - DNA, 1231 bp, Panicum virgatum
  misc_feature: Ceres CLONE 2015588
  misc_feature: Encodes the peptide sequence at SEQ ID NO. 43195
ggctccatcacgccacgcgcgctcctgctccgtcgtccctgcacctagacgtaaccatcgcagccagcgcgacgcatctgacccgcggagaccaggcgcgcacggcgcatcgcatcggcatggcgtccgcggcggtgccggaggtggccctgcggtcgggcggcgcgcggccgatgccggcggtcggcatgggcacggcgacgttcccgccggcgcccggcggggtcaccaaggacgcggtgctggcggccatcgaggtgggctaccgccacttcgacacggccgccatgtacggcacggagcggccgctcggcgacgccgtggccgaggcggtgcgccgcgggctcctccggtcccgggaggaggtgttcgtcacgtccaagctctggtgcacgcagagccacccggacctcgtcctcccctccctccgggagaccctcaagagcctgcagatggagtacctggacctgtacctgatccactggccggtggccctcaagcccgggccgctgactttccccaacaggaaggaggacgccgtgccgctcgacttggagggcgtgtggcgcgccatggaggagtgccagcggctggggctcgccagggccatcggcgtcagcaacttcaccaccaggcacctcggcagggtgctcgccgccgccgccgtcccccccgcggtgaaccaagtggagctcaacccggcgtggcagcagcgggcgctgcgggcgtactgcgccgacaagggcgtccacgtcgcggcctactcgccgctggggggccagaactgggacggcacaggcagcaacgccgtgctggagtcggaggtgctcgccgggatcgccagggcgagggggaaatccgtcgcgcaggcggcgttgaggtggatatacgagcagggcgtgacgtccatcgtcaagagctacaacaaggagaggctcaagcaaaacctcgacatcttcgactgggagctgacggacgacgaccggctcaagatcagccagatcccgcagaagaagattgtcaaggccgagggtttgttctcgcaggagggtgagttcacgtccgttgatccagcggacctggacatcgtagaggaatagggaacgcggaatgatatgcgcccgcgcggctccgtatgaacatttgaataagaccaggcttttccgtgccgatggagtaatttctttttgttacctccttgtaatgttcgatatgggaacgtttcctctca

SEQ ID NO: 43195 - protein, 326 aa, Panicum virgatum
  misc_feature: Ceres CLONE 2015588
  misc_feature (11)..(297): Pfam Name: Aldo_ket_red Pfam Description: Aldo/keto reductase family
  misc_feature: SWISSPROT Homolog: EC 2.3.1.170 6'-deoxychalcone synthase
  misc_feature: Functional homolog of the protein sequence given in SEQ ID NO 51665
  misc_feature: Useful for making plants with modulated drought sensitivity
  misc_feature: The sequence is a functional homolog of SEQ ID NO 26 in US patent 7193127
MASAAVPEVALRSGGARPMPAVGMGTATFPPAPGGVTKDAVLAAIEVGYRHFDTAAMYGTERPLGDAVAEAVRRGLLRSREEVFVTSKLWCTQSHPDLVLPSLRETLKSLQMEYLDLYLIHWPVALKPGPLTFPNRKEDAVPLDLEGVWRAMEECQRLGLARAIGVSNFTTRHLGRVLAAAAVPPAVNQVELNPAWQQRALRAYCADKGVHVAAYSPLGGQNWDGTGSNAVLESEVLAGIARARGKSVAQAALRWIYEQGVTSIVKSYNKERLKQNLDIFDWELTDDDRLKISQIPQKKIVKAEGLFSQEGEFTSVDPADLDIVEE

SEQ ID NO: 43196 - DNA, 1221 bp, Panicum virgatum
  misc_feature: Ceres CLONE 2015590
  misc_feature: Encodes the peptide sequence at SEQ ID NO. 43197
gaagccgctagggtttatcacctctgcccatatcacaaagcctagggtttctcgggcgctgctgcttgcgcgagagagcagagggggatcgaggatgattcggcggaaccagaggatgcggcgggagtacctgtacaccaagagcctggagggagccgagcgggcgctgttcgagaagaagcgccgcatccggcaggcgctcgaggagggcaagcccatccccaccgagctccgcaacgaggagcacgagctgcggcggcagatcgacctcgaggaccaggagcgtcaggtttcgaggagcttcgttgataatgagtacgcgactagcacgattcgggagcccaagatactcttgaccacgtctcgcgatcccagcgcccccctgattcagtttgttaaggagctgaaggttgtctttcccaactcgcaaagaattaaccgtggtggtcaggtgttatcagatattgttgagtcttgccggtcacatgatgttactgatcttattttagtccacgaacatcgtggccaacctgatggtttggtcatctctcatctaccgcaaggtccaactgcatactttggattactcaatgtggtgacaaggcatgacatcaaggacaggaaggcaatgggcaaaatgtcagaagcttacccccatttagtacttgacaacttctcaaccaagattggtgaaaggactgctactattctgaagcacctctttcctgtgccaaagccagattctaagcgaataattacttttgctaatagggacgactacatttctttcaggcatcatgtctacgagaaaccaggcggccccaagtctatcgacctgaaagaggttggcccccgatttgagatgcggctgtacaagctcaaactaggaactatggaacaaaacgaagcgccatttgagtttgagctgcggccctacatcagcactgccaagaaacaaaggaccctaggcgcatgaattgagtgaatgcagtttgtttgatgatccgcactgcagtacagcggtttttagtttgttttggcccttcaccatttactgtaatagtagcatcaatgcacagtgtaatgtgtcttgtattacttatcccaatttcgggtcctgcctcttgtgttctctacattctggtcgttcctttctgaagtagacatgaactcttttgtaaattttcgtatcattcactcgaatttgtgattgattgtcct

SEQ ID NO: 43197 - protein, 293 aa, Panicum virgatum
  misc_feature: Ceres CLONE 2015590
  misc_feature (86)..(262): Pfam Name: Brix Pfam Description: Brix domain
MIRRNQRMRREYLYTKSLEGAERALFEKKRRIRQALEEGKPIPTELRNEEHELRRQIDLEDQERQVSRSFVDNEYATSTIREPKILLTTSRDPSAPLIQFVKELKVVFPNSQRINRGGQVLSDIVESCRSHDVTDLILVHEHRGQPDGLVISHLPQGPTAYFGLLNVVTRHDIKDRKAMGKMSEAYPHLVLDNFSTKIGERTATILKHLFPVPKPDSKRIITFANRDDYISFRHHVYEKPGGPKSIDLKEVGPRFEMRLYKLKLGTMEQNEAPFEFELRPYISTAKKQRTLGA

SEQ ID NO: 43198 - DNA, 728 bp, Panicum virgatum
  misc_feature: Ceres CLONE 2015602
  misc_feature: Encodes the peptide sequence at SEQ ID NO. 43199
agcggcattctcctggacgttatgcacaggctgaggagggtgaggaggacgatgaaattgagcgactcttcaagggtaataaaaagaagaagaagaatgatcgcccacgtgcagatattggtcttatagtggaacaattcatcgctgagttcgaggtagcagctgaagaagatgcgaacttgaataggcagtcaaaaccagccattaataaacttatgaaacttccactgctcatagatgttctctccaagaagaatcttcagcaggaatttcttgatcatggagttctcactcttctaaaaaattggcttgagccattgccagatggaagcatgccaaacatgaatattcgatctgctgtacttaaattattaactgattttccaattgacttggagcaatatgacagaagagagcagcttaagaaaagtggtctgggaaaggtcattatgtttttgtccaaatctgatgaagagacttgcaaataggaaactggctaaggagttggttgacaaatggagtcgaccaatattcaacaagagtacgagatttgaggatatgaggagatatgatgatgaaagagcgccttacaggcggccacaaatgaagaagccttcgtcaagtagctctggaatggaatctagagatgatgatcttgatgccgacttctcacaacgcaagtctgggcaaagtaggtcaaggcagcatgcttcagggccagaagcctc

SEQ ID NO: 43199 - protein, 161 aa, Panicum virgatum
  misc_feature: Ceres CLONE 2015602
  misc_feature (41)..(161): Pfam Name: IWS1_C Pfam Description: IWS1 C-terminus
RHSPGRYAQAEEGEEDDEIERLFKGNKKKKKNDRPRADIGLIVEQFIAEFEVAAEEDANLNRQSKPAINKLMKLPLLIDVLSKKNLQQEFLDHGVLTLLKNWLEPLPDGSMPNMNIRSAVLKLLTDFPIDLEQYDRREQLKKSGLGKVIMFLSKSDEETCK

SEQ ID NO: 43200 - DNA, 1389 bp, Panicum virgatum
  misc_feature: Ceres CLONE 2015625
  misc_feature: Encodes the peptide sequence at SEQ ID NO. 43201
aaaaaggagggaggagattttctctcttcttactcttttttaccttattttctatttactaacatgaagttctctatcttgactgctgccttgctgatggctggttatgccactgctgttcccatgatgaaccctacctccttcaacgatggttccgtagcacctttatacgctcctgttgagaccgaagctgttcgtggctcatacattgtcgtcctcaagaatgatttggatgccaaacaaattgaaaatcatgctgaatggattagcagcatgtctgctgctcatgccctcaacaacggcgattatttgaatgaatatgaccatggtatcaaccatgtttatgagatgccaaacttcaagggttactctggtaaatttgataagaaactcttggacgctatccgtcaatcagatgaagttgcctatgtcgaagaggattctgttgtttatgctagtgaattgcaacgcggtgctccttggggtcttgctcgtatctctacacgtgatcgtctctctcttcgcaactttaacaagtacaactacgatgctgataccgctggtgagggtgtcaaggtgtacgtcattgatactggtatcaatgtgaagcatgttgatttcggtggcagagctatttggagtaagaccatccccaagaacgatgaagatgttgatggcaacggtcatggttctcattgtgcaggtactatcggaggaaagaagtatggtgtggccaagaagtctatccctgttgctgttaaagtattggcttcaaacggtagtggtagtatgtctgatgtcgttaagggcgttgattgggctaccaacgagtatctcaaggataagaaggctgctttgcaatccaagaagcctttcaagggctctgctgccaacatgagtttgggtggtggtaaatctccttctttggatgccactgtaaacggcgctgttgaagctggtcttgtgtttgctgttgctgctggtaatgataacaaggatgcttgtaattattctcctgctcgtgccgaaaaggccattactgttggtgcctccaccatctttgatgaacgtgcctacttctccaactttggtgaatgtgttgatgtctttgctcccggtttgaacattgaatccatctggaacaccaacgatcacgctaccaataccatctctggtacttctatggcctcccctcatgttgctggtcttgctgcctaccttttggctcaagctcccgaaggcaccactcccaaggaaatcaagaagcaagtgcttgaattagctacccgcaatgtattcaaggaacttcctgccaagactcccaatcttctcatttacaacggtttcgagtaaatcatattataaatatcgagtaaattatatctcttc

SEQ ID NO: 43201 - protein, 429 aa, Panicum virgatum
  misc_feature: Ceres CLONE 2015625
  misc_feature (148)..(422): Pfam Name: Peptidase_S8 Pfam Description: Subtilase family
  misc_feature (46)..(132): Pfam Name: Subtilisin_N Pfam Description: Subtilisin N-terminal Region
  misc_feature: SWISSPROT Homolog: EC 3.4.21.48 Cerevisin
MKFSILTAALLMAGYATAVPMMNPTSFNDGSVAPLYAPVETEAVRGSYIVVLKNDLDAKQIENHAEWISSMSAAHALNNGDYLNEYDHGINHVYEMPNFKGYSGKFDKKLLDAIRQSDEVAYVEEDSVVYASELQRGAPWGLARISTRDRLSLRNFNKYNYDADTAGEGVKVYVIDTGINVKHVDFGGRAIWSKTIPKNDEDVDGNGHGSHCAGTIGGKKYGVAKKSIPVAVKVLASNGSGSMSDVVKGVDWATNEYLKDKKAALQSKKPFKGSAANMSLGGGKSPSLDATVNGAVEAGLVFAVAAGNDNKDACNYSPARAEKAITVGASTIFDERAYFSNFGECVDVFAPGLNIESIWNTNDHATNTISGTSMASPHVAGLAAYLLAQAPEGTTPKEIKKQVLELATRNVFKELPAKTPNLLIYNGFE

SEQ ID NO: 43202 - DNA, 1271 bp, Panicum virgatum
  misc_feature: Ceres CLONE 2015639
  misc_feature: Encodes the peptide sequence at SEQ ID NO. 43203
atataggaataagccagccacacacactgacagtctgacagacttgaccatcatttccctgcatattttttgtactgtagctcctcaacccaaccaccactccaccaccagctcccatggacgatggatctatctccagagcattccatatatataagctttagctcattaattcccattccttccctggatagatcgatagatccatagaggagctgaacatcatcacaaacaactggccaaaaacccatctacccggccggccaccatggctgctgtcaataacaagcaggccacctccgcggcggcgctagtcttcctcggcgtgttggtcgccgtcctggccgcagaggacgccggcacgacgcacctgaccttcttcatgcacgacatcgtgtcgggcagcagcccgacggcggtgcaggtgatcaagggccccggcgggtcggcgacggccgcgacgctgggcatgtccttcggcgacaccctggtgatggacgacccgctgacggagacctcgtcgccgacgtcggcggcgctggggcggatgcagggcttctacctggtgtcggcccagtcgggcctggtgctgacggtgtgcggcaacctgctgctgacctcgggggaccacaacggcagcaccatcgccgtgctggggcgcgacgacacgggcgccgacgtgcgggagctcgccgtcgtgggcggcaccggcaagttcaggatggccaccggctacgtgctgtggaagacgtccagcgccaagggcgccgacgccaccctccagctggacgtgtacctcaccacctcgggcaacgccaccaccatcgacgccggggcgcccgtctcgcccgctggcggcggctcctctgcagggccgtcctccgggtccaagtcgagctcgggtgctgctgcgagggccgccggcgggtgggtcgccgtggtggttgcggcggttgttggatcgtcctggctttggtgaccggattaacgacgagtggtggacattggatgcgttagttggtgagtgtgtggaaagttgggtgagatgtcggtcggtggggtttgctttggtgtggtggatcgagctgaggacggagatgcttgcttgcacgctgcatcatggcctcatggcatgggtgtaggcctcatttcttttcctctaccctactactaccccaccacgatgcatgtggattcttcttgctttctgctgatgaggctttctttctttgcttgtcatacatgcaaacatcatggataatattgttcag

SEQ ID NO: 43203 - protein, 236 aa, Panicum virgatum
  misc_feature: Ceres CLONE 2015639
  misc_feature (13)..(179): Pfam Name: Dirigent Pfam Description: Dirigent-like protein
MAAVNNKQATSAAALVFLGVLVAVLAAEDAGTTHLTFFMHDIVSGSSPTAVQVIKGPGGSATAATLGMSFGDTLVMDDPLTETSSPTSAALGRMQGFYLVSAQSGLVLTVCGNLLLTSGDHNGSTIAVLGRDDTGADVRELAVVGGTGKFRMATGYVLWKTSSAKGADATLQLDVYLTTSGNATTIDAGAPVSPAGGGSSAGPSSGSKSSSGAAARAAGGWVAVVVAAVVGSSWLW

SEQ ID NO: 43204 - DNA, 573 bp, Panicum virgatum
  misc_feature: Ceres CLONE 2015641
  misc_feature: Encodes the peptide sequence at SEQ ID NO. 43205
gttccccctccctagctccctctcggcgacggcgcacgggctcgttccgccggaattccagtcgagcggcgggtggcagcagccatggatgagtggattcgccaggccgagttgtgggggcgccaggccgaggcctggatccgtcagcagcccccggagcagatctacgtcgcggccgcggtggtcgccctcaccatcctggtgcttgtcgcatcatcttgtctgaaatcctcgaaacgaaacaccatagtgctatctgggcttagtggcggtggcaaaactacactcttctaccagcttcgggatggatcatcacatcaaggaactgtgacttcaatggaaaaaaacaatgatacgtttgtgctgcattcagagcaagaaaggataggcaaagtaaaacctgtgcatattgttgatgttcctggtcatgcaaggctcaaacccaagcttgatgaagtcctgcctaaagcagctggggttgttttcgttgttgatgctcaatatttcttgtctagcatgcaagcttctgcagagtatctgtatgacattctgacaaatgcagctgtagcgaag

SEQ ID NO: 43205 - protein, 162 aa, Panicum virgatum
  misc_feature: Ceres CLONE 2015641
  misc_feature: Functional homolog of the protein sequence given in SEQ ID NO 51666
  misc_feature: Useful for making plants with modulated cold sensitivity
MDEWIRQAELWGRQAEAWIRQQPPEQIYVAAAVVALTILVLVASSCLKSSKRNTIVLSGLSGGGKTTLFYQLRDGSSHQGTVTSMEKNNDTFVLHSEQERIGKVKPVHIVDVPGHARLKPKLDEVLPKAAGVVFVVDAQYFLSSMQASAEYLYDILTNAAVA

SEQ ID NO: 43206 - DNA, 664 bp, Panicum virgatum
  misc_feature: Ceres CLONE 2015648
  misc_feature: Encodes the peptide sequence at SEQ ID NO. 43207
gccgagccacgtccacctgctgtgctttccctccttccctccctcgcgaattcctccgcggccgcgcgatttctgcgcccttccttcacctccctccgcagctaaattacggttccgcccctgctcccgcaccgtctccgcggccatggaccaagcctcgggctcggggccccctccgccgccgccgcccccgcccgcggccgagagagacatgggcttcgccgagcgctccctcgcggcggccggcgcggccgttgtgtccgccgtcctcgtcaaccccctcgacgtcgccaagacgaggttgcaagcgcaagctgctggagttgtatataatcctatatggtcagattttaggtgctatccatcatgcagcactggtgggatcaatggttttggcccatcttgcagccctgagtgctttcagtacaggggaactatggacgtgttctctaaagtcactagacaggaaggattattcagattatggagaggtactggtgcaagcctagcattggctgtgccaacggttggaatatatctaccttcttatgatttattgcacaattggattgaagaatactcagatcataattgtccaaaactaagaccatatgctcctctcatttctggcactattgcacgatcgctggcatgcataacttgt

SEQ ID NO: 43207 - protein, 172 aa, Panicum virgatum
  misc_feature: Ceres CLONE 2015648
  misc_feature (24)..(146): Pfam Name: Mito_carr Pfam Description: Mitochondrial carrier protein
MDQASGSGPPPPPPPPPAAERDMGFAERSLAAAGAAVVSAVLVNPLDVAKTRLQAQAAGVVYNPIWSDFRCYPSCSTGGINGFGPSCSPECFQYRGTMDVFSKVTRQEGLFRLWRGTGASLALAVPTVGIYLPSYDLLHNWIEEYSDHNCPKLRPYAPLISGTIARSLACIT

SEQ ID NO: 43208 - DNA, 678 bp, Panicum virgatum
  misc_feature: Ceres CLONE 2015662
  misc_feature: Encodes the peptide sequence at SEQ ID NO. 43209
ctctgacggcgtggggccgagatgcagtggttctcctccggctccgggccctcctcctcggcggcggcgtcctcctcccagccgtcgctgctcgcggattggaactcctacgccgccgcccgctccgccgaggacgcgggcgatggcttcgggatcgacatcgaggccgccgtccgctccgccaacgaccgcgtcgccggcaccttcggcgtggtctcaaacggtgttaaagggttgcctggcagcttcaagtccacaacaagcagtgttacatctggcggatctctcatgtatttcggactgtttcttgctagtggcgtattcctagttttcattgcattcacaatatttctgccagtcatggtgataatgcctcaaaagtttgcaatctgtttcacggcgggatgtgccttcataatcggatcattctttgcactgaaagggcctaagaatcagctctatcatatgatttccaaagagagattacctttcaccgtgggatttgtcggcagcatggttgccaccatttatgtgtcaatggtgcttcatagctacatactttctgttttcttctccgtgcttcaggtccttgctctagcatattatgccatctcatacttccctggtggatctgctggaatgaagtttctatcatctgctcttgtgtcctcggtgctg

SEQ ID NO: 43209 - protein, 218 aa, Panicum virgatum
  misc_feature: Ceres CLONE 2015662
  misc_feature (83)..(207): Pfam Name: SFT2 Pfam Description: SFT2-like protein
MQWFSSGSGPSSSAAASSSQPSLLADWNSYAAARSAEDAGDGFGIDIEAAVRSANDRVAGTFGVVSNGVKGLPGSFKSTTSSVTSGGSLMYFGLFLASGVFLVFIAFTIFLPVMVIMPQKFAICFTAGCAFIIGSFFALKGPKNQLYHMISKERLPFTVGFVGSMVATIYVSMVLHSYILSVFFSVLQVLALAYYAISYFPGGSAGMKFLSSALVSSV

SEQ ID NO: 43210 - DNA, 1072 bp, Panicum virgatum
  misc_feature: Ceres CLONE 2015678
  misc_feature: Encodes the peptide sequence at SEQ ID NO. 43211
gttgtttcatcgagagaaggcgccgcgcgcaagcaatcctccgcggcggcgatgggcaagggctcccgccccgcctccacctccaccggcggcgagaagaagggggaggagcgggtgctgagccacggcgacgtcgtgctcatccgctccgacctcgccattctccgcgggcctcgcttcatcaacgaccgcatcatcgccttctacttcgcccacctctccgccggcctcggcgacgacctcctcctgctcccaccctccatcccctaccttctctccaacctccccgacccggcctccgtcgccgccgtagcggagccgctccgcctcgcctcccgccgcctcgtgctgctccccgtcaacgacaaccccgacgcctccgtccccgagggcggttcccactggaccctcctcgtcctcgacaacaccaccagcccatccggcccccgcttcgtccaccacgacagcatccgcggcgagcccaacctccccatcgccagccgcctcgccgacgcgctccgccccctgctcctccagagcgattcgaggaggaggggcgctgtgccggtcgtggaggggcccaccccgaggcagcccaacggctacgactgcggcgtctacgtcatggccatctccagggccatctgtggctggtggaagagtggccatggcggccaccggggtggggattggttcgaggcggtgaggagggaggtggacgccgacagtgtcaaggccatgaggggcgagctgctgcaactaatcaccaccctcatccaagacaaggccaatgccagttcaatatccgagggcaacaagacgggcaacactgattgaggatcattgttgtgtctctgtaagatcgattggaacgacaggcagtagcgtacctgatagtacactggtttctcaagtttggttgctctttttgatcttagtcaaggggtttcttgctggatcggcttctttgcgaaaaggaagagcaagcagagcatacacacttgtgtaagcaaagttttggaaaatcacatttgtcccttttgtgagtaaagttttagcaaatgcctgttac

SEQ ID NO: 43211 - protein, 261 aa, Panicum virgatum
  misc_feature: Ceres CLONE 2015678
  misc_feature (42)..(234): Pfam Name: Peptidase_C48 Pfam Description: Ulp1 protease family, C-terminal catalytic domain
MGKGSRPASTSTGGEKKGEERVLSHGDVVLIRSDLAILRGPRFINDRIIAFYFAHLSAGLGDDLLLLPPSIPYLLSNLPDPASVAAVAEPLRLASRRLVLLPVNDNPDASVPEGGSHWTLLVLDNTTSPSGPRFVHHDSIRGEPNLPIASRLADALRPLLLQSDSRRRGAVPVVEGPTPRQPNGYDCGVYVMAISRAICGWWKSGHGGHRGGDWFEAVRREVDADSVKAMRGELLQLITTLIQDKANASSISEGNKTGNTD

SEQ ID NO: 43212 - DNA, 694 bp, Panicum virgatum
  misc_feature: Ceres CLONE 2015683
  misc_feature: Encodes the peptide sequence at SEQ ID NO. 43213
agcccgaccgactcgcgattccaaacccccaaaccctcctcctccctgaacccgatccaacccaatccccggcggcggcggcggcggcgatggcggccgtgaccaacgccgacgtggaggtggtcgacttcgacctcgacgacgacgacctcatggacgaggacgccggggcggagcccgcgccgccccccgcccccgcgtcccgactccgctccaccatcgcgggcgacgacgcgccgcgtaagaccaagggccgcggcttccgcgacgacccaaactcctcatccgccccccgcgacacgcgcttcggcgctggggggcgcgccgacttcgactcgctcggctccggcggcggcccggcacccatccgatcaattgaaggatggattgtgctggtcactggagttcacgaagaagcacaagaagatgaccttcacaatgctttccgagaatttgggcaggtccgaaacctgcatttgaatttggatcgtcgtactggatttgtcaaggggtacgctttgattgaatacgagaactttgaagaagctcaggctgcaataaaagaactggatggaactgagctttatggacaaataataagcgttgattgggcatttagcagtggccctgctaagcgcagaaattctcaaaagagacctccatcaagagctcgttctaggaccccacccaagag

SEQ ID NO: 43213 - protein, 201 aa, Panicum virgatum
  misc_feature: Ceres CLONE 2015683
  misc_feature (101)..(172): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAVTNADVEVVDFDLDDDDLMDEDAGAEPAPPPAPASRLRSTIAGDDAPRKTKGRGFRDDPNSSSAPRDTRFGAGGRADFDSLGSGGGPAPIRSIEGWIVLVTGVHEEAQEDDLHNAFREFGQVRNLHLNLDRRTGFVKGYALIEYENFEEAQAAIKELDGTELYGQIISVDWAFSSGPAKRRNSQKRPPSRARSRTPPK

SEQ ID NO: 43214 - DNA, 938 bp, Panicum virgatum
  misc_feature: Ceres CLONE 2015696
  misc_feature: Encodes the peptide sequence at SEQ ID NO. 43215
aaattttttctaatcttagtactttacacagcaaactaagccgccacttcaactaatgaacgttcaagacactgatttaggagatctcagaatcgacctcggaaaccctgaccaaaaaggctacggctctactgctcaatccactcaacctaaagaccaaggtgctccccgtgtcgaaagagaagaagccccaagacccgccagaactggcttgttgtcatgcttctctattgaattctatcaaccttactttgatatcaccactgatgacgttaaacaaagaattttggccactgttgaccccagaaagaacaccttctttgaaactttggataatagacccgatctttatggacctttctggatttataccactttgatctttgctttggctgcctctggtaatttctccaacttgatcagagctagtgctaaaaaccaaagtttcgaaagcagatttaattttgtccctattgctaccagtgtcatttatggcttcggtatcatcgtccccatccttttcactttcctcttgagattctttggatctaaagtccattatgttgacactgtctgcatttatggctattcatttttcattttgatccccgtcttgatcgttgctatcatccccatgtctgttattcaatggattgttttaatatacggatttgtttcatcttcctggttcttgttgaataattatgctcatgaattgaagaaatatgttggaaatcaaagatacattttgttgggattcattggtgccagtcaattcatcttacttcttgtctttagactcaagttcttctctgacatttacgccactagtgctaattgaaacttgtgatttgatctgaattatatatatacatagttaatctatataaatgatattgtaattatttttgttttttcatcatttaaaacaaaattgt

SEQ ID NO: 43215 - protein, 261 aa, Panicum virgatum
  misc_feature: Ceres CLONE 2015696
  misc_feature (66)..(232): Pfam Name: Yip1 Pfam Description: Yip1 domain
MNVQDTDLGDLRIDLGNPDQKGYGSTAQSTQPKDQGAPRVEREEAPRPARTGLLSCFSIEFYQPYFDITTDDVKQRILATVDPRKNTFFETLDNRPDLYGPFWIYTTLIFALAASGNFSNLIRASAKNQSFESRFNFVPIATSVIYGFGIIVPILFTFLLRFFGSKVHYVDTVCIYGYSFFILIPVLIVAIIPMSVIQWIVLIYGFVSSSWFLLNNYAHELKKYVGNQRYILLGFIGASQFILLLVFRLKFFSDIYATSAN

SEQ ID NO: 43216 - DNA, 588 bp, Panicum virgatum
  misc_feature: Ceres CLONE 2015700
  misc_feature: Encodes the peptide sequence at SEQ ID NO. 43217
tccacgccttgtcgcaccatctctccacggttttcctcggcgagtcctcccctcttccctacttcgtgtcgctcctgccgctcctgcctattcctccatggcttccgacccgagcaaaacttcataaccggagaaaccctctgagccatcgggtgccgccctccccaatccttttgatttttcttgtctgattggcttgctcgctgatccaccattaagatagatggcaaaccaaattgccagtgacccactgttcaaccacatggttgaacagcttcagaaaactgctcagtgtgctggtgaacagggtatccctgcactggatcctcaacaatacatggaaacaatgcaacaagtcatgcaaaatcctcagtttgtgtcaatggcggaccgtcttgggaatgctcttatgctcgatcctgctatgtccagtatgcttgagaacgtgagtagtccagctcctgacgagcactttgaagagcgaatggctcgtatcacggaagatccatccgtgaagccgatccttgatgagatagacaatggtggaccatctgcgatgatgaaggactgctatgacactgaggttct

SEQ ID NO: 43217 - protein, 121 aa, Panicum virgatum
  misc_feature: Ceres CLONE 2015700
  misc_feature: The sequence is a functional homolog of SEQ ID NO 1839 in the 10/374,780 US patent application
MANQIASDPLFNHMVEQLQKTAQCAGEQGIPALDPQQYMETMQQVMQNPQFVSMADRLGNALMLDPAMSSMLENVSSPAPDEHFEERMARITEDPSVKPILDEIDNGGPSAMMKDCYDTEV

SEQ ID NO: 43218 - DNA, 1309 bp, Panicum virgatum
  misc_feature: Ceres CLONE 2015714
  misc_feature: Encodes the peptide sequence at SEQ ID NO. 43219
atctctcttgcatttactgcatcaacaaaccggcgaccgattcttcctagaggcatcgcctgccgccttccctcattcactgcgacccgcgaccgccgttgttgctttctacggcgacttcccaaatcctgcgccttgtttgcagctcatcctgctgccgcatcaccaaacccgcctcgatacccttcttcatcacacagctccagtctcccagcaaccatggccgccgagctgcgcagaaagctggtcatcgtcggcgacggcgcctgcggcaagacctgcttgctgattgttttctccaagggtaccttcccggaggtttacgtccccactgtcttcgagaactacgttgccgatgtcgaggtcgatggaaagcatgttgagctggcgctgtgggatacggctggccaggaggactacgaccgcctgcggcccctgtcataccccgactcccacgtcatcttaatctgcttcgccgttgactcgcccgactccttggataacgttggcgagaagtggtgctctgaagtacatcacttctgccccgatgtccccaagatcctggttggctgcaagaaggaccttcgtttcgaccagaagacgatcgaggagcttcgcaagactagccaggcacccgtgacccctgagcaggccacgacggttgccaacaacatcaaggccaccaagtaccttgagtgctcggccaagaccaacgagggtgtccgcgaggtgttcgagttcgcgacacgggcggctctcctcaagaaggccgggaaaaagaagagcaagtgcgtcatcgcctaagcgtaggcgggtcacgaatagccgccttcacggctgccaaccgctgttgtccgacatggaccattttggcaacagaacgcccgtcacgatggggtccttggccctagaaagagagatagagttcctcacacttcttttcccagccggcgcgagaaacgccgaatggtgaacggccgcgtgctcccggatggtggtaagcaggcgtccctgacgtgaggatggagaaacgagaactcgacgttggcagctgcgagccgaggaaagggaggatgcaatcacgagcatcgtgggtaattctggggtactgcccacgcaggccccaagtctcggccgagctggggatggccggctaagcaagtactgggcggcatgcaataatccaacgcgtcctcttccctttctatcttgtcctttttttttctgtctcagattactcgacggtaccgcggtttcccatcctcgtttttactagttagctatctatttattcatgcgcttttcttgg

SEQ ID NO: 43219 - protein, 194 aa, Panicum virgatum
  misc_feature: Ceres CLONE 2015714
  misc_feature (8)..(181): Pfam Name: Ras Pfam Description: Ras family
MAAELRRKLVIVGDGACGKTCLLIVFSKGTFPEVYVPTVFENYVADVEVDGKHVELALWDTAGQEDYDRLRPLSYPDSHVILICFAVDSPDSLDNVGEKWCSEVHHFCPDVPKILVGCKKDLRFDQKTIEELRKTSQAPVTPEQATTVANNIKATKYLECSAKTNEGVREVFEFATRAALLKKAGKKKSKCVIA

SEQ ID NO: 43220 - DNA, 1187 bp, Panicum virgatum
  misc_feature: Ceres CLONE 2015723
  misc_feature: Encodes the peptide sequence at SEQ ID NO. 43221
acgcgaaaaacaggaaaacactcttcctccccctccttctcaccagcagttcaggaagccatcgaacttgcttatcttgatattacttctgccatggttcagatcaaggaatttcggatcgtcatgcctatgtccatggaagagtatgaaataggcctcagctacaccatcatgaagatggagcaggaaaacacaaacagcaaggagggtgtagaagtactgcagcaggtcccatttgaggatgagaagcttggcaagggccaactcacctcaaaagtctatcatctgcagagcaaaattccatcctggatgaagggctttgctcctgccactgctctcacggtgcacgaggattcttggtgtgcgtttccaaagagcagaacagtgatcaagtgcccacttttcagcaaatgctcattgaccatcgacaccataagcagacccgacaacggttgttccgaaaatgcgcataatctgaacagcgagcagttagctgcaagagaagttgagatcatcgacatagcatctatatcccgagattactggagcaaggtgatcagtgctccaaatgtcgacctgacagccttcaagtctcaaagaacagagcgaggccctcttcagaagggatggatggattcatgtcgtccagtcatgaccacatacaagctggtgaccatggatgccccaatctggggcttcggcgaacggctcgaagactgcatcattgcgggagagagggcgctgttcttggcgtgccaccggctgtgcttcgcgtggatcgacgagtggtacggcatgaccgtggagcagatacgggagatggagcggcagacggacatgctgctgaagaagacgctgaaaaagcctgggaaggccgggagcaagcacgagggcaagaggaagacgctcaaagacgagatcgcggtggtggggagctgcacgtagtgctagttcggggtgatggaccatttgattctggttcccgtaggcctgatggcatcgtcgcctgaagaaaggtagcaaaagtctgccaggggacggggacgattaggtgtgtgtggaatctggtgtacgcgtgtacatatccatccacgatccaccgaagatgctgtatatatacattcagggcatcatggtctgcacaaacctaaagtatcgaatgcttaattaaatgattcttcagattc

SEQ ID NO: 43221 - protein, 283 aa, Panicum virgatum
  misc_feature: Ceres CLONE 2015723
  misc_feature (2)..(251): Pfam Name: IP_trans Pfam Description: Phosphatidylinositol transfer protein
MVQIKEFRIVMPMSMEEYEIGLSYTIMKMEQENTNSKEGVEVLQQVPFEDEKLGKGQLTSKVYHLQSKIPSWMKGFAPATALTVHEDSWCAFPKSRTVIKCPLFSKCSLTIDTISRPDNGCSENAHNLNSEQLAAREVEIIDIASISRDYWSKVISAPNVDLTAFKSQRTERGPLQKGWMDSCRPVMTTYKLVTMDAPIWGFGERLEDCIIAGERALFLACHRLCFAWIDEWYGMTVEQIREMERQTDMLLKKTLKKPGKAGSKHEGKRKTLKDEIAVVGSCT

SEQ ID NO: 43222 - DNA, 1325 bp, Panicum virgatum
  misc_feature: Ceres CLONE 2015731
  misc_feature: Encodes the peptide sequence at SEQ ID NO. 43223
ctatcgaatactctactgctactgtagtagctagctagcgagcgcgccgccatgggtgacacgggcgcgaacatggcccactgggccgggctctacggcggcgggaacggcgcgccggcggcggggacggaggcggccgtggtgacggcgtcgagcccgacgtccggcgggtctgtcggcggcagcccgacccgggcgcagccgggggtcgagggcgggcgcgtcgcgaagcccgcgcggcggcggtcccgcgcgtcccgccgcgcgccggtcacgctgctcaacacggacacctccaacttccgcgccatggtgcagcagttcaccggcatcccgcccggcccctacggtcccgccggcggcgccggcgggcccgtgatcagcttcggcgccggcggcggggactacggcggcggcgccgcgcttgtgcgcccgtcgccgacgtcggccgtcatgtcgttcgaccacctggcggcggcggcgttgcagcagcagcagcaccaccaccggcacgcgtcgctgcagggccagctcttcaggccgcagcagcagtacgccgccgacgtcggctacggcggcatgcacggcggcggcggcggggacatgccgccgttcctgcacgggttcgagtcgtcggcggaggatcggctgctgctccagagcatccaagcggcgcagatgatgcccacccgcccgtcctccaccactagcaacagcaatggctacaacttcggctgatcgatctgccacctaccgccaaccagagctcgatcaacaaggtaacaacaacaataatagaaccaaggtcacttgatcagatccagggagatcaagaagccattagtttgatttgtggtcacggcgtgcatggtcgtcgtcgatcacgagctgaccgatgatgtttgttcttgcttgtcgctgatgctcaagcattatttcgttttgtttttgttggccttgccgtgtgatcagaggccaattaaggtttgcttaattagcagtttagcacacagtaattagtactactactccactagtagtagctttgctgctttagaagaagtcaagctagctaggtgctttagatgtgaaacgaagtgcagagaaaagaggcatcatgtaaatatggttggcagtaaaaagttgggcgcgcgtgcgctttcggtgtgtagtagccagctgatacttgatagcgaggaatctttctagagagagagattagattattgccttggctcggaagcaaagtccgggatggctgctacatgcttgtactgatcaccaattatgaagtcccgccgctaattgactgcatcctgatgatc

SEQ ID NO: 43223 - protein, 228 aa, Panicum virgatum
  misc_feature: Ceres CLONE 2015731
  misc_feature (70)..(100): Pfam Name: VQ Pfam Description: VQ motif
MGDTGANMAHWAGLYGGGNGAPAAGTEAAVVTASSPTSGGSVGGSPTRAQPGVEGGRVAKPARRRSRASRRAPVTLLNTDTSNFRAMVQQFTGIPPGPYGPAGGAGGPVISFGAGGGDYGGGAALVRPSPTSAVMSFDHLAAAALQQQQHHHRHASLQGQLFRPQQQYAADVGYGGMHGGGGGDMPPFLHGFESSAEDRLLLQSIQAAQMMPTRPSSTTSNSNGYNFG

SEQ ID NO: 43224 - DNA, 717 bp, Panicum virgatum
  misc_feature: Ceres CLONE 2015753
  misc_feature: Encodes the peptide sequence at SEQ ID NO. 43225
aaattcttgttactggaatcaaggttgtggatctccttgcaccctaccaaagaggaggtaaaattggtctctttggtggtgcaggggtgggcaaaactgtccttatcatggagctcattaacaacgtcgccaaggcccatggtggtttctctgtctttgctggtgttggagaacgtactcgtgagggtaatgacttgtacagggaaatgattgagagtggtgtcattaagcttggtgacaagcagagtgagagcaagtgcgctcttgtctacggtcaaatgaatgagcctcctggtgctcgtgctcgtgttggactgactggtttgactgttgccgagcatttccgtgatgctgaaggacaggatgtgcttctcttcattgataatattttccgtttcgcccaggcaaactctgaggtgtctgctttgcttggacgtattccatctgctgtgggttaccaacccaccctagccacagatcttggaggactgcaggagcggattaccaccacaaagaagggttctattacatctgttcaagctatttatgtgcctgctgatgacttgacagatcctgcccctgcaaccaccttcgcccatcttgatgctactactgtgttgtcgcgtcagatttctgagcttggtatttaccctgctgtcgaccctctggactccacatccagaatgttgtccccccacgttctgggtgtggaccact

SEQ ID NO: 43225 - protein, 238 aa, Panicum virgatum
  misc_feature: Ceres CLONE 2015753
  misc_feature (4)..(226): Pfam Name: ATP-synt_ab Pfam Description: ATP synthase alpha/beta family, nucleotide-binding domain
  misc_feature: SWISSPROT Homolog: EC 3.6.3.14 H(+)-transporting two-sector ATPase
ILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFAQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGVDH

SEQ ID NO: 43226 - DNA, 569 bp, Panicum virgatum
  misc_feature: Ceres CLONE 2015755
  misc_feature: Encodes the peptide sequence at SEQ ID NO. 43227
agctcacaatggccatcccctccccgtcgctttctttcgctgtcgtcgccatgctcgtgctccttccctccccgtccctctccggcgaccccgacttgctccaggacatctgcgtcgcggatctcacgtccagcgtgaaggtgaacgggttcgcctgcaaggccaccgtgacagaggatgacttctacttcaaaggccttgccgccgccggcaacaccaacaacacctatggctccgtcgtcaccggcgcgaacgtcgagaaggtaccgggcctcaacaccctcggcgtgtccatgtcccgcatcgattacgcccccggtggcttgaacccgccgcacacccacccgcgcgccaccgagatggtgttcgtcctccagggcaccctggacgtcggcttcataaccaccgggaacaagctcgtcgccaagaccatcaacgccggcgacgtcttcgttttccctcgtggtctcgtgcatttccagaagaacaatggggatgctcccgccgcggtcatatcggccttcaacagccagctccctggcacacagtccctcgccatgactctgttc

SEQ ID NO: 43227 - protein, 186 aa, Panicum virgatum
  misc_feature: Ceres CLONE 2015755
  misc_feature (62)..(184): Pfam Name: Cupin_1 Pfam Description: Cupin
  misc_feature (97)..(172): Pfam Name: Cupin_2 Pfam Description: Cupin domain
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MAIPSPSLSFAVVAMLVLLPSPSLSGDPDLLQDICVADLTSSVKVNGFACKATVTEDDFYFKGLAAAGNTNNTYGSVVTGANVEKVPGLNTLGVSMSRIDYAPGGLNPPHTHPRATEMVFVLQGTLDVGFITTGNKLVAKTINAGDVFVFPRGLVHFQKNNGDAPAAVISAFNSQLPGTQSLAMTL

SEQ ID NO: 43228 - DNA, 601 bp, Panicum virgatum
  misc_feature: Ceres CLONE 2015769
  misc_feature: Encodes the peptide sequence at SEQ ID NO. 43229
tgcaaggggactggagagagcatcaatgagaaggatcgctgcccagggtgcaagggtgagaaggttgttcaggagaagaaggttctggaagttcacgttgagaaggggatgcagcacaaccagaagatcactttccctggtgaagctgatgaagcgcctgatactgtcactggagacattgtatttgtcctccagcagaaggatcactccaaattcaagagaaagggcgatgatctcttttatgagcacaccttgtctctgactgaggctctctgtgggttccagtttgttcttacacatctggacaacaggcaacttctcatcaagtcaaaccctggtgaagttgttaagcctgaccaattcaaggcgataaatgacgaggggatgccaatgtaccagaggcctttcatgaaggggaaactctacattcacttcacggtagagttcccagactcgctggcgccagagcagtgcaaggctcttgaggcgttacttccaccgaagcctacatccaagctgaccgacatggagatagacgagtgcgaggagactactatgcatgacgtgaacaacatcgaggaagagatgcgcaggaggcaag

SEQ ID NO: 43229 - protein, 200 aa, Panicum virgatum
  misc_feature: Ceres CLONE 2015769
  misc_feature (41)..(165): Pfam Name: DnaJ_C Pfam Description: DnaJ C terminal region
CKGTGESINEKDRCPGCKGEKVVQEKKVLEVHVEKGMQHNQKITFPGEADEAPDTVTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEALLPPKPTSKLTDMEIDECEETTMHDVNNIEEEMRRRQ

SEQ ID NO: 43230 - DNA, 680 bp, Panicum virgatum
  misc_feature: Ceres CLONE 2015775
  misc_feature: Encodes the peptide sequence at SEQ ID NO. 43231
gatccttcctgcttctcgatcggattgggttgggggttctgggtaggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgcaggcccagacgcggaagatatgttccactggcaagcgacgattatgggcccatcagatagcccatactttggcggcgtctttttggtcacaattcacttccctccagactacccattcaaaccgcctaaggttgcattcaagacaaaggtcttccatccgaatatcaacagcaatgggagcatctgtcttgatatcttgaaggaacaatggagcccagcattgacagtttctaaggtactactctcaatttgctcccttttgacggacccaaaccctgatgacccattggttccggagattgctcacatgtacaagagtgatcgggcgaaatatgagtccactgctaggagctggactcagaaatacgcaatgggctgacattgccggctaccgggaagatgatgacctagcaatatgctcgtgttatgtgcctttgttccagttctaatgtattgccttctgtcgttcgtgcatcgaacaatctctataat

SEQ ID NO: 43231 - protein, 148 aa, Panicum virgatum
  misc_feature: Ceres CLONE 2015775
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
MASKRILKELKDLQKDPPTSCSAGPDAEDMFHWQATIMGPSDSPYFGGVFLVTIHFPPDYPFKPPKVAFKTKVFHPNINSNGSICLDILKEQWSPALTVSKVLLSICSLLTDPNPDDPLVPEIAHMYKSDRAKYESTARSWTQKYAMG

SEQ ID NO: 43232 - DNA, 1219 bp, Panicum virgatum
  misc_feature: Ceres CLONE 2015777
  misc_feature: Encodes the peptide sequence at SEQ ID NO. 43233
aagatatgacgaatcggcgcgccattttcctcctgcttttctttccaagggcgacataagagagatcttcgccgcccttcagtatcaccaccacctgtcgcttgccacgccacacatgctcgcctcaaggtaggccaagagcaggagcgcagcttcacacatgtcgtcaccggcgacggcgagaggtggtggcgcgccggaggatcagggggcaggcggcgaggccggcgtggagcggggagggcgaggcacgtggcggcacgcggccttccacgtcgcgacgacgatcgccacgccggcggcctacgcccccttgcccttcgccgtcgcctcccttggctggcctcttggtgtttgcagcttggttattgggacactggttacatggtgctcaagcttggttgtggcctcgctgtggcagtggaatggagagaagcacaccagctaccggctacttgcaaagagcatctttgggtatcagatcgacagaaaggaagtcagttacagtcttcaaggaaacactgcaactaagatcttcagagctttcaatgcattgggcacgatagcgttctcctttggtgatgctatgctgccagaaattcagagtactgtgcgtgaaccggtgagggcaaacatgtacaaaggtgtttcggctgtgtacacgatcatcgtcgtgtcctactggaccctggcattcagtggttactgggcattcagttctcaagtccagccctacatcctgtcctccctgacagctccaagatgggcaattgtgatggcaaacctttttgcagtcattcagatagcaggttgctttcagatatactgcaggccaacatttgcgtactttgaagagcaggttcaggcaacgaacaggagctgcagatcctgcctgtggcggctgatgtacacttctgcatacatggccgtgatcaccctcgtctccgcagcaatgccattctttggggactttgtatctatctgtggagcagttgggttcacccctctggactttgtgctgcctggattggcacttctgaagactagtaagcttcctgataacctaggatcgcagtatgctgtgaaggtgctcagcgctgctgtcgccgtcttgttctcaatcataggcgtgcttgcatgcatcggcgccatcagatcgatcacacttgatgtcagaacctataagctcttccatgatatgtgatgatagttttgcagc

SEQ ID NO: 43233 - protein, 347 aa, Panicum virgatum
  misc_feature: Ceres CLONE 2015777
  misc_feature (28)..(332): Pfam Name: Aa_trans Pfam Description: Transmembrane amino acid transporter protein
MSSPATARGGGAPEDQGAGGEAGVERGGRGTWRHAAFHVATTIATPAAYAPLPFAVASLGWPLGVCSLVIGTLVTWCSSLVVASLWQWNGEKHTSYRLLAKSIFGYQIDRKEVSYSLQGNTATKIFRAFNALGTIAFSFGDAMLPEIQSTVREPVRANMYKGVSAVYTIIVVSYWTLAFSGYWAFSSQVQPYILSSLTAPRWAIVMANLFAVIQIAGCFQIYCRPTFAYFEEQVQATNRSCRSCLWRLMYTSAYMAVITLVSAAMPFFGDFVSICGAVGFTPLDFVLPGLALLKTSKLPDNLGSQYAVKVLSAAVAVLFSIIGVLACIGAIRSITLDVRTYKLFHDM

SEQ ID NO: 43234 - DNA, 665 bp, Panicum virgatum
  misc_feature: Ceres CLONE 2015800
  misc_feature: Encodes the peptide sequence at SEQ ID NO. 43235
gccggcaacggcggcggaggagggagcgcggcgggggcacgcacacggcgctgcgtctcctggagcgcggctacggcgtcaccgtcgtcgacaacttccacaactccgtccccgaggcgctcgaccgcgtccgcctcatcgccggccccgcgctctccgcccgcctcgacttcgtgctcggggatctgaggagcatcgacgacctggagaaggtgttcgcggtcaagaggtacgacgccgtcatccacttcgccgggctgaaggccgtgggggagagcgtcgcgcacccggagctgtactacgacaacaacctcgtcggcaccatcaacctctacaagaccatgaagaagcacggctgcatgaagatggtgttctcgtcgtcggcgaccgtgtacggctggccggaggagatcccgtgcgtcgaggacgccaagctgcaggccgcgaacccctacggcaggaccaagcttatcctggaggatatggcgcgggactaccaccgcgcggacccggagtggagcatcgtcctgctgcgctacttcaaccccatcggcgcgcacagctccggcgagatcggcgaggaccccaaggggatcccgaacaacctgctgccctacatccagcaggtcgccgtcggcaggctgcccgagttcaacgtctacggc

SEQ ID NO: 43235 - protein, 220 aa, Panicum virgatum
  misc_feature: Ceres CLONE 2015800
  misc_feature (12)..(220): Pfam Name: Epimerase Pfam Description: NAD dependent epimerase/dehydratase family
  misc_feature: SWISSPROT Homolog: EC 5.1.3.2 UDP-glucose 4-epimerase
  misc_feature: Functional homolog of the protein sequence given in SEQ ID NO 51667
  misc_feature: Useful for making plants with altered carbohydrate content
  misc_feature: Functional homolog of the protein sequence given in SEQ ID NO 51668
  misc_feature: Useful for making plants with altered cell wall content and/or composition
RQRRRRRERGGGTHTALRLLERGYGVTVVDNFHNSVPEALDRVRLIAGPALSARLDFVLGDLRSIDDLEKVFAVKRYDAVIHFAGLKAVGESVAHPELYYDNNLVGTINLYKTMKKHGCMKMVFSSSATVYGWPEEIPCVEDAKLQAANPYGRTKLILEDMARDYHRADPEWSIVLLRYFNPIGAHSSGEIGEDPKGIPNNLLPYIQQVAVGRLPEFNVY

SEQ ID NO: 43236 - DNA, 1111 bp, Panicum virgatum
  misc_feature: Ceres CLONE 2015820
  misc_feature: Encodes the peptide sequence at SEQ ID NO. 43237
cccccaacccatttccttcctgcccgcaacccagcccaggcccggcggtccctcgatcctctcggctccggatcggcaagagcccagccgcagccgcccgtagccgcctcgctgccggattcacacgacgccttgtcggcgtctctctctctctcgaggcccatggcgcagcgcgacaagaaggtggaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcctcgccggcggtgttcgacaagccgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagctgtcatcacgctgttctcgagaatcccacaaacaagaagaagatgatttgattgatgaaggaaaaagaagaaggagcagatcatgggaaccatgaaggcagggaagctgcgagaaaaaggggatcgagagcacagtgcgatgataatgttgttgttgtagcggtggttggggtggaggggaagagatagagtcggtttggtgtgttgtcctactacaaatcacaatcttctattaaatttttcttccatctctctgtataaactaaattataattgggatctccctattgcccagct

SEQ ID NO: 43237 - protein, 168 aa, Panicum virgatum
  misc_feature: Ceres CLONE 2015820
  misc_feature (109)..(149): Pfam Name: zf-AN1 Pfam Description: AN1-like Zinc finger
MAQRDKKVEEPTELHAPELTLCANSCGFPGNPATKNLCQNCFLAASASVSPPSPSSSSPAVFDKPRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 43238 - DNA, 1216 bp, Panicum virgatum
  misc_feature: Ceres CLONE 2015838
  misc_feature: Encodes the peptide sequence at SEQ ID NO. 43239
ggcaccggtcaacagtgttttcctctcataccactctaacagcatcatccagccaccagccagcagtatttttctctcacaccattccaatagcaacttccagcaccagcacagcgatcagggtgaaaaggggcctgggcagagtggacttgccgcatcagcgtagctggcaacagcagtctcgaggagcaggtagagcgctaagctttcggtgtgcggagcgaggagcgaagcggaagcgaagatggtgaagctcgcgttcgggagcgtcggcgactccttcagcaccacctccatcaaggcctacgtggccgagttcatcgccaccctcctcttcgtcttcgccggcgtcgggtccgccatcgcctacgggcaactgacccatggcggcgcgctcgaccctgccggcctggtggcgatcgcgatcgcccacgcgctggcgctcttcgtcggcgtctccatcgccgccaacatctccggcggccacctgaaccccgccgtgaccttcggcctcgccgtcggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgagctggagggcgtggtcttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccctgcccgctccttcggccccgccgtcgccgcgggcaacttcgccggcaactgggtctactgggtcggcccgctcatcggcggtggactcgctggcctcatctacggcgacgtgttcatcggcggcaactaccagcaggtcgccgaccaggagtacgcctaagtccgatggactcaaccgcgatcgagtgcagcgtttcagtctgaatcgtcgtttgcattgctcttcactacgtcacatggtcacaaatttgtatttacgaatgatgtgtcgttcatggttcttctgtccatttcccttttttttgtttgttaaattgatgtaaagatctcatccgatctgcagttcttgtctttcaaggaaaaaaagatgtgtttacttttc

SEQ ID NO: 43239 - protein, 249 aa, Panicum virgatum
  misc_feature: Ceres CLONE 2015838
  misc_feature (11)..(231): Pfam Name: MIP Pfam Description: Major intrinsic protein
MVKLAFGSVGDSFSTTSIKAYVAEFIATLLFVFAGVGSAIAYGQLTHGGALDPAGLVAIAIAHALALFVGVSIAANISGGHLNPAVTFGLAVGGHITILTGLFYWVAQLLGASVACLLLKFVTHGKAIPTHGVAGISELEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGNYQQVADQEYA

SEQ ID NO: 43240 - DNA, 1090 bp, Panicum virgatum
  misc_feature: Ceres CLONE 2015854
  misc_feature: Encodes the peptide sequence at SEQ ID NO. 43241
tcttattgcgtgcaccgcgaacgagaatttgctctctaacaaacttcgctgagaatttgttctagaaaagtagaagttcatccgccatgaagcaatacgaggatccgccggccaagatcttccaccgcgcgcacccggcgcacgacctcaagctggtggccgccggcgccacgttcgtgtgcgacggctgcaaggagcccggcgacggggcccggtacgcgtgcggctgcgggggcgacagcttcgatctccacctgccctgcgccctcgccgacgaggacgacgccctgcggcacgctctgttccccggccacaacttcttcttcgtccccgagcccccgcccccggtggacaagacgatctgcgacgcctgcggcgagcccgcgctcgggtacgtctaccactgcttcgaggccgacctggatctccacccgtgctgcgcgtgcctgccgggccgcctcctccaggacggccgcgtcttcgagctccgccggaaggcgtcgtcgtcgcggccctgcggcctgtgcggcgaccgccgccgcggcttctgggcgtaccgctcctacttcgacggcgaggccgtggacctgcacgtggcgtgcatgaaggacatggctcgcctgagctgggaggcggcgcgcaagaaccaggtcggcggcggccaccagatcgtccaagcgagcctgcccaacatggagcgtacgctgcagagcttgcgcagggacaggaggacgaggagtgggttcgaccggttcatcaggattgttagcaccgtggcgagcatcatcatcgcagtcatctttggcaaccccgtggcgatgatggccgccattgcggggcccggtggttttcttcggggttaattaggtttttgttagtagggattgatggagtttctaaaacatcaaggaacacacaaaagagttagttttgttttaccttttttttgtgagttgatgtatacatctggtcttttgtatttggttcattcgaagaacatttattcatgaatatttgtagtgtagccttatgttattgaaccactattcagttgtaaaatttcgtactcatttcattaatattcttgctt

SEQ ID NO: 43241 - protein, 258 aa, Panicum virgatum
  misc_feature: Ceres CLONE 2015854
  misc_feature (91)..(119): Pfam Name: C1_3 Pfam Description: C1-like domain
MKQYEDPPAKIFHRAHPAHDLKLVAAGATFVCDGCKEPGDGARYACGCGGDSFDLHLPCALADEDDALRHALFPGHNFFFVPEPPPPVDKTICDACGEPALGYVYHCFEADLDLHPCCACLPGRLLQDGRVFELRRKASSSRPCGLCGDRRRGFWAYRSYFDGEAVDLHVACMKDMARLSWEAARKNQVGGGHQIVQASLPNMERTLQSLRRDRRTRSGFDRFIRIVSTVASIIIAVIFGNPVAMMAAIAGPGGFLRG

SEQ ID NO: 43242 - DNA, 684 bp, Panicum virgatum
  misc_feature: Ceres CLONE 2015855
  misc_feature: Encodes the peptide sequence at SEQ ID NO. 43243
gatcaaggcggccatcttggattctggatttcatattgtcaaagagacccaggtccagcttgatgctgagagggcatctctcttctatgcggagcattctgggagaagcttctttgacagcctagtcaagtatataacgagtggcccagttcttgctatggttctggaaagacctgatgccattgcacaatggcgtgctttgattgggccaactgatgcaagaaaggctaaaactactcatccaaacagcattagagcaatgtgtgggttggactcggagaaaaactgtgtgcatggttcagattcaccggaatctgcagccagagatatttcatttttctttggagatggcgattctggttgttttcttcaatacttgtttcataattctgaagaccactccataaaacttctgaccttattctttgatagtgcagaaactgtggaacatgatgagctatagacactagactggaatcagtcaaggcagtaaattgaaacttgatgactcctatgaactcatagttgatgaaaacttgggtgaatcagacaagtctactctgatagcacattacaattcttgacatggtaacttaatatacagagttctgaaagaattgatctgcagattgtgattgctgaggattacgatggtttaacagaaaccttcactaatcacttggg

SEQ ID NO: 43243 - protein, 153 aa, Panicum virgatum
  misc_feature: Ceres CLONE 2015855
  misc_feature (1)..(117): Pfam Name: NDK Pfam Description: Nucleoside diphosphate kinase
  misc_feature: SWISSPROT Homolog: EC 2.7.4.6 Nucleoside-diphosphate kinase
IKAAILDSGFHIVKETQVQLDAERASLFYAEHSGRSFFDSLVKYITSGPVLAMVLERPDAIAQWRALIGPTDARKAKTTHPNSIRAMCGLDSEKNCVHGSDSPESAARDISFFFGDGDSGCFLQYLFHNSEDHSIKLLTLFFDSAETVEHDEL

SEQ ID NO: 43244 - DNA, 627 bp, Panicum virgatum
  misc_feature: Ceres CLONE 2015859
  misc_feature: Encodes the peptide sequence at SEQ ID NO. 43245
gacagtaccagctgcgccgcgaaagccgagcggaacaaactgccaaaagggaaagcgaacgggagagctgtcacagcccgcggggggcagcgtcgagagggaatcgccggggatgggcggcgctccgcgacgaccggcggcgacggcgtacgtgccttccgcgctgctcctgctcgccgtgctctttgttggccgggcggcggcgctcggcgactgcccgacggcgctgcacaggcacgcggcgttcttcgaccgcgacggcgacggcgtcgtcaccctatcggagacgtacggcgcgttccgggctctcggatttggattcggcgtgtccaccttcagcgcggcctttatcaatggcgccctcggcagcaagtgcagacctgaaaatgcaacgtcatcaaatttggacatctacatagagaacattcagaaaggaaaacatggaagtgatactggctcgtatgacactgaaggaaggttcgttccagagaagttcgaagagatattcgccaagcacgccaagaccgtccctgacgccctgacatcggacgaggtcgaccagctgctccaagcgaacagacagcctggggactacaaaggatgggctggcccagaagcggagtggag

SEQ ID NO: 43245 - protein, 171 aa, Panicum virgatum
  misc_feature: Ceres CLONE 2015859
  misc_feature (31)..(171): Pfam Name: Caleosin Pfam Description: Caleosin related protein
MGGAPRRPAATAYVPSALLLLAVLFVGRAAALGDCPTALHRHAAFFDRDGDGVVTLSETYGAFRALGFGFGVSTFSAAFINGALGSKCRPENATSSNLDIYIENIQKGKHGSDTGSYDTEGRFVPEKFEEIFAKHAKTVPDALTSDEVDQLLQANRQPGDYKGWAGPEAEW

SEQ ID NO: 43246 - DNA, 1133 bp, Panicum virgatum
  misc_feature: Ceres CLONE 2015870
  misc_feature: Encodes the peptide sequence at SEQ ID NO. 43247
tttatcaaaaataagcaacatgaaggctgtgcttatcctttcccttatggccctcgctatggccaccacctacgagacccaaatgctctgggaatcctggaaggtcgtccacggaaaatcctactccgacctcgaagaaaccgccagattcggtatcttctcccacaactacagaaagatcgccaagttcaacgctgaaaacgaagatgttaagctcgcccttaacaagttcgctgacctcactgcccccgaattcaaggccaagatgaccggtttcggtttctacgaatccaaccaggccctcgtccaagaacacaccattgctctccctgaagatttcggagttctccccgcttccgttgattggagaaacaagggtgccgttacccccgttaaggatcaaggccaatgcggttcatgctggtctttctccaccaccggtgtcctcgaaggtttctacttcatccacagtggcaaactcctctccttctctgaacaacaaatcgttgactgtgacaccgctaccaaccaaggttgcgacggtggctggccttacctcgctgtccaatatgctgccaagaacggtttggaactcgaatctgactatccatacactgctcaagacggtacttgccaatactccaagtccaaggccaccaccactggtgcctccaactacgctttcgtcactgccaacagcactaaccaactcaagagtgctttggtcaacagccccgtctccgtcctcatcgaagctgaccaagatgtcttccaattctacagcactggtgtcatcaagactggttgcggtgccaacttagatcatgccgtcctcgctgtcggttaccacaaggttggtactcttgaagctttcattgtcaagaactcctggggtactgattggggagagagtggttacgtccaaatctggagtcaaagctcccaaaacaacggccaaggtgtctgcggtatccttgctcaacccatgatcccatccaagtaagaggggtgactcgtaacactatctcgatactatataatatgaatatctagattaatagtattctgcgtttataaagttaatgatctatctaacggtatgatgatgaacttatatcgagatttccctactt

SEQ ID NO: 43247 - protein, 327 aa, Panicum virgatum
  misc_feature: Ceres CLONE 2015870
  misc_feature (110)..(326): Pfam Name: Peptidase_C1 Pfam Description: Papain family cysteine protease
  misc_feature (24)..(79): Pfam Name: Inhibitor_I29 Pfam Description: Cathepsin propeptide inhibitor domain (I29)
  misc_feature: SWISSPROT Homolog: EC 3.4.22.30 Caricain
MKAVLILSLMALAMATTYETQMLWESWKVVHGKSYSDLEETARFGIFSHNYRKIAKFNAENEDVKLALNKFADLTAPEFKAKMTGFGFYESNQALVQEHTIALPEDFGVLPASVDWRNKGAVTPVKDQGQCGSCWSFSTTGVLEGFYFIHSGKLLSFSEQQIVDCDTATNQGCDGGWPYLAVQYAAKNGLELESDYPYTAQDGTCQYSKSKATTTGASNYAFVTANSTNQLKSALVNSPVSVLIEADQDVFQFYSTGVIKTGCGANLDHAVLAVGYHKVGTLEAFIVKNSWGTDWGESGYVQIWSQSSQNNGQGVCGILAQPMIPSK

SEQ ID NO: 43248 - DNA, 612 bp, Panicum virgatum
  misc_feature: Ceres CLONE 2015876
  misc_feature: Encodes the peptide sequence at SEQ ID NO. 43249
acccaccgcaccgcaccgcccgccgcgcccgctgccgtgccgacgtgccgtgccgtgcccgtgcccccttcctttccttctcctctcctctctctctctctttccccacgccgccaccacaccactctctctctctttcctcgctcgccccgagaccagatcggcgcggagagcggaggggggccgggggcgtagcgggcagaggagcaatggcggcggggtaccgggcggaggacgactacgactacctcttcaaggtggtcctgatcggcgactccggcgtcggcaagtccaacctgctctcccgcttcacgcgcaacgagttcagcctcgagtccaagtccaccatcggcgtcgagttcgccacccgctccctccaggtcgacggcaaggtcgtcaaggcccagatttgggacaccgccggccaggaaagatatcgagctatcactagtgcatattaccgaggtgctgttggagctttgcttgtttatgatgtcactcgtcactcaacctttgagaacgttgagcgctggttgaaggaattgagggaccatacagatcccaacatagttgttatgctggttggcaacaaatctgatctgcgccatcttg

SEQ ID NO: 43249 - protein, 134 aa, Panicum virgatum
  misc_feature: Ceres CLONE 2015876
  misc_feature (16)..(134): Pfam Name: Ras Pfam Description: Ras family
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50522
  misc_feature: Useful for making plants with modulated oxidative stress sensitivity
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHL

SEQ ID NO: 43250 - DNA, 698 bp, Panicum virgatum
  misc_feature: Ceres CLONE 2015879
  misc_feature: Encodes the peptide sequence at SEQ ID NO. 43251
agcagcagcagcagcatcatcacattgcagctagctagcgatcagaagcagatcgagagaagtagagacaaagtagagagaagctaaggagagggagatcgaagatggtggctgcaggcaggagcagggaggagcggtggagcctcgccggcgcgacggcgctcgtcaccggcggcagcaagggcatcgggcatgcgatcgtggaggagctggccggcttcggggcgcgggtgcacacgtgctctcgcaacgcggcggagctggaggcgtgccgccggcggtgggaggagaaggggctcgccgtcaccgtctccatctgcgacgtctcggtgcccgcggagcgcgagagcctcgtggccaccgtcgaggccaccttcggtggcaagctcgacatcctcgtgaacaacgcgggacagtcgctgttcaagacagccgtggagtgcaccggcgaggactccgcgcgggtcatggcgaccaacctcgagtcctgcttccacctcagccagctggcgcacccgctcctcctcctcgccggcggcggcggcagcgtggtccacatctcctccatcgccggcttcatcgggctcccggcgctcgccgtctactccatgaccaagggcgccatgaaccagctcaccaggagcctcgccgccgagtgggcccgcgacggcatccgcgtcaactgcgtcgcgcctggc

SEQ ID NO: 43251 - protein, 197 aa, Panicum virgatum
  misc_feature: Ceres CLONE 2015879
  misc_feature (17)..(186): Pfam Name: adh_short Pfam Description: short chain dehydrogenase
  misc_feature: SWISSPROT Homolog: EC 1.1.1.206 Tropine dehydrogenase
MVAAGRSREERWSLAGATALVTGGSKGIGHAIVEELAGFGARVHTCSRNAAELEACRRRWEEKGLAVTVSICDVSVPAERESLVATVEATFGGKLDILVNNAGQSLFKTAVECTGEDSARVMATNLESCFHLSQLAHPLLLLAGGGGSVVHISSIAGFIGLPALAVYSMTKGAMNQLTRSLAAEWARDGIRVNCVAP

SEQ ID NO: 43252 - DNA, 631 bp, Panicum virgatum
  misc_feature: Ceres CLONE 2015887
  misc_feature: Encodes the peptide sequence at SEQ ID NO. 43253
aacagagattatcctttcacccaacacgaatcccatagcttgaggtcgctcgatcgtcggggtgcagcagcctcttgttggagcctgcaggaagcaggaggaagagcagtggtggtgtagccatggcgcagccgcagccgagaagggaagaccaggagctgcggcaggcgcagcagggcagcaaggccccgcagcaggagcccatcaagtacggcgacgccttcgccgtgaagggcgagctggccgcgcagcccatcgcgccgcgcgacgcggcggccatgcggtccgccgaggacagcgtgccgggcgtgcaggtcccgcaggagagcggcggcgggttcagcgccgcggccttcatggagtcggcggcccagtacaacgaggccgtcggcgccgtgcgccccggccaggccagcgacgccgccgccaagcacgggatcaacgtcacccaggacgccgtgcccggcgggcgcatcgtcaccgagttcgtcgcaggccaggtatgtcgcgctctgatgatgatcgatcatgatgaggctccgagcccagaccgcgcttgcttatatgggtgctctgatgttttggtttctggtgtccaggtttgtagggcagtacgccgtccccgaagcgg

SEQ ID NO: 43253 - protein, 169 aa, Panicum virgatum
  misc_feature: Ceres CLONE 2015887
  misc_feature (27)..(91): Pfam Name: SMP Pfam Description: Seed maturation protein
MAQPQPRREDQELRQAQQGSKAPQQEPIKYGDAFAVKGELAAQPIAPRDAAAMRSAEDSVPGVQVPQESGGGFSAAAFMESAAQYNEAVGAVRPGQASDAAAKHGINVTQDAVPGGRIVTEFVAGQVCRALMMIDHDEAPSPDRACLYGCSDVLVSGVQVCRAVRRPRS

SEQ ID NO: 43254 - DNA, 328 bp, Panicum virgatum
  misc_feature: Ceres CLONE 2015910
  misc_feature: Encodes the peptide sequence at SEQ ID NO. 43255
attcgttcccgcaccacctccaccccaccagcagcctatctagggtttgcgagcgaggggcctcggggttgggatggcggcggatcgggtgaccgggacggtgaagtggttcaacgggaccaaggggttcggcttcatcacccccgacgacggctgccagtacctcttcctccaccagtcctccatcatagacatacggctaccccaacgtcaaggatggagagaccgactagttcaccttccgcgccgacagatacggccgccccaaggtcctcgacgtctccgcgcctggcggcaggacactcgacagcggggaactcccccacag

SEQ ID NO: 43255 - protein, 84 aa, Panicum virgatum
  misc_feature: Ceres CLONE 2015910
  misc_feature (5)..(57): Pfam Name: CSD Pfam Description: 'Cold-shock' DNA-binding domain
MAADRVTGTVKWFNGTKGFGFITPDDGCQYLFLHQSSIIDIRLPQRQGWRDRLVHLPRRQIRPPQGPRRLRAWRQDTRQRGTPP

SEQ ID NO: 43256 - DNA, 711 bp, Panicum virgatum
  misc_feature: Ceres CLONE 2015919
  misc_feature: Encodes the peptide sequence at SEQ ID NO. 43257
  misc_feature (639)..(639): n is a, c, t, g, unknown, or other
taacagtacaaggtgaggttattgagcactcctttggagaggagcacttgtgctttagaactttgcaacgctacactgcagctacccttgaacatggcatgcatcctccaatttcccccaaacctgaatggcgtgctctgatggacgaaatggctgtcgtggcaaccaaagaatatcgatcaattgtcttccaagaaccacgctttgttgaatacttcagatcggctacacctgagactgaatatggtaggatgaatatcggtagccgtccatcgaagaggaagcctagtgggggaatagaatcgctccgtgcaattccatggatctttgcttggacacagacaaggttccatctccctgtttggcttgggtttggcgcagcattcaagcatatcatgcagaaggacatcaggaacatccatactctgaaagaaatgtacaatgagtggccattcttcagagtcacccttgacttgcttgagatggttttcgccaagggagacccaggaatcgcagctgtgtacgacaaactgctagtggctgaagatctgcaatcctttggggagcagctgaggaagaactatgaggagacaaaagagctactccttcaggttgccggtcacaaggacgtcctcgaangcgatccttacctgaagcagcgtctgcggctgcgtgagtcctacatcaccacctttgaacgtctgccaggcc

SEQ ID NO: 43257 - protein, 236 aa, Panicum virgatum
  misc_feature: Ceres CLONE 2015919
  misc_feature: SWISSPROT Homolog: EC 4.1.1.31 Phosphoenolpyruvate carboxylase
  misc_feature (213)..(213): Xaa is any aa, unknown, or other
TVQGEVIEHSFGEEHLCFRTLQRYTAATLEHGMHPPISPKPEWRALMDEMAVVATKEYRSIVFQEPRFVEYFRSATPETEYGRMNIGSRPSKRKPSGGIESLRAIPWIFAWTQTRFHLPVWLGFGAAFKHIMQKDIRNIHTLKEMYNEWPFFRVTLDLLEMVFAKGDPGIAAVYDKLLVAEDLQSFGEQLRKNYEETKELLLQVAGHKDVLEXDPYLKQRLRLRESYITTFERLPG

SEQ ID NO: 43258 - DNA, 1280 bp, Panicum virgatum
  misc_feature: Ceres CLONE 2015930
  misc_feature: Encodes the peptide sequence at SEQ ID NO. 43259
ataaacataaaaactactccttagtaattactcaattaaatgaagaagctccttcttattgctgccctctctgccctcttgaccatctcctctgcgagcgtcaagacagattctctcgacggccacaataaatacagagcagatgtcggtctcgcaaaccttgtctggtcatcttcccttgctgataaagcacaagcctgggccgaaacccttgccaaaaacgatgcaatttctcacagtactggcagagacaatgttggtgaaagccttgcctacggcagttcaagaagcaacagtgtcaccagttttgtggatgcttgggctgacgagaaggaagattttattgaagaggaaatttaccctgcctgcagcgctactggtgatattgaagatgttaagcactactctcaaatggtatgggaggcgactgaacagcttggttgtggtttggcaaccaatgctgattctggcaaaatgtattatgtgtgccagtactatccagctggtaacatcaatggacagcctccatatcttctggatgaggaagaacctgaaccccaacagccagaagaccccactgaacctgaaccaactgagcctgaacaacctcagcaacctcaagaaccagaagagcctgtatccagcgatcccttcattgctcagtctttagctgctcacaacaatgaaaggctgaaatacggcgttccagcactaaagtggtcaacttcactcgctaacagcgctaaagcctattctgcggtccaagccagaactggaactaaatctcacagctcaggcagagtcaatgttggtgagaatctagcttggggaagcggcaaaggtaccgacgttgatttcttggctggcatgtggcttgctgagaaaaagtacttcattaggggcagaaatttccctagttgcagcaccactggcagctggagtgatgtggctcattacactacattgatgtggagaaagacaactgaagttggatgtggaatcaccaaatctagctccggtatgaattactatgtctgccattattctcctcgaggaaacatgaatggagaaccagtcttctaaggagtagtggaaggataaactggtgaatgaatcagtgagttcatcggaagaaaccaacatgaagtttacacaaatgaactccttaatttgtcactttttatcatttttatgcattatttttttcatatcgacttatttggatatctattagccttcatacttaaaaggctgctaagcttatccttttttactaaccc

SEQ ID NO: 43259 - protein, 347 aa, Panicum virgatum
  misc_feature: Ceres CLONE 2015930
  misc_feature (26)..(152): Pfam Name: SCP Pfam Description: SCP-like extracellular protein
  misc_feature (210)..(335): Pfam Name: SCP Pfam Description: SCP-like extracellular protein
MKKLLLIAALSALLTISSASVKTDSLDGHNKYRADVGLANLVWSSSLADKAQAWAETLAKNDAISHSTGRDNVGESLAYGSSRSNSVTSFVDAWADEKEDFIEEEIYPACSATGDIEDVKHYSQMVWEATEQLGCGLATNADSGKMYYVCQYYPAGNINGQPPYLLDEEEPEPQQPEDPTEPEPTEPEQPQQPQEPEEPVSSDPFIAQSLAAHNNERLKYGVPALKWSTSLANSAKAYSAVQARTGTKSHSSGRVNVGENLAWGSGKGTDVDFLAGMWLAEKKYFIRGRNFPSCSTTGSWSDVAHYTTLMWRKTTEVGCGITKSSSGMNYYVCHYSPRGNMNGEPVF

SEQ ID NO: 43260 - DNA, 1021 bp, Panicum virgatum
  misc_feature: Ceres CLONE 2015934
  misc_feature: Encodes the peptide sequence at SEQ ID NO. 43261
acattcccagttccttgcccctctcacgcttcacgtccaccagtagcaaaatggccctctccatgaaggcgatgaccacccgctctgctgcccgtggcagcatgatgggcagccgtgtgtccactgccaccaacggcaccaaggtggtcatgcgcgctggcaactggctgccaggcagcgacgccccctcttggctgcccgataccatcccagccaactacggcttcgacccactgggtctgggcaaggacaaggactccctggcccgcttccgcgagagcgagttgatccactgccgctgggctatgttgggtgttgctggctctctggccgtcgagctgctgggctttggcaactggtatgacgctcctctctgggccatcaacggtggcaaggctacatggttcggcattgaggtgcccttcgacatcaccaccctgctggtcattgagtttgttgcctttgctgtgtctgagggtctgcgcgctgacaactctgatgctgagaggaagctgtacccaggtggtgctttcgacccactgggcttcagcaaggatgccaagaactttgagacctacaagctgaaggagatcaagaacggtcgccttgccatggttgccatgattggctttatcggtcagcacgccgccactggcaagggcccactggctgctctgggcgagcacttgtccagcccatgggctgctaacttcgccaccaacggcgtgtctgtcccaggcctgtaaatcatccagcccaatctctcgtgtctgtgtgttttcagtgtgtgcgtgatgtgagctaacaaggccctagggccacaaaactcaagtaaactgcagctgaagctttttccacgagggtgaagagctgccacctgccatcgtgcagtttttctagctttgattaccctttagctaccagctaagtgtccttgtgcatctattgagtgattcgacaaattgctttgtcaactgaagggtcgacccgcctttctttgtaaaggtggaagcggtatctc

SEQ ID NO: 43261 - protein, 231 aa, Panicum virgatum
  misc_feature: Ceres CLONE 2015934
  misc_feature (44)..(199): Pfam Name: Chloroa_b-bind Pfam Description: Chlorophyll A-B binding protein
MALSMKAMTTRSAARGSMMGSRVSTATNGTKVVMRAGNWLPGSDAPSWLPDTIPANYGFDPLGLGKDKDSLARFRESELIHCRWAMLGVAGSLAVELLGFGNWYDAPLWAINGGKATWFGIEVPFDITTLLVIEFVAFAVSEGLRADNSDAERKLYPGGAFDPLGFSKDAKNFETYKLKEIKNGRLAMVAMIGFIGQHAATGKGPLAALGEHLSSPWAANFATNGVSVPGL

SEQ ID NO: 43262 - DNA, 682 bp, Panicum virgatum
  misc_feature: Ceres CLONE 2015959
  misc_feature: Encodes the peptide sequence at SEQ ID NO. 43263
aatcgaaatcaaaataatatgattcaacctcagacccttttaaatgtagcagataacagtggagctagaaaattgatgtgtattcgagtcataggagccgctggtaatcagcgatatgctcgtattggtgatgttattgttgctgtaatcaaagacgcagtaccccaaatgcctctagaaagatccgaagtaattcgagctgtaattgtacgtacatgtaaagaattcaaatgcgaagatggtataataatacgctatgatgacaatgcagcagttatcattgatcaaaaaggaaatccaaaaggaactcgagtttttggcgcgattgccgaagaattgagagaattgaattttacgaaaatagtttcattagctcctgaagtattataaacactagtagacgagatatagatcaaagaaaaattagtagattgtgtctcacgtatatgctttaaaatccaaaattaaaagaaaaaggaaaacatgttgattatagaaaaattaggaggaacctagaattagagtcttatgggcaaggacactattgctgatttactaacctctataagaaacgcagacatgaataaaaaaggaactgttcgagtagtatccacaaatattaccgaaaacattgttaaaatacttctacgagagggttttattgaaagtgttcggaaacatc

SEQ ID NO: 43263 - protein, 129 aa, Panicum virgatum
  misc_feature: Ceres CLONE 2015959
  misc_feature (7)..(129): Pfam Name: Ribosomal_L14 Pfam Description: Ribosomal protein L14p/L23e
NRNQNNMIQPQTLLNVADNSGARKLMCIRVIGAAGNQRYARIGDVIVAVIKDAVPQMPLERSEVIRAVIVRTCKEFKCEDGIIIRYDDNAAVIIDQKGNPKGTRVFGAIAEELRELNFTKIVSLAPEVL

SEQ ID NO: 43264 - DNA, 447 bp, Panicum virgatum
  misc_feature: Ceres CLONE 2015963
  misc_feature: Encodes the peptide sequence at SEQ ID NO. 43265
agagcagcagcccagcaaaagcagaggaagcggacgactccgcgctgtgggtggcaatggctgctggcacctgggtaaagctggagcagaaggggaccgggccaggagcaaggagctcccacgccatcaccctcgtcggcgacacggcctacgcgttcggcggcgagctcaccccgcgcgtgccggtggacaacaccatgtacgccttcgacctccagacccagacctggtcgccggtcgccgccacgggcgacgtgccgccgccgcgcgtcggcgtgaccatggcggccgtcggcggcacggtgtacatgttcggcgggcgcgaccaggaccacaaggagctcaacgagctctactccttcgacacggcggcgggcgcgtgggccctcctctcctccggggccgacggcccgccgcaccggagctaccactccatggcggccgagt

SEQ ID NO: 43265 - protein, 130 aa, Panicum virgatum
  misc_feature: Ceres CLONE 2015963
  misc_feature (18)..(65): Pfam Name: Kelch_1 Pfam Description: Kelch motif
  misc_feature (70)..(116): Pfam Name: Kelch_1 Pfam Description: Kelch motif
  misc_feature: SWISSPROT Homolog: EC 3.1.3.16 Phosphoprotein phosphatase
  misc_feature: Functional homolog of the protein sequence given in SEQ ID NO 51669
  misc_feature: Useful for making plants with modulated cold sensitivity
MAAGTWVKLEQKGTGPGARSSHAITLVGDTAYAFGGELTPRVPVDNTMYAFDLQTQTWSPVAATGDVPPPRVGVTMAAVGGTVYMFGGRDQDHKELNELYSFDTAAGAWALLSSGADGPPHRSYHSMAAE

SEQ ID NO: 43266 - DNA, 597 bp, Panicum virgatum
  misc_feature: Ceres CLONE 2015963-R
  misc_feature: Encodes the peptide sequence at SEQ ID NO. 43267
ctacgacccggcgaccgggcggtggtcggcggtggagaccgccggcgacaagccgagcccccgcagcgtgttctgcgccgccggaatcggggagcgcgtcgtcgtgttcggcggcgaggtggaccccagcgacctgggccacctcggcgccggcaagttctcggctgaggcgttcgcgctggacacggggaccggcgcgtggacgcgcctggacgacggcgccgccggggccggggccgagcaccacccggggtctcgcgggtggtgcgcgttcgcggcgggggagaaggacggccggcgagggctgctggtctacggcggcaactcgccgaccaacgaccggctcgatgacatctatttcttcgcgcccgctctagaggccgcgagctaggcactggcatgtatgtgttcatgcagtggccggcggcgagctctcttcttctctccgtgtgtgcatctgcaataatgtatagcagggcaatctgcaggcttgttgtggtggcggctgtgttgtgttgttgtaaatcttgctcccttggcttctgtctgtgctagtactcccttagtatgctgtgtgatgctctgattatattgtag

SEQ ID NO: 43267 - protein, 129 aa, Panicum virgatum
  misc_feature: Ceres CLONE 2015963-R
  misc_feature: SWISSPROT Homolog: EC 3.1.3.16 Phosphoprotein phosphatase
YDPATGRWSAVETAGDKPSPRSVFCAAGIGERVVVFGGEVDPSDLGHLGAGKFSAEAFALDTGTGAWTRLDDGAAGAGAEHHPGSRGWCAFAAGEKDGRRGLLVYGGNSPTNDRLDDIYFFAPALEAAS

SEQ ID NO: 43268 - DNA, 650 bp, Panicum virgatum
  misc_feature: Ceres CLONE 2015979
  misc_feature: Encodes the peptide sequence at SEQ ID NO. 43269
gctcgcaggtttcgcaaggcggccacacgccaaaacctccaccaccacccgttcccgtcgcctcccccgccgggccacgccaccatgttaacaccggccgcccgcctcgcggcccgccgcctcctcggcctcccctcctcctccgcgtcgaaagccgccgcccgccgcctggttccggttccaatcgccgcctcttcctaccccgccgccgctaggggttccgtccccagttccaaacccttctccacggttcttaactaccacattgattcgccgaaaaacaagccgaacataaaatggaagttcacggaggcaaacataaaaaaggtcaaggaaatactgtctcactacccaagcaactacaagcaatcaggtattattccgttgcttgatcttgcccaccaccagcatggggaatgggtgccggttgcaccaatggatgctattgttaaaatcgttaaatttgcgccaatcagggaatatgaagttgctactttttacactatgtttaatcgaactaaggttggtaaataccaccttctatggtgtggaactacaccttgcatgattctgggctcacgtgaaattgaaaagacataattgaagcaccttgaagtaaaaagaaatgaggtgacaagtgatggttaatt

SEQ ID NO: 43269 - protein, 171 aa, Panicum virgatum
  misc_feature: Ceres CLONE 2015979
  misc_feature (72)..(170): Pfam Name: Complex1_24kDa Pfam Description: Respiratory-chain NADH dehydrogenase 24 Kd subunit
  misc_feature: SWISSPROT Homolog: EC 1.6.99.5 NADH dehydrogenase (quinone)
MLTPAARLAARRLLGLPSSSASKAAARRLVPVPIAASSYPAAARGSVPSSKPFSTVLNYHIDSPKNKPNIKWKFTEANIKKVKEILSHYPSNYKQSGIIPLLDLAHHQHGEWVPVAPMDAIVKIVKFAPIREYEVATFYTMFNRTKVGKYHLLWCGTTPCMILGSREIEKT

SEQ ID NO: 43270 - DNA, 684 bp, Panicum virgatum
  misc_feature: Ceres CLONE 2015988
  misc_feature: Encodes the peptide sequence at SEQ ID NO. 43271
tctcgcagcccactctctcggacggactcccccctctctggttctgctctgaccttgagtgcggcgcaagccagcaggagcagagctgagcagggaaggaatttcccgaggggacagcccgcagctgccgccagaagagagcacccggagggggagcctccaaacgcaagcaaccaagcccacgcggcaggagcgctcccctcactagtcctcagagagacgttccccgagcgagtccaactccgaaaggccgcgatgaggtcgtctctgctgaaatccacgtccgagctcctccgccgcagccgcggctactcctcctctgccaacccggagcggaaggtggccatcctgggcgcggctggtggcatcgggcagccgctctcactcctcatgaagctcaacccgctcgtctcctccctctccctctacgatatcgcggggaccgtcggcgtcgctgccgacgtgtcccacatcaacacccccgccctggtgaaggggttcatgggggatgaccagctcggggaggcgctggagggatccgacgtcgttatcatccccgccggggtgcccaggaagcccggcatgaccagggatgacctctttcacatcaacgctggcattgttaaggcgcttagcacggccatcgccaagcactgccccaacgcacttgtcaatatgatcagc

SEQ ID NO: 43271 - protein, 142 aa, Panicum virgatum
  misc_feature: Ceres CLONE 2015988
  misc_feature (27)..(142): Pfam Name: Ldh_1_N Pfam Description: lactate/malate dehydrogenase, NAD binding domain
  misc_feature: SWISSPROT Homolog: EC 1.1.1.37 Malate dehydrogenase
MRSSLLKSTSELLRRSRGYSSSANPERKVAILGAAGGIGQPLSLLMKLNPLVSSLSLYDIAGTVGVAADVSHINTPALVKGFMGDDQLGEALEGSDVVIIPAGVPRKPGMTRDDLFHINAGIVKALSTAIAKHCPNALVNMI

SEQ ID NO: 43272 - DNA, 725 bp, Panicum virgatum
  misc_feature: Ceres CLONE 2015999
  misc_feature: Encodes the peptide sequence at SEQ ID NO. 43273
gacttctccgcggtgcctcttccgaagcgagtcacggcgcatcctccacgagggagccatccgcactcgtcgttggcgcggcgggacgaggatctatcctcgatcggacagacgggcttcctcgccgccggccgctggttaaacttttgtgatatcttcctccacttagccgcatcacaaggagaatggcaagcaaagcaggcagtgatggcaaagaagccataaacgagcaagtaatcgccaacacttatgccaacatgcgcaccgaaatgaaccagctctacaccaagatcacggagctggagatggaggtcagcgagcactccctcgtgatcggtgctatcgagccgctggacccctcgaggcgctgctacaggatgatcggcggtgtcctggtggagaggaccatcaaggaggtcctgcccgcggtgaagcgcaacaaggagggcctcgaggaggtgatcgcccgcatgcacgaggcgctggagaggaagaagaaggagatcaccgagttcgagctcaagtacaagatcagaattcgtaaggcagacaatgactctgaggaaggcgggaagaaggaaggcactgcgcagggggttcttgttgggcctgctgggcagtaaaaccgagttatggagacctgcatgcagttactttggtgcccagattgcttctttgctagatgtggaatgatatctctgggtgttttaggggggatatgcttt

SEQ ID NO: 43273 - protein, 145 aa, Panicum virgatum
  misc_feature: Ceres CLONE 2015999
  misc_feature (16)..(121): Pfam Name: Prefoldin_2 Pfam Description: Prefoldin subunit
MASKAGSDGKEAINEQVIANTYANMRTEMNQLYTKITELEMEVSEHSLVIGAIEPLDPSRRCYRMIGGVLVERTIKEVLPAVKRNKEGLEEVIARMHEALERKKKEITEFELKYKIRIRKADNDSEEGGKKEGTAQGVLVGPAGQ

SEQ ID NO: 43274 - DNA, 1099 bp, Panicum virgatum
  misc_feature: Ceres CLONE 2016018
  misc_feature: Encodes the peptide sequence at SEQ ID NO. 43275
atctcatcccacaaaagctgtcagcctagctccattgcctagcctctctcctcgtcctccatttccatctcgttctctgcagctacctttgcataggcttccatggacatggccaggtctctgatcttgtgcacagtccttacagcgtgcctcgcgcacaccgccgcccagtggaaccctggcaccgccacgttctacggcggacccgacggctccgacaccatgggtggcgcgtgcgggtacggcaacctgtacaacgctggctacggtattctcaacgcggcgctgagcgagaccctgttcaagggaggcgcgtcgtgcgggcagtgctacaccatctcgtgcgacgggtcgcgcccgggcggcgagtactgcaagcccggcacgtcgatcaccgtctcggccaccaacctgtgcccggccaacttcgcgctgcccaacggcggctggtgcggcccggggcgcccccacttcgacatgtcgcagccggcgtgggagcacattggcgtctaccaggccggcgtcatccccgtcgtgtaccagcaggtcaagtgctggcgcagcggcggcgtgcgcttcagcatcgccgggttcaactacttccttctcatcaacatccagaacctcagtggcagcggctccgtgggcaacgcatggatcaagggcgccaacaccgggtggatccagatgtccaggaactggggagcaaactggcaggcgctctccgggctcgtcggccaggggctcagcttcgccgtgaccagcaccggcgggcagtacattcagttcctcaacgtcgtcccggcgtggtggaagttcggcgagacctacaccaccaaccagaacttctactactaagatttccaaacttatacaatgcggtcaacttgccagtgcatcgttggtgatgacgactgactggcatagatcggcgatagttcgactgcaggaggtcgaaaaggattttttttccctacactgtagttaccaactcatactattgttcttaaaatcttgcgatacatcatatatatatatataacacatatataccaaatgtaaagctctttcaacactctatatcagacttccaaactcg

SEQ ID NO: 43275 - protein, 251 aa, Panicum virgatum
  misc_feature: Ceres CLONE 2016018
  misc_feature (59)..(146): Pfam Name: DPBB_1 Pfam Description: Rare lipoprotein A (RlpA)-like double-psi beta-barrel
  misc_feature (157)..(234): Pfam Name: Pollen_allerg_1 Pfam Description: Pollen allergen
  misc_feature: SWISSPROT Homolog: EC 3.2.1.4 Cellulase
  misc_feature: Functional homolog of the protein sequence given in SEQ ID NO 51623
  misc_feature: Useful for making plants with altered carbohydrate content
  misc_feature: Functional homolog of the protein sequence given in SEQ ID NO 51670
  misc_feature: Useful for making plants with altered cell wall content and/or composition
  misc_feature: Functional homolog of the protein sequence given in SEQ ID NO 50489
  misc_feature: Useful for making plants with altered lignin content
MDMARSLILCTVLTACLAHTAAQWNPGTATFYGGPDGSDTMGGACGYGNLYNAGYGILNAALSETLFKGGASCGQCYTISCDGSRPGGEYCKPGTSITVSATNLCPANFALPNGGWCGPGRPHFDMSQPAWEHIGVYQAGVIPVVYQQVKCWRSGGVRFSIAGFNYFLLINIQNLSGSGSVGNAWIKGANTGWIQMSRNWGANWQALSGLVGQGLSFAVTSTGGQYIQFLNVVPAWWKFGETYTTNQNFYY

SEQ ID NO: 43276 - DNA, 962 bp, Panicum virgatum
  misc_feature: Ceres CLONE 2016019
  misc_feature: Encodes the peptide sequence at SEQ ID NO. 43277
gtacatgcaatgcatatccactcgctcccttccttccttgccttatttgcgttcccttccctttacccgacccgagccaatccagcccatgatctccgcctcctcctccggccgccgcatcgcgtatttaaacacgcgcacgcacgcaacccaggatcccattccgggcccatgcgctgttccaagctgctcgctcctgccgccgccgccgccgccgcttttcgaatcgacgacgatcgtgatatggaggaagacgattgccaggcggaggcggcggcgctccgtggccagcggcggcaaggtgcgatcaacgccgccggcggctgggtcgtatccaaggccgggtcggtgtccagcggatcgtcgtcgtcgctcttctcgtcgacgtcgagcctgacggaccaggaggaggaggacggcgacggcgcgacgtcctgctgccggccggatcgtgacgtctcgtcttcgtccttgtcctccctgacttcgtcggggtccgagacggtgcagatgggcggcgggccgctcaacgcgctgtcgacgatgctggaggatcttccgcctctcagaacagggttgtccaagcactaccaggggaagtcccagtccttcacatcgctggccgatgtcagctgtgtggaggacctcgcgaagaagacgaccccttacatcaggagaaagaaggcgcccaggcgctacgctgaagtgctgggtgcgacgaaccggttgtcaaagacgatagccaaaaaggcgccgagggccaaaccacctgcataccagggcaagagagagatgtacagatgtccaaaaaatgaagaaccatgaggcctccttatcttcactcatcagtagacctttctgaaatagtttgtttttttacttcagttctcagaactgtgatcagtcctttgtctgcatccttgattggtgtatatagtggatgatgcaaaggttaataactg

SEQ ID NO: 43277 - protein, 193 aa, Panicum virgatum
  misc_feature: Ceres CLONE 2016019
  misc_feature: Functional homolog of the protein sequence given in SEQ ID NO 51254
  misc_feature: Useful for making plants with modulated biomass
MEEDDCQAEAAALRGQRRQGAINAAGGWVVSKAGSVSSGSSSSLFSSTSSLTDQEEEDGDGATSCCRPDRDVSSSSLSSLTSSGSETVQMGGGPLNALSTMLEDLPPLRTGLSKHYQGKSQSFTSLADVSCVEDLAKKTTPYIRRKKAPRRYAEVLGATNRLSKTIAKKAPRAKPPAYQGKREMYRCPKNEEP

SEQ ID NO: 43278 - DNA, 674 bp, Panicum virgatum
  misc_feature: Ceres CLONE 2016023
  misc_feature: Encodes the peptide sequence at SEQ ID NO. 43279
gttggttgttgccgtcgtcgtcttcaactggccatccccttgtctttgaccagaggacccgtggaagcagaatcaaggaggtggagcgccatggcgggctccgatccccccctcgcgcgtccaggattagccatcgtgatcatgggagtcagcggctgcggcaaatcaaccgtcgcggcactgcttgctgaagccctgggttgcagcttcatcgaagcagacgactaccattcccaggaaaacaaagcgaagatgagcaagggcatcccgctctccgacgccgaccgcacgccatggctggaatccctccaagacgccatccgggagcgactcgacggcggtgagaacgtggccgtcagttgctcggcgctgcggctcaagtacagggaggtcatccgggcggctgaccggagctacaagccgggggactacgccacctgcagggtgaagttcgtgtgcctgaggacgtcggcagaggtgatcaccgagaggatgcagaggaggtcaagcgaagggaaacacttcatgccggcgagtttgctgcaaagccagctcgacctgctcaagatcgacgcggcggaggggatcaccgaggtcgatgcgacggtgcgtgccggcaacattgtccgcgacaccgttgctcagttcagggaggagctggcatccacagtttc

SEQ ID NO: 43279 - protein, 194 aa, Panicum virgatum
  misc_feature: Ceres CLONE 2016023
  misc_feature (21)..(174): Pfam Name: SKI Pfam Description: Shikimate kinase
  misc_feature: SWISSPROT Homolog: EC 2.7.1.12 Gluconokinase
MAGSDPPLARPGLAIVIMGVSGCGKSTVAALLAEALGCSFIEADDYHSQENKAKMSKGIPLSDADRTPWLESLQDAIRERLDGGENVAVSCSALRLKYREVIRAADRSYKPGDYATCRVKFVCLRTSAEVITERMQRRSSEGKHFMPASLLQSQLDLLKIDAAEGITEVDATVRAGNIVRDTVAQFREELASTV

SEQ ID NO: 43280 - DNA, 658 bp, Panicum virgatum
  misc_feature: Ceres CLONE 2016026
  misc_feature: Encodes the peptide sequence at SEQ ID NO. 43281
cgtcagcttgcattgaaaataagtgcaaactcggtttatggtttcactggagcaactgttggtcaattaccttgtttagagatttcttcaagtgtgaccagctatggccgacagatgattgaacatacaaagaagcttgttgaagataaattcacaacagtaggaggctatgagcataatgcagaggtaatatatggggatactgattctgtgatggtacagtttggtgtttctacagttgaagatgcaatgaagttgggtagagaagctgcagattatattagtggaacatttactaagcctatcaagctggaatttgaaaaggtctactttccttacctgcttatcagcaagaagagatatgctggtttgtactggacgaatcctgagaaatttgacaagatggatgcaaaaggtattgaaactgtaagaagagacaactgtttattggtaaagaacctggtaactgagtgccttcataaaatactagtggaccgtgatgttcctggtgcagttcagtatgtcaagaacaccatatcagatctattaatgaatcgtgtggacttgtctcttcttgttataacaaagggtttgactaaaacaggggaagattatgcagtaaaagcagctcatgtggagcttgctgagaggatgcgaa

SEQ ID NO: 43281 - protein, 219 aa, Panicum virgatum
  misc_feature: Ceres CLONE 2016026
  misc_feature (1)..(219): Pfam Name: DNA_pol_B Pfam Description: DNA polymerase family B
  misc_feature: SWISSPROT Homolog: EC 2.7.7.7 DNA-directed DNA polymerase
RQLALKISANSVYGFTGATVGQLPCLEISSSVTSYGRQMIEHTKKLVEDKFTTVGGYEHNAEVIYGDTDSVMVQFGVSTVEDAMKLGREAADYISGTFTKPIKLEFEKVYFPYLLISKKRYAGLYWTNPEKFDKMDAKGIETVRRDNCLLVKNLVTECLHKILVDRDVPGAVQYVKNTISDLLMNRVDLSLLVITKGLTKTGEDYAVKAAHVELAERMR

SEQ ID NO: 43282 - DNA, 719 bp, Panicum virgatum
  misc_feature: Ceres CLONE 2016036
  misc_feature: Encodes the peptide sequence at SEQ ID NO. 43283
atcaccatccaggcaatcaccgaagacagcacaagacaatcaccacgaactagctcagtgcagttcactgcaatggctgctttcgccgccatggttgccatcgccgtgctcgcccttgcaacggtcgccgacgcagcttcgacaccggcggccgtggcggcggcggcgacgacgacgaccaagagtccaccggtgatctacattttcggggactccatgtccgacgtcgggaacaacaactacctcctgctctccctcgccaagtgcaactacccctggtacggcatcgactacaagaccggctaccccaccgggaggttcaccaatggccgcaccatcggagacatcatggctgccaaattcggcgccccgcccccggtgcccttcctctccctgtacatgaccgacgacgaggtcctcggcggcgtcaacttcgcgtccggcggcgccgggctcctcaacgagaccggcatttactttgtccagtacctgtcgttcgacaaccagatatcgtacttcgagcagatcaagaacgcgatgatcgccaagatcggcaagaaggccgccgaggagaccgtcaatggcgcaatcttccagatcgggctcgggagcaacgactacgtcaacaacttcctgcggccgttcatggcggacggcatcgtgtacacccacgacgagttcatcggcctcctcatggcgaccatggaacggcagctcac

SEQ ID NO: 43283 - protein, 215 aa, Panicum virgatum
  misc_feature: Ceres CLONE 2016036
  misc_feature: SWISSPROT Homolog: EC 3.2.1.51 Alpha-L-fucosidase
MAAFAAMVAIAVLALATVADAASTPAAVAAAATTTTKSPPVIYIFGDSMSDVGNNNYLLLSLAKCNYPWYGIDYKTGYPTGRFTNGRTIGDIMAAKFGAPPPVPFLSLYMTDDEVLGGVNFASGGAGLLNETGIYFVQYLSFDNQISYFEQIKNAMIAKIGKKAAEETVNGAIFQIGLGSNDYVNNFLRPFMADGIVYTHDEFIGLLMATMERQL

SEQ ID NO: 43284 - DNA, 1504 bp, Panicum virgatum
  misc_feature: Ceres CLONE 2016041
  misc_feature: Encodes the peptide sequence at SEQ ID NO. 43285
agagagagaaacgtgaggaggtggaggctcaacgcgcccaccctcacagcttcgaattccgctcccctcctctcctcgggcctcggcgccgcaacccgcgcggcgcgttcacaccggcgaaccctagccccccgccccccgctatccggaggggatgcagacggaggcgcgcgtgggcgtcgtcgtcgacggcggcggcggccgcgccgcggtcgcccggcgccaggagcagcgtcacatcggcacggcggcgcacctcgccgccggaggcttcgccggcgccgtcagcaagacgtgcaccgccccgctcgcgcggctcaccatcctcttccaggtggcaggtatgcacgcagatgctgcagctctaaggaagtatagcatatggcatgaggcttcacgaattgttcgagaagaagggtttcgagccttttggaaaggaaatctagtgacaattgtacatcgcttaccttattccgccatcagcttctattcatatgaccgctacaaaattcttctccaaatggtcccaggcttggatagagaatcaaacaatgttggtgttgtacgtttgcttggtggcgggttggcgggaataacagccgcatctgcaacctacccgttggatgttgtccgtactcgtttggcaacacagaaaacaactaggtattacaagggcatcttccatgcgatgtctacaatttgtagagatgagggtgtcaaaggattgtacaaaggccttggggccacgttactgggagttggacctagtatagcaatcagcttttctgtttatgaatcactgaggtctcactggaaaatggaaaggccccacgactctaccgcggttgttagcttgttttctggaagcctatctggcattgcatcatcgacagccacatttcctcttgatcttgtaaaacggcggatgcaactacaaggagcagctgggacagctcctggccataaatccacaattactggaactgttcgtgacattttgcagaaggaaggccctcgtggcttttatagagggatcgcccctgagtacctcaaggttgttcccagtgttggcattgcctttatgacatacgagacactgaagagcttgctctccagcatggacgcagatgacgagagctgaggttttccattttacagagaggttaaacttcagggagattttagccataggtcactgtcagaactcagaagctaagtgcatcagagtggttacatggccggcagtgtggcagttttgtagttcttggtaggataaagcttgcctgacacatgtacaaataaaccgtcagtcttatgttgtaccataggctaagaagagcaaatgagcacttcatcttttgcgttcatcggagcattgtgctccagttttgtgtcatgaaatgtaatgccctcgcaaggagaaaaagagaggcgatagtcaatgattttacagattctattttttcttttgcagcaaatgtgtgatgtatgcatgacttcactc

SEQ ID NO: 43285 - protein, 328 aa, Panicum virgatum
  misc_feature: Ceres CLONE 2016041
  misc_feature (229)..(323): Pfam Name: Mito_carr Pfam Description: Mitochondrial carrier protein
  misc_feature (134)..(224): Pfam Name: Mito_carr Pfam Description: Mitochondrial carrier protein
  misc_feature (30)..(125): Pfam Name: Mito_carr Pfam Description: Mitochondrial carrier protein
MQTEARVGVVVDGGGGRAAVARRQEQRHIGTAAHLAAGGFAGAVSKTCTAPLARLTILFQVAGMHADAAALRKYSIWHEASRIVREEGFRAFWKGNLVTIVHRLPYSAISFYSYDRYKILLQMVPGLDRESNNVGVVRLLGGGLAGITAASATYPLDVVRTRLATQKTTRYYKGIFHAMSTICRDEGVKGLYKGLGATLLGVGPSIAISFSVYESLRSHWKMERPHDSTAVVSLFSGSLSGIASSTATFPLDLVKRRMQLQGAAGTAPGHKSTITGTVRDILQKEGPRGFYRGIAPEYLKVVPSVGIAFMTYETLKSLLSSMDADDES

SEQ ID NO: 43286 - DNA, 652 bp, Panicum virgatum
  misc_feature: Ceres CLONE 2016047
  misc_feature: Encodes the peptide sequence at SEQ ID NO. 43287
accctatccgcttctagacactcagccacctcgcgcatctcctcccattctcccaaacccgttgtcctcgcagcacccacctcgccatgggcaagataaagatcggaatcaacggtttcggaaggatcggcaggctcgttgcccgtgtcgcgctccagagcgaggatgtcgagctcgtcgccgtcaacgacccgttcatcaccaccgactacatgacctacatgttcaagtatgacaccgtgcacggccactggaagcacagcgacatcaagctcaaggacaccaagaccctcctcttcggtgagaagccagtcaccgtctttggcttcaggaacccagaggagatcccttggggtgaggctggtgctgagtatgtcgtggagtccaccggtgtcttcaccgacaaggataaggctgcggctcacttgaagggtggtgccaagaaggttgttatctctgctccaagcaaagatgcgcctatgttcgttgttggtgtcaacgaggacaagtacacctcagatgttaacattgtctccaatgctagctgcaccacaaattgccttgctcccctcgctaaggtgattcatgacaacttcggcattattgagggtctgatgacgaccgttcatgccatcactgccacccagaagac

SEQ ID NO: 43287 - protein, 188 aa, Panicum virgatum
  misc_feature: Ceres CLONE 2016047
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDIKLKDTKTLLFGEKPVTVFGFRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQK

SEQ ID NO: 43288 - DNA, 676 bp, Panicum virgatum
  misc_feature: Ceres CLONE 2016049
  misc_feature: Encodes the peptide sequence at SEQ ID NO. 43289
gcggaggaggggaggtcggtggggggttggagagtgcggcgagcaggcggggagatgtcggacgcgctgattaatggcctcgcgggcgccggcggcgggatcatcgcccagctcctcacctacccgctccagaccgtaaacgcgcggcagcagacagagcgcgaccctaccaagccggcgtttaaggacggcgccgcgcgccagttatacttggttgtgaagagtgaggggtgggagcgcctgtacggcgggctcatgccctcgctcgtcggcaccgccgcctcccagggtgtctactactacttctaccaaatattccggaacagggccgaggccaaggcccttgagcgatccaggagagggcttgtcgatgggtctgtcgggatgctccaatctctcactgtcgctgccctgtctggctgcgtcaatgtactgctcacaaacccaatttgggtggttgttacccgaatgcaaactcacagaaaggccaacaaacaacaaagcccgcagggtttgacatgtgctcttgacaaggccatggaagctgctattactgaaaccaccccttacaaaactatcgatgtttttcaggaactgtacaaagaagctggagtgttgggcttctggaaaggggtaatcccagctcttattatgggttagcatcctgcgatgcagt

SEQ ID NO: 43289 - protein, 201 aa, Panicum virgatum
  misc_feature: Ceres CLONE 2016049
  misc_feature (3)..(96): Pfam Name: Mito_carr Pfam Description: Mitochondrial carrier protein
  misc_feature (110)..(201): Pfam Name: Mito_carr Pfam Description: Mitochondrial carrier protein
MSDALINGLAGAGGGIIAQLLTYPLQTVNARQQTERDPTKPAFKDGAARQLYLVVKSEGWERLYGGLMPSLVGTAASQGVYYYFYQIFRNRAEAKALERSRRGLVDGSVGMLQSLTVAALSGCVNVLLTNPIWVVVTRMQTHRKANKQQSPQGLTCALDKAMEAAITETTPYKTIDVFQELYKEAGVLGFWKGVIPALIMG

SEQ ID NO: 43290 - DNA, 1018 bp, Panicum virgatum
  misc_feature: Ceres CLONE 2016051
  misc_feature: Encodes the peptide sequence at SEQ ID NO. 43291
gcctctcgcccaaagccctagccctcgccctcgcgccgccgccgccacccgccagcgcgcgccgcgacgtcaccatgaagttcaacatcgcctacccgcccaccgggtgccagaagaagctcgaggtagatgacgaccagaagcttcgtcccttctttgacaaaagaatatcccaggaggtccttggtgatgcttttggcgaggaattcaagggctatgtcttcaagatcaatggaggctgtgacaagcaaggtttcccaatgaagcaaggagtgctgacttctggccgagtccgccttctgctccacaggggcactccgtgcttccgtgggtatggtaggcgtgatggtgagcgcaggaggaagtcggtccgtggttgcattgtcagccaagacctatctgttatcaacctggtgattgtcaagaagggggagaatgatcttcctgggctgaccgacactgagaagcccaggatgaggggacctaagagggcatccaagatcaggaagctcttcaacctttccaaggatgatgatgtacgcaagtatgtcaacacataccgcaggacattcactaccaagaatggcaaaaaggttagcaaggcccccaagatccagcgtctcgtgacccctcaggtgctgcagaggaagcgcgccaagattgcggagaagaagaggaggattgccaagaagcaggctgatgctgcagagtaccagaagctgctggcccagagactcaaggagcagagggagcgccgaagtgagagcctggccaagaggaggtccaagctctctgccgctgccaaggcctcggctgccacatccgtctaaggaatgtccagatgctttgagttgtttttagaagccttcctacctacctaagaacaatgttatagctgaaaaccccatgcactatgtttgctctgttacaaacctctattctctagctacatcagtgcaattttgcgtggacatgatgctggcttgtcaaaaaaaaatttgagtacctgagatttatt

SEQ ID NO: 43291 - protein, 251 aa, Panicum virgatum
  misc_feature: Ceres CLONE 2016051
  misc_feature (1)..(129): Pfam Name: Ribosomal_S6e Pfam Description: Ribosomal protein S6e
MKFNIAYPPTGCQKKLEVDDDQKLRPFFDKRISQEVLGDAFGEEFKGYVFKINGGCDKQGFPMKQGVLTSGRVRLLLHRGTPCFRGYGRRDGERRRKSVRGCIVSQDLSVINLVIVKKGENDLPGLTDTEKPRMRGPKRASKIRKLFNLSKDDDVRKYVNTYRRTFTTKNGKKVSKAPKIQRLVTPQVLQRKRAKIAEKKRRIAKKQADAAEYQKLLAQRLKEQRERRSESLAKRRSKLSAAAKASAATSV

SEQ ID NO: 43292 - DNA, 696 bp, Panicum virgatum
  misc_feature: Ceres CLONE 2016058
  misc_feature: Encodes the peptide sequence at SEQ ID NO. 43293
acaaaccctttctaccgcaaccaacttcatcagaaccgccggctcagcaacatggctaccaaggggtacaaacttctctgcttggagaaccctctcctcgacattcaggcctttggcaatgacgcacttctcgagaagtacggtctcaaggccaatgatgctatcctggccgatcccgagaagcacctagacctctatgaggacctcctcaacaactacgatgccaagctgattgccggcggtgccgcccaaaacacggcccgcggtgcccaatacatgcttcctgctaacagcgttgtctacttgggcggcgccggcgacgacaagtactccgcgatcctacgggacgcctgcaagcaggccggcctccgtgtcgagtaccgcgtcgaccccaagatccccaccggccgttgcggcgtcgtcatcaccggccacaaccgtagcatgtgcaccgacttgggcgctgctaaccactatgatctcgagcacctgaagcgccccgatatctgggcactcgttgaagaagctgaggcgtattacattggcggctaccacttcactgtctgccctcctgccatcatggagctcgccaaccaggccgccagcaagaacaagcctttcattctgtcgctctccgcacccttcatcccccaattcttcaaggagccgctcgacgcctctgcgccctactgggat

SEQ ID NO: 43293 - protein, 214 aa, Panicum virgatum
  misc_feature: Ceres CLONE 2016058
  misc_feature: SWISSPROT Homolog: EC 2.7.1.20 Adenosine kinase
MATKGYKLLCLENPLLDIQAFGNDALLEKYGLKANDAILADPEKHLDLYEDLLNNYDAKLIAGGAAQNTARGAQYMLPANSVVYLGGAGDDKYSAILRDACKQAGLRVEYRVDPKIPTGRCGVVITGHNRSMCTDLGAANHYDLEHLKRPDIWALVEEAEAYYIGGYHFTVCPPAIMELANQAASKNKPFILSLSAPFIPQFFKEPLDASAPYW

SEQ ID NO: 43294 - DNA, 684 bp, Panicum virgatum
  misc_feature: Ceres CLONE 2016060
  misc_feature: Encodes the peptide sequence at SEQ ID NO. 43295
aaaactcccagtcaaaccaaactcacggctgccggctggcgtgccctccgacaacccgcatgattgcggcggctactagaggcgggctcagcggcccccgaatcctgctatccctcgcggtcctcgccctcgccattgccttcgtctcccgctcccgcgcccccacggttccagacatggccgacgacctgcccgcctccatctacgacatcgccgtcaaggatattaggggcaatgacataaaactgagtgagtatgctggaaaggttcttcttattgttaatgttgcatcgcaatgtggattgactaattcaaattacaaagagctgaatgtcttgtatgacaagtaccgaacaaaaggccttgagatacttgcatttccatgcaaccaatttgctggtcaagagcctggcagtaatgaagatattcaggagacagtttgtactaggttcaaagcagagtttcctatttttgataagattaatgtgaatggtaaggataccgcgccattgttcaagtatttgaaatcacagaaaggaggcttccttggagatggaattaaatggaacttcaccaaatttcttgtcagtaaagatggcaaggttgttgggcgatatgctcctacaacttctcctttgaagatagagaatgacatcgagaagcttcttggcaccgtatcatgat

SEQ ID NO: 43295 - protein, 168 aa, Panicum virgatum
  misc_feature: Ceres CLONE 2016060
  misc_feature (9)..(117): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50171
  misc_feature: Useful for making plants with modulated nitrogen use efficiency
  misc_feature: Functional homolog of the protein sequence given in SEQ ID NO 50170
  misc_feature: Useful for making plants with modulated flowering time
MADDLPASIYDIAVKDIRGNDIKLSEYAGKVLLIVNVASQCGLTNSNYKELNVLYDKYRTKGLEILAFPCNQFAGQEPGSNEDIQETVCTRFKAEFPIFDKINVNGKDTAPLFKYLKSQKGGFLGDGIKWNFTKFLVSKDGKVVGRYAPTTSPLKIENDIEKLLGTVS

SEQ ID NO: 43296 - DNA, 1262 bp, Panicum virgatum
  misc_feature: Ceres CLONE 2016088
  misc_feature: Encodes the peptide sequence at SEQ ID NO. 43297
gaaagtgggcaattttggcgacgccccaattctatccattccccttcgcccccacccgcgccgccgtccgccgtcgttgcgcacccccctcgcggcagagcagatcccccaccgccgacgctcctccggccggatgagaagcgcgcccgcgcgctacggtcactaggcttcgtcgatggcgtcgccggggccgtcgtccgctccggccagccgatccgggcgccggcgggcgcccgccgccgactccgccggcgtgctgcccccggacctgctgttcgacgtcctgctgcggctgcccgccaaggagctctgccgcctccgcgccgtctgccgctcctggcgctccctcaccttcgacccgctcttcgtcggcgagcacgcggcgcgccacccgctcttcctggtcaatttccgggacgacagggcgcgcgtccatgtcgtggatctgtccggcaacgtggtgaaggtgatacctaacccggacggcgaccggctgctccccacgcgcctcgatctggcctgcgcagcgacggccggacacatctttcgcatttgggaggattggcgctaccggagagtacaaggtgctacggatgttcagctggcccagccatgcacagtggagggcgaggccgagccatgagaaattcgtcgacccaggcagcgccatcgtcgttggtgagcatctattcgtttggccttgagagagaggaatggaggggaattctgcgagggccaatacatgacatctttcaaaccgatgagtatgatgatgatttgggtgactacctttccctttggtatcggactactctagctgatctgagaggctcattaggtcttctgtactaccgcaagcaccagcacatcatggacctctggcttctgaaagacttcgacaatggtctctgggtgaaagcatacaggattcaaattgaaccaattttccctactaccaagagccatgtaaattcattgtttatgttagatgacggaaggatagtcatccatttcgcactaactggatggctgttcatctatgatccaagaaccaacacttctgcacaagtggagatgagacaacttgatgcgcttgcgatgtacactggaaatctgctgactttacaagttggtgacatggtgtagtgttgtaacttgctgctagttgctactctgtgtttccatctgctacatgaatccaaatgtacatggaaccttgtaaatgtaagagatttcatctgtagtttgatcattttaccgtt

SEQ ID NO: 43297 - protein, 155 aa, Panicum virgatum
  misc_feature: Ceres CLONE 2016088
  misc_feature (23)..(70): Pfam Name: F-box Pfam Description: F-box domain
MASPGPSSAPASRSGRRRAPAADSAGVLPPDLLFDVLLRLPAKELCRLRAVCRSWRSLTFDPLFVGEHAARHPLFLVNFRDDRARVHVVDLSGNVVKVIPNPDGDRLLPTRLDLACAATAGHIFRIWEDWRYRRVQGATDVQLAQPCTVEGEAEP

SEQ ID NO: 43298 - DNA, 563 bp, Panicum virgatum
  misc_feature: Ceres CLONE 2016089
  misc_feature: Encodes the peptide sequence at SEQ ID NO. 43299
aaacacatcgatctgtgcacgtcgaacacatcatgtcgactttgcggcgttctctgctaccgttgatcatcctcctgcagctgcacatcctctccggcgggccggcggcggcgaaggtcccggcgctgatcgtgttcggcgactcgacggtcgacacgggcaacaacaactacatctccacggtcatcaggagcgacttcgcgccctacggccgcgacctccgggtgggcggcggcggcggaaccagtggccagcccaccggccggttctccaacggccgcctcgccgtcgacttcatctccgaggctttcgggctgccgccgctcgtgccggcgtacctggacccgaacgccgacatgagcagccttgcgaccggcgcctgcttcgcctctgccggcgccggctacgacaacgccacgtctgatcttttcgcaagccgccgtgtgcatttccacgccagctccgacgccggccggtcacgatcgacaagcaatgcgaatgccatggtcatcgagagctttctctgtctcgcagtccgtcctgccgctgtgggaaggagcttg

SEQ ID NO: 43299 - protein, 176 aa, Panicum virgatum
  misc_feature: Ceres CLONE 2016089
  misc_feature: SWISSPROT Homolog: EC 3.2.1.51 Alpha-L-fucosidase
MSTLRRSLLPLIILLQLHILSGGPAAAKVPALIVFGDSTVDTGNNNYISTVIRSDFAPYGRDLRVGGGGGTSGQPTGRFSNGRLAVDFISEAFGLPPLVPAYLDPNADMSSLATGACFASAGAGYDNATSDLFASRRVHFHASSDAGRSRSTSNANAMVIESFLCLAVRPAAVGRS

SEQ ID NO: 43300 - DNA, 1150 bp, Panicum virgatum
  misc_feature: Ceres CLONE 2016091
  misc_feature: Encodes the peptide sequence at SEQ ID NO. 43301
attatcccgaaaaagcacgcgatttccgccttcccttcttcaagaacgccatggaaatctcgcgtgctcgccgcgacttcttctcctcctccttcttcccgcagcagcttcgcacgctctaaccaaacccaaggtacgcgacgcgcgacaccgggacctgttcgctttctcctattgctctggtcgtgcgacctgtgcacatccatggccatggccgcgccatggtcgtcgtcctgctgccccgcgaccgcgtcgacgagcgccccgaggccgctgggtccggggagcctcaagggcgcggcttggccggttggtggtgccggctggaggaactgcagggagcaggggaggaacagccggcggcggctgtccgtctgcgccacggcggccgcgccgccgccgcccgttgactacgcggacaccagcgccggcgccggcgccgacgccgactacgtggcgtcgctcaaggtcaagctgctgggcgcggtgtccgggctgaaccgcggcctggcggcgggccaggaggacctggaccgcgcggacgcggcggcgcgggagctcgaggcggcgggcggcgggcccgtggacctaggccgggacctcgaccggctgcagggccggtggcgcctcgtgtacagcagcgccttctcgtcgcggacgctcggcggcagccgccccggcccgcccaccggccgcctcctccccatcacgctcggccaggtgttccagcgcatcgacgtggtcagccgggacctggacaacatcgtcgagctcgagctcggcgcgccgtggccgctgccgcccgtcgaggccacggccacgctggcgcacaagttcgaggtcgtcgggacgtcggggatcaagatcaatttcgagaagacgacggtgaagacgaaggggagcctgtcgcagctgccgccgctggaggtgccgcggatccccgacaacctgcggccgccgtccaacaccgggagcggcgagttcgaggtgacgtacctcgacggcgacacgcgcgtcacccgcggggacaggggcgagctccgggtgttcgtcatcgcgtgaccaagaaagagctgccagtgaatgccaatcttgtattgtagcaatccgtttgtccatcatacggtaatctggtagtagaatttcgacc

SEQ ID NO: 43301 - protein, 283 aa, Panicum virgatum
  misc_feature: Ceres CLONE 2016091
  misc_feature (83)..(281): Pfam Name: PAP_fibrillin Pfam Description: PAP_fibrillin
MAAPWSSSCCPATASTSAPRPLGPGSLKGAAWPVGGAGWRNCREQGRNSRRRLSVCATAAAPPPPVDYADTSAGAGADADYVASLKVKLLGAVSGLNRGLAAGQEDLDRADAAARELEAAGGGPVDLGRDLDRLQGRWRLVYSSAFSSRTLGGSRPGPPTGRLLPITLGQVFQRIDVVSRDLDNIVELELGAPWPLPPVEATATLAHKFEVVGTSGIKINFEKTTVKTKGSLSQLPPLEVPRIPDNLRPPSNTGSGEFEVTYLDGDTRVTRGDRGELRVFVIA

SEQ ID NO: 43302 - DNA, 1291 bp, Panicum virgatum
  misc_feature: Ceres CLONE 2016097
  misc_feature: Encodes the peptide sequence at SEQ ID NO. 43303
agatttgtcagaacgcgagctcctctcctaccctctctctccctcgcgctccgaaaccctagccgcacgcaagctctcccctcccctcgcctcgcctcgccgcacccgccgcgcgggacgagccgggcgccatggccgcggagaattactggaggtacgccgacgcgcggcagcagcagcaggcgatggtggccgccgcggctgggatggcacccgcggcgacggtcaccgcgtcccagacggtcgggggaccggcggcgggaatgaacccgcaggcggccgccgccgccatggcgcagcaggccgccgcgccgcctctcaagcgcgcgcgccccgacttcggagatgtgtctggaggacaagacatgacaggatattatccacgtgaaactgacagggcaggttaccattcacttagagagaatgaagcgatcggagcttcttatgatcgttacttgcgcaatgggatgccctctgtcggtgccaatgacactagtagggctgctgggatgaatgctgggatcgctgctgggatgggtgctgggatggctgctggaatgggtgctgggatggctggctatggtgttgatgaccgccgtatgatgggtgttgtcggtatggacaacagagggatgggctatggtggcaggcctgagcctcctcttcctccggatgcatcaaacactttgtatattgagggcttacctgcaaactgcacacgccgggaggtttctcatatatttcgcccatttgtaggctttcgcgaagtgcgacttgttaacaaagagtccagacatcctggtggagacccacatgtgttgtgttttgttgattttgacaaccctgctcaagctacaattgctcttgaagcattgcaaggttataagtttgacgaacacgatcgtgactcagcccatttgcggctgcaattctcacgctttcctggtccgaggtcagctggcggacctcgcggtaggcgttaagacgtgcggacctcgtggttgccgaacctatcgtttgtacgaacgatcaatctgccgcagcgtaacacttcgatatgcgctgaaatcctcggtggctagggtttggcatctcatttcgtgaatgcgtgaaaggtgtcatgcaataagtgatattcgttctcttgtcattagactgccatagcgtgtgttaggggtggaactttaagttatttgacatactgtatctgttgccttagttattatgatttactgtaactttgttaccttgctaccagagacaagagttgttatcctttgaatctgtcctt

SEQ ID NO: 43303 - protein, 283 aa, Panicum virgatum
  misc_feature: Ceres CLONE 2016097
  misc_feature (186)..(260): Pfam Name: RRM_1 Pfam Description: RNA recognition motif. (a.k.a. RRM, RBD, or RNP domain)
MAAENYWRYADARQQQQAMVAAAAGMAPAATVTASQTVGGPAAGMNPQAAAAAMAQQAAAPPLKRARPDFGDVSGGQDMTGYYPRETDRAGYHSLRENEAIGASYDRYLRNGMPSVGANDTSRAAGMNAGIAAGMGAGMAAGMGAGMAGYGVDDRRMMGVVGMDNRGMGYGGRPEPPLPPDASNTLYIEGLPANCTRREVSHIFRPFVGFREVRLVNKESRHPGGDPHVLCFVDFDNPAQATIALEALQGYKFDEHDRDSAHLRLQFSRFPGPRSAGGPRGRR

SEQ ID NO: 43304 - DNA, 1121 bp, Panicum virgatum
  misc_feature: Ceres CLONE 2016112
  misc_feature: Encodes the peptide sequence at SEQ ID NO. 43305
tctcctccctcctctcccctacccggctaccactcccccctccccccacccaccccccactcccttcttctccactcggccgccgggcactccgccgcgcaccagatagatgtccacaatgctgccctccagatcaagatctgggccgaacgagtcccccatcagcagcaggggcaggccgagcacgccgtcctccgcccaccgcccgtccacgccgtcctcagcccaccgcccgtccacgccgtcctccagccaccgcccgtccacgcccggcggcaccaggaggagcagcgtcggcacgccgtccacgccgcgctcccgcgccaacggcgccgggccgttcaagtccgagcccaactcgccgccgtcggcgaccgcgcagagcgcgcgcccgcgcctctcgttcgaccgctcgccgagatccgcggactccaagcccgtcgtcgagcgccgggtgcccaagatcggcacgcctcctgataagcagccgcggagggaggccgaactgcaggcgcggcttgagtccgcccaggaggacctgaagaaggccaaggatcagctggccttcatcgtcggggagagggaccgtcttgttggggagctcaatgaggccaagcgagtcgctgatgagacccacgagaagctccaggatgccctcatggccaagaggtgggccgaggaggccaccgagatcgagaagttccgggcggatgagctcgagcaggcaggcatcgacgaggcgcagaggcgggaggaggagtggcagagggagattgagtgcgtgcgtggccagcatgccgccgacctggagtctttggtcaacacgacagaggaactagagaggctcaggcatgatctttcgatggcgaacgaggctaagaaggctgcacttggccacgcagatgatgccatgaagatcgctgaggtcaatgcggagaaggtggaggtcctctcaaacgaagttgttcgattgaaagggttgcttgattcaactgctgcaagcgaggagagtaaagcccgtgaaactgaggttcttgttaagaatctggagtcggaggtttcatctctaaaagtcaagcttgaggaggcaaaattccttgaggacagactggcccaggcag

SEQ ID NO: 43305 - protein, 337 aa, Panicum virgatum
  misc_feature: Ceres CLONE 2016112
  misc_feature: SWISSPROT Homolog: EC 2.7.11.1 Non-specific serine/threonine protein kinase
MSTMLPSRSRSGPNESPISSRGRPSTPSSAHRPSTPSSAHRPSTPSSSHRPSTPGGTRRSSVGTPSTPRSRANGAGPFKSEPNSPPSATAQSARPRLSFDRSPRSADSKPVVERRVPKIGTPPDKQPRREAELQARLESAQEDLKKAKDQLAFIVGERDRLVGELNEAKRVADETHEKLQDALMAKRWAEEATEIEKFRADELEQAGIDEAQRREEEWQREIECVRGQHAADLESLVNTTEELERLRHDLSMANEAKKAALGHADDAMKIAEVNAEKVEVLSNEVVRLKGLLDSTAASEESKARETEVLVKNLESEVSSLKVKLEEAKFLEDRLAQA

SEQ ID NO: 43306 - DNA, 720 bp, Panicum virgatum
  misc_feature: Ceres CLONE 2016113
  misc_feature: Encodes the peptide sequence at SEQ ID NO. 43307
ttagcaggcaacaaggttgtagccacatgtggaggtgaaagtaaatctacgtttctgtcttccttaggagttgatcgagttgtcaactacagaaatgaaaatctcaaagatgttctgaagaaagagttcccaagaggtgtggatatcatatacgaatctgtaggtggagaaacatttgatatctgtttgaatgccctagcagtctatgggcgtctcattgtaattggtatgatctctcagtatcaaggagaggaaggatggaagccacaaaattacactggattatgtgagaagattcttgggaaaagtcagactgtggctggatttttcctgattcaatatgcacacctgtggcaaggccatcttgaaaaactttttaacctgtatgcctctggaaagctaaaggttttccttgaccccaagaaattcctgggtgttgcttccgtggcagatgcagtagaatatctccattctggcaggagcgttggcaaggtcgtcgtttgcatggatccatcctacagccagacccttgctaagctatagtgcgcagacatatgagctgcactgtcaacagaaagatattcttcttcggattcctcgtctgtcagactgaaagatggccgcagagttccgccgtatgttcagacttggcagcatatagctggcttgtccgattagttggcgggcacgtgagtcggaggggcgaaattggacaggaaa

SEQ ID NO: 43307 - protein, 180 aa, Panicum virgatum
  misc_feature: Ceres CLONE 2016113
  misc_feature (2)..(127): Pfam Name: ADH_zinc_N Pfam Description: Zinc-binding dehydrogenase
  misc_feature: SWISSPROT Homolog: EC 1.6.5.5 NADPH:quinone reductase
LAGNKVVATCGGESKSTFLSSLGVDRVVNYRNENLKDVLKKEFPRGVDIIYESVGGETFDICLNALAVYGRLIVIGMISQYQGEEGWKPQNYTGLCEKILGKSQTVAGFFLIQYAHLWQGHLEKLFNLYASGKLKVFLDPKKFLGVASVADAVEYLHSGRSVGKVVVCMDPSYSQTLAKL

SEQ ID NO: 43308 - DNA, 650 bp, Panicum virgatum
  misc_feature: Ceres CLONE 2016126
  misc_feature: Encodes the peptide sequence at SEQ ID NO. 43309
gaaaaacctcccactacttcaatcccccccccccccccccccggcgctcgtcactgttactcgtacgtgctcgcgcacgccggtttcgacagctgcgtgcgtgtcactcacacacgagaggggagggggattcatcagccactcatgctcatggagttgctctgctgagcctgagctcgttgtttccttctgcctgggcgtttcttctccctctggttcctcggccggaggctgaagcggtgagcgaagatgaactacctcaggagccggagcctgaagcggctcctgtccctcggccgccggagcaacgcggacgagtccgccgaggagtgcgtcgacgccgaaccgccgccgccgccgtacaagcccacgtggaggtgcttctcctacgacgagctccaccaagccaccgatggcttccaccaagacaacatggtggggaaaggcgggtacggcgaggtgtaccgcggcgtcctggacgacgggagcgccgttgccgtgaagcgcctggcgccgacggccgcggcggacgagaagaaggagaaggacttcctcacggagctgggcacggtgggccacgtccgccaccccaacgtgtgcgcgctcctcggctgctgcgtcgaccgcggcctctacctcgtcttcgagtt

SEQ ID NO: 43309 - protein, 133 aa, Panicum virgatum
  misc_feature: Ceres CLONE 2016126
  misc_feature: SWISSPROT Homolog: EC 2.7.11.1 Non-specific serine/threonine protein kinase
MNYLRSRSLKRLLSLGRRSNADESAEECVDAEPPPPPYKPTWRCFSYDELHQATDGFHQDNMVGKGGYGEVYRGVLDDGSAVAVKRLAPTAAADEKKEKDFLTELGTVGHVRHPNVCALLGCCVDRGLYLVFE

SEQ ID NO: 43310 - DNA, 1195 bp, Panicum virgatum
  misc_feature: Ceres CLONE 2016136
  misc_feature: Encodes the peptide sequence at SEQ ID NO. 43311
tgatctcatcttcccacagctcaaaccaaacagaaaccctcactgccatctccttgtcgacactcttcaatcagctacctcaacactgatgacgaccacggaaatggtcaagtccctgatcttcttgtgcacagcgctcgcggcgtgcctcgcgctcgccgccgccgactggtgtcagggcaccgccacgttctacggcggacccgacggttccgacaccatgggcggtgcgtgtgggtacggcaacttgtacaacgccgggtacggcatcaataacgcggcgctgagcgagacgctgttcaacaacggcgcgtcatgcgggcagtgctacctcatcatctgcgacgggtcacgaccaggcggccagtactgcaagcccggcacggcgatcacgatctcggccaccaacctgtgcccggccaacgacgcgctgcccaacggcggctggtgcggcccggggcgcccccacttcgacatgtcacagccggcgtgggagaacatcggcatctaccaggccggcatcatcccggtcctgtaccagcaggtgaagtgctggcgcaacggtggcgtgcgcttcagcatcgccgggttcaactacttccttctcgtcaacatccagaacctcgccggcagcggctccgtgggcgcagccttgatcaagggcgacaacaccgggtggatccagatgaccaggaactggggagccaactggcaggcgctctccggactagtcggacaggggctcagcttcgccgtggccagcacgggcgggcagtacattgagttcctcaacgtcgtgccagcgtggtggcagttcggcatgaccttcaacacgtaccagaatttcgactactgaaacttattacaggtagcagagtgatcgaccgcccttatagccatctcttgatggcagggttgcatgaacaagggatgcaacccagacctcaaggcccctttaatttattttccctccagaagatacaaaacattatgttttctttctttctttttgcgagaatcattcttttcaacattgtattatcaaattataagttctgccgattgtgctatgtgtagaattccaaattttagtggtcaatacacatactatattggtgtatctggaaataggttcggacccatgaaaaaaaaatacggtgcgctaagtttatctgacaccaatattatcacacct

SEQ ID NO: 43311 - protein, 250 aa, Panicum virgatum
  misc_feature: Ceres CLONE 2016136
  misc_feature (58)..(145): Pfam Name: DPBB_1 Pfam Description: Rare lipoprotein A (RlpA)-like double-psi beta-barrel
  misc_feature (156)..(233): Pfam Name: Pollen_allerg_1 Pfam Description: Pollen allergen
  misc_feature: SWISSPROT Homolog: EC 3.2.1.4 Cellulase
  misc_feature: Functional homolog of the protein sequence given in SEQ ID NO 51623
  misc_feature: Useful for making plants with altered carbohydrate content
  misc_feature: Functional homolog of the protein sequence given in SEQ ID NO 50487
  misc_feature: Useful for making plants with altered cell wall content and/or composition
  misc_feature: Functional homolog of the protein sequence given in SEQ ID NO 50489
  misc_feature: Useful for making plants with altered lignin content
MVKSLIFLCTALAACLALAAADWCQGTATFYGGPDGSDTMGGACGYGNLYNAGYGINNAALSETLFNNGASCGQCYLIICDGSRPGGQYCKPGTAITISATNLCPANDALPNGGWCGPGRPHFDMSQPAWENIGIYQAGIIPVLYQQVKCWRNGGVRFSIAGFNYFLLVNIQNLAGSGSVGAALIKGDNTGWIQMTRNWGANWQALSGLVGQGLSFAVASTGGQYIEFLNVVPAWWQFGMTFNTYQNFDY

SEQ ID NO: 43312 - DNA, 629 bp, Panicum virgatum
  misc_feature: Ceres CLONE 2016143
  misc_feature: Encodes the peptide sequence at SEQ ID NO. 43313
gagtgcctggtgacagagatagcggcggccatggcggtgcagagggtggtggcgctgtacttgcaggtggcggcggcggcggtgctgctggcggcggcggggctccgcgcgcagctgcgggtgggcttctacgacagctcgtgcccggcggcggagatcatcgcgcagcaggaggtgagcaaggcggtgggcgccaacccgggcctcgccgccggcctgctccgcctccacttccacgactgcttcgtcagggggtgcgacgcatccgtgctgatcgacacgaccagcggcaacacggcggagaaggacgccgcgcccaacaccagcctccggggattcgaggtcgtcgaccgcatcaaggcgcgcgtcgagcaggcctgcgccggcgtcgtctcctgcgcggacattctcgccttcgccgccagggacagcgtcgcgctggccggcgggaacgcgtaccaggtgccggcggggcggcgtgacggcgccgtgtcgcgcgcgtcggacacgaacggcaacctgccgccgccgtcggccaacgtggcgcagctgacgcagatgttcggcgccaagggcctgacgcagcgggacatggtcgccctctcccgcgcgcacaccatcgggtcctc

SEQ ID NO: 43313 - protein, 199 aa, Panicum virgatum
  misc_feature: Ceres CLONE 2016143
  misc_feature (45)..(199): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50376
  misc_feature: Useful for making plants with altered carbohydrate content
  misc_feature: Functional homolog of the protein sequence given in SEQ ID NO 50377
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
MAVQRVVALYLQVAAAAVLLAAAGLRAQLRVGFYDSSCPAAEIIAQQEVSKAVGANPGLAAGLLRLHFHDCFVRGCDASVLIDTTSGNTAEKDAAPNTSLRGFEVVDRIKARVEQACAGVVSCADILAFAARDSVALAGGNAYQVPAGRRDGAVSRASDTNGNLPPPSANVAQLTQMFGAKGLTQRDMVALSRAHTIGS

SEQ ID NO: 43314 - DNA, 683 bp, Panicum virgatum
  misc_feature: Ceres CLONE 2016149
  misc_feature: Encodes the peptide sequence at SEQ ID NO. 43315
accggcacacttcaattccacacaaaacttttcctcctcatcatcatcttcgtcttcctctcctcctcatcctctctctagctgctgtggtcatactttctctctcttctattctctttctctgccaagaacaccggccggctagcagctcgtgctcccatggagatcgacgccgacaacctcagcgccaccgagctccgcctcggcctgccgggaaccagcagcggcgacgccgaccgcccgaagaggccggcgccctccgtcggcgccaagcgcgcgctcgacgacaccaggagcgaggcctcgggcaccagcccggccgccgggggcgaccacgacgccgccacgcctgccaaagcgcaagtggtggggtggccgccggtgagggcgtacaggaagaacaccttccaggcggcggcggcggcgaagaaggccgagcagccgggagggctgtacgtgaaggtgagcatggacggggcgccgtacctcaggaaggtggacctccggatgtataaggggtaccgggagctcagggaggcgctggacgccctcttcaccaagtccttctccgcctccgccggagcggagggcggcgacggccagcacgccctcgcctacgaggacaaggacggcgacctcatgctcgtcggagatgtgccctgggacatgttcatctcttcgtg

SEQ ID NO: 43315 - protein, 174 aa, Panicum virgatum
  misc_feature: Ceres CLONE 2016149
  misc_feature (7)..(174): Pfam Name: AUX_IAA Pfam Description: AUX/IAA family
  misc_feature: The sequence is a functional homolog of SEQ ID NO 636 in the 11/479,226 US patent application
MEIDADNLSATELRLGLPGTSSGDADRPKRPAPSVGAKRALDDTRSEASGTSPAAGGDHDAATPAKAQVVGWPPVRAYRKNTFQAAAAAKKAEQPGGLYVKVSMDGAPYLRKVDLRMYKGYRELREALDALFTKSFSASAGAEGGDGQHALAYEDKDGDLMLVGDVPWDMFISS

SEQ ID NO: 43316 - DNA, 1297 bp, Panicum virgatum
  misc_feature: Ceres CLONE 2016156
  misc_feature: Encodes the peptide sequence at SEQ ID NO. 43317
gaaatatcaaatccatccatcctcacgttctcccaccccgctccacgcctccaccccactccccatcccccgaacctcgcgagcggcggcggcgagcaacatcggcattatggacggcgcctacttcgtcgggcgcaacgagatcctcgcgtggatcaacaccacgctgcagctcggcctctccaaggtggaggaggcggcgtcgggcgcggttgcgtgccagctgatggacgcggcgcacccgggggcggtgccgatgcacaaggtcaacttcgacgccaagacagagtacgacatgatccagaactacaaggtcctgcaggacgtgttcaacaaactcaagatcaccaagcacatagaggtgaacaaactcatcaaaggaagacctcttgacaatttggagtttatgcagtggatgaaaagatactgtgattctgttagtggtggtttcatgaccagctacaatgcttctgagagaagggaaagcagcaaaggtggaaaagaaaccaacagaagaacatcggtgccctctcaaactccggccaagtctacatctacaagacacaagactcaaccttcatcacatggcgctaagcgggggagtggacaagcagcgaatgcgccacaacgcagtgctaaaccgtcaccagccaactctggcggaccagcttatgatgaacagatcaccgagctgaagctcctggtggatagcctcgagaaggagagagatttctacttctccaagttgcgggacattgagatcctgtgccagagccctgaagttgagcacgtgccggtcgtccatgctatccagaacatactctacacatcagaggacgaccccgcgacagtggccgaagctcaggcgatggtttcacagcagcagcaacagccggcgctgagccccatcctggaggcgtccgatgagaggccgaaaccagaggcagcgaacaagcggaagagcatctcggacctggaggagtttgggatggcatccagctcacggcagaggctctccgacatctcggacgttggatccccgctgatgagtttcagcggtctcgtcattgctgcaaaatcggtctcgtcattgctgttatgacctgatcttttgtatggcagtgaaactatctcggttggattggtttgtggatccgtctgttgtaaggtcggtggtgttttgtcgtgtgccctcgttatccgccacagaatttgtggccgtttgctacaaaccattcatattatgatcgttgcttctatgacttgtcggattgaactattttgcatcctttgctcc

SEQ ID NO: 43317 - protein, 330 aa, Panicum virgatum
  misc_feature: Ceres CLONE 2016156
  misc_feature (201)..(248): Pfam Name: EB1 Pfam Description: EB1-like C-terminal motif
  misc_feature (7)..(108): Pfam Name: CH Pfam Description: Calponin homology (CH) domain
MDGAYFVGRNEILAWINTTLQLGLSKVEEAASGAVACQLMDAAHPGAVPMHKVNFDAKTEYDMIQNYKVLQDVFNKLKITKHIEVNKLIKGRPLDNLEFMQWMKRYCDSVSGGFMTSYNASERRESSKGGKETNRRTSVPSQTPAKSTSTRHKTQPSSHGAKRGSGQAANAPQRSAKPSPANSGGPAYDEQITELKLLVDSLEKERDFYFSKLRDIEILCQSPEVEHVPVVHAIQNILYTSEDDPATVAEAQAMVSQQQQQPALSPILEASDERPKPEAANKRKSISDLEEFGMASSSRQRLSDISDVGSPLMSFSGLVIAAKSVSSLLL

SEQ ID NO: 43318 - DNA, 1095 bp, Panicum virgatum
  misc_feature: Ceres CLONE 2016176
  misc_feature: Encodes the peptide sequence at SEQ ID NO. 43319
gacaaacggagctcgcctgtcgccacaccacggcccccgctcggccgctcgccaccgcgatgctgctcctagcgcgagcctcgccgccgtccttggcggccaactattcggcgagcccggagcgcggcctccgccttcggagcatgccctcgtcccgcgccgtcgtcgctacggtctcctctgcggcgaagccggcggccgcggcttcctcgcgggccgggcaaaagcgcaagcaggtggcgagcgtggcgaacccgctcgtgaagcactgcgtcaagctccggctctccgccgcgtaccgccgctcctgccgccgcctcctcctcgtcggcctcgcgcccatcctggagatgtgtaggtttgagctcgacgccatcgattacctgcttctcctggacggcgtggaggtcccggaggcgctgcgcgagttctctggcgatgtcgtgtttgtcagcgccgcggtgatgaagaaggtgtccggcatgcagtcggttgattccaccgaggcgattgctgtcatgcacatgcctaggcacttccgcgacctcgggagccatgaggatggggattctcttcatgggctgttcaatcacccaaagaggattctggtccttgatgggatacaggatcctggtaaccttggaacgctgataagatcagcttgtgctttcaaatgggacggggtatttcttctcccagcttgttgtgatcctttcaatgaaaaggctctccgtgcagcccgtggagcctctttgcagcttcctattgtctctggtacctggcatgacctgcatgcattaatgactaaatatgatatgaagatgatggcaggccatccagaaagtagcagtgatgcatccaagggaatccactcgctgtccaaagaactagctgattcactcttgaatgagtctctgtgcttagtgttagaaagtgaggggaatggcctttcttcagaaaccctccaagcctgcgagcttgtaaacattccgatggaagctacttttgaatctctgaatgtttcggttgcaggtggtatatttttgttcatgttacaacctaaatatcaaatagatagcacaactttaacccctt

SEQ ID NO: 43319 - protein, 345 aa, Panicum virgatum
  misc_feature: Ceres CLONE 2016176
  misc_feature (180)..(330): Pfam Name: SpoU_methylase Pfam Description: SpoU rRNA Methylase family
  misc_feature: SWISSPROT Homolog: EC 2.1.1.66 rRNA (adenosine-2'-O-)-methyltransferase
MLLLARASPPSLAANYSASPERGLRLRSMPSSRAVVATVSSAAKPAAAASSRAGQKRKQVASVANPLVKHCVKLRLSAAYRRSCRRLLLVGLAPILEMCRFELDAIDYLLLLDGVEVPEALREFSGDVVFVSAAVMKKVSGMQSVDSTEAIAVMHMPRHFRDLGSHEDGDSLHGLFNHPKRILVLDGIQDPGNLGTLIRSACAFKWDGVFLLPACCDPFNEKALRAARGASLQLPIVSGTWHDLHALMTKYDMKMMAGHPESSSDASKGIHSLSKELADSLLNESLCLVLESEGNGLSSETLQACELVNIPMEATFESLNVSVAGGIFLFMLQPKYQIDSTTLTP

SEQ ID NO: 43320 - DNA, 531 bp, Panicum virgatum
  misc_feature: Ceres CLONE 2016178
  misc_feature: Encodes the peptide sequence at SEQ ID NO. 43321
ccgcctcccccattcctcttcccctgcgatccggggccgcacccgcagggaggagaagcgatcacctgatcaccagggcgacgcctcgcgatctcgcgcaggagcggagatggggctcacgttcacgaaactgttcagccgcctctttgccaagaaggagatgaggatcctcatggttggtctcgacgcggctggtaagaccaccatcctctacaagctcaagctcggcgagatcgtcaccaccatccccaccataggatttaacgttgaaactgttgagtacaagaacattagcttcactgtttgggatgtcggtggtcaggacaagatcagacccctgtggaggcactacttccagaacacccagggcctcatttttgttgtggacagcaacgacagagagcgtgttgttgaggccagagatgagctccatcggatgctgaacgaggacgagctccgtgatgctgtgcttctggtattttgcaacaaacaggatcttcctaatgccctgaatgctgctgaaatccccga

SEQ ID NO: 43321 - protein, 140 aa, Panicum virgatum
  misc_feature: Ceres CLONE 2016178
  misc_feature (5)..(140): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFCNKQDLPNALNAAEIP

SEQ ID NO: 43322 - DNA, 653 bp, Panicum virgatum
  misc_feature: Ceres CLONE 2016193
  misc_feature: Encodes the peptide sequence at SEQ ID NO. 43323
aagaacacgagcgggggcctcagaagtcagatcgcatcgtaagcttctgcgagttcccgtcgggagccgcctgggatggcgattcgcggggggtcttcgtttgccctcgcggcactgctcgcgctcgcctctgtcgccgccgtcgctggcgaggtcttcttccaggagaagttcgaagatggctgggaaagtcggtgggtcaagtccgactggaagaaggatgagaacatggctggtgaatggaaccacacctctgggaaatggaatggagatgctgaggacaaaggtatccagacctctgaggactacaggttctatgccatttcggcggagtaccctgagttcagcaacaaggataagaccctggtgctgcagttctcagtgaagcacgagcagaagctggactgtggtggtggttatgtaaagttgcttggcggtgatgtggaccagaagaaattcggtggcgacacaccttacagcattatgtttggaccagatatctgtggatacagcaccaagaaggttcatgctatcctgacaaaggatggcaagaaccacctgatcaagaaggatgtgccttgcgagactgaccagttgacacatgtgtacactatgatgacattcccaaggaaattccggaccctgatgctaag

SEQ ID NO: 43323 - protein, 192 aa, Panicum virgatum
  misc_feature: Ceres CLONE 2016193
  misc_feature (27)..(191): Pfam Name: Calreticulin Pfam Description: Calreticulin family
MAIRGGSSFALAALLALASVAAVAGEVFFQEKFEDGWESRWVKSDWKKDENMAGEWNHTSGKWNGDAEDKGIQTSEDYRFYAISAEYPEFSNKDKTLVLQFSVKHEQKLDCGGGYVKLLGGDVDQKKFGGDTPYSIMFGPDICGYSTKKVHAILTKDGKNHLIKKDVPCETDQLTHVYTMMTFPRKFRTLML

SEQ ID NO: 43324 - DNA, 1350 bp, Panicum virgatum
  misc_feature: Ceres CLONE 2016211
  misc_feature: Encodes the peptide sequence at SEQ ID NO. 43325
aagcgaaaacagtccgtccaaggcccaacgcgagcgagtacccagctcccctctccccagtccccactccgccgtccgctcccaccgcgcaacccgtcggggcgccgccgccggcgatgaccaccccgcggtccgtctcaacctccctcgcccgtttatcctacacgccgacctccccagttcccaaatccttggggagggattgcggtcgggtccccactttccccgctaggccgcgcggtttcgcgctccgtctctggtcgtcgcctgttatggccgccgccggcgtcggcggcaacggctcccctgccgctcccggagactccacagggtcttctaggattggagaggttaagagagtgaccaaggagacaaatgtgtatgtgaagataaaccttgatggcaccggtgttgccgactgtagcacagggataccgttcttggatcatatgcttgatcaactggcatcacatgggctctttgatgtgtacgttaaggcaacaggtgacacacacattgatgatcatcactcaaacgaggacattgcactggcaattggaacggcactgcttcaatcacttggtgatcgaaaagggattaaccgatttgggcattttactgcaccactcgatgaggcagcagttgaggttatactggatctgtctggtcgtcctcatttaagttgcggcttagatattcctactcagagagttggtacatatgatacacagctggttgagcactttttccagtctttggtgaatacatctgggatgactcttcacatccgtcagcttgctgggaaaaactcacaccatattatcgaggcatgtttcaaagcatttgctagggcccttcgacaagcaacagaatatgacttgcgccgtcatggcactgtccccagctccaaaggtgttttgtcaagatcatagcattacaggttcaaacggttgcttgtccgcttttagctcggtgcgatcataggaaacagagcgggcagctgtatacagcttggtttgttctgctttacatcgggagtctgcatacaagttatggcatcattgctaatgagattgtcaaaaatcaaatgtaccaccaatcagtattgggcttatttataacagcgctataatgtatctgctcgctactgcaattttctctgctctctggagctacgagattatctgaagattggaaaggagtggacaataagctgcgactctgaaagcaactccagtcaggattcaggaataatgctgtgccttgtataaactttgcaacatgggctgagttagccgcatttgtaatgattgtccgcgttcaagggaataaaattggtttctgtgcgtc

SEQ ID NO: 43325 - protein, 271 aa, Panicum virgatum
  misc_feature: Ceres CLONE 2016211
  misc_feature (104)..(248): Pfam Name: IGPD Pfam Description: Imidazoleglycerol-phosphate dehydratase
  misc_feature: SWISSPROT Homolog: EC 4.2.1.19 Imidazoleglycerol-phosphate dehydratase
MTTPRSVSTSLARLSYTPTSPVPKSLGRDCGRVPTFPARPRGFALRLWSSPVMAAAGVGGNGSPAAPGDSTGSSRIGEVKRVTKETNVYVKINLDGTGVADCSTGIPFLDHMLDQLASHGLFDVYVKATGDTHIDDHHSNEDIALAIGTALLQSLGDRKGINRFGHFTAPLDEAAVEVILDLSGRPHLSCGLDIPTQRVGTYDTQLVEHFFQSLVNTSGMTLHIRQLAGKNSHHIIEACFKAFARALRQATEYDLRRHGTVPSSKGVLSRS

SEQ ID NO: 43326 - DNA, 1290 bp, Panicum virgatum
  misc_feature: Ceres CLONE 2016214
  misc_feature: Encodes the peptide sequence at SEQ ID NO. 43327
gcctgcctgtgcgcaacccgcaaccgcgcatgctccgtggccacgcgctgcggccgccgtgcgcgcccgcgcccgcgcaccggcaactgctctataaaccccaccagtgtccaccacgcatctcggccctgcggttgcgcatgcatcctgcatttctgctgccgctgctccactacttccccttcctcgtcgccccatcgccgtagtcctccgatccttccgtcgccctagctagctaggcacctcggtcgtcgttggtccggcggcttggctggtggtttctgcggcggcggatcgaccggccgggcggcatgggccaggacagggaggagggggcggcgggggaaatggcggcgtcgtggcggctcaacgtcaacgacttccagcagatgccggagcggcccaaggagccgcccttcgtcaccagggtcttcctccgcagcagccacgggaagcagaggaagattgcaaagtactacaagaagcaagagaatctactgaaggatttcagcgagatggagaccatgaatgaacttggtggtttagatcagaatggtccttccgaggaagagctaaggcaactggcaaagagcgaaagatttgctattaacctgtcgaatataatcaatctcatcctttttgttacgaaagtcgttgcttctgccgaaagtttatccatggcagtaatagcatcgacgctggactctctactggaccttctgtcaggtttcattctttggtttacagcgcatgctatgaaaaagccaaacaagtacaactacccaattgggaagaggcgcatgcagccagtgggcataatagtcttcgcatcagtgatgggcacacttggcttccaagtgctgatcgaatcagggcgccagctcatcacgcaggagcatgcgaatttcaagcgcaagcaggagctctggatggtgggcagcatgtcctcggttgcggtcgtgaagttcttcctcatgctctactgtcggaccttcaagaacgagatcgtgagggcttacgcccaggaccacttcttcgacgtgatcaccaactcggtcggcctggtcgcggcgttgctcgccgtccggtacaaatggtggatggatcccgttggtgccatattgatcgcgctgtacacgatcacgacgtgggcgcggacggtgcttgagaacgtgggcacgctgatcggcaagtcggcgccggcggagtacctgacgaagctgacgtacctcatctggaaccaccacgaggagattcggcacatcgacacggtgcgtgcctacccctttc

SEQ ID NO: 43327 - protein, 326 aa, Panicum virgatum
  misc_feature: Ceres CLONE 2016214
  misc_feature (99)..(326): Pfam Name: Cation_efflux Pfam Description: Cation efflux family
MGQDREEGAAGEMAASWRLNVNDFQQMPERPKEPPFVTRVFLRSSHGKQRKIAKYYKKQENLLKDFSEMETMNELGGLDQNGPSEEELRQLAKSERFAINLSNIINLILFVTKVVASAESLSMAVIASTLDSLLDLLSGFILWFTAHAMKKPNKYNYPIGKRRMQPVGIIVFASVMGTLGFQVLIESGRQLITQEHANFKRKQELWMVGSMSSVAVVKFFLMLYCRTFKNEIVRAYAQDHFFDVITNSVGLVAALLAVRYKWWMDPVGAILIALYTITTWARTVLENVGTLIGKSAPAEYLTKLTYLIWNHHEEIRHIDTVRAYPF

SEQ ID NO: 43328 - DNA, 628 bp, Panicum virgatum
  misc_feature: Ceres CLONE 2016216
  misc_feature: Encodes the peptide sequence at SEQ ID NO. 43329
gacgcacacgcgcgctctcccgcggcgacagagcagcacgacgcgcgaggccgccaccgccatggacatgggcggagggcacgacatgggcggcatgatggccccgccgccgtccccgccgggcggcggcggcatggggatgcggtacacccacatgaccttcttctggggcaagaactcggagatcctcttcacggggtggcccggcgccgacggcggcatgtacgcgctggcgctcgtggccgtcttcgtgctcgcgttcgtcctcgagttcctgggctcccgcaggctggacgagctcctccgcccgcgcgcggcgcgcgcggcggtgcacgcgctgcgcgtgggcgcggcgtacctgctcatgctcgcgatcatgtcgttcaacggcggcgtgctcctcgtcgccgtcgcggggcacgcggcggggttcctggcgttcaaggccggcctgttcggccacgggcgggctcaggtggaggacgggcgcggcaaggaggagctcgagccggcggcgtgctgacgacaggcggcgtgctgcgacgatggcgccaatgatgatcgatgcgtttgcttgtctggcgttgttttgtgcgttttccattcctttgtgccgtgtcgcctgccc

SEQ ID NO: 43329 - protein, 153 aa, Panicum virgatum
  misc_feature: Ceres CLONE 2016216
  misc_feature (30)..(138): Pfam Name: Ctr Pfam Description: Ctr copper transporter family
MDMGGGHDMGGMMAPPPSPPGGGGMGMRYTHMTFFWGKNSEILFTGWPGADGGMYALALVAVFVLAFVLEFLGSRRLDELLRPRAARAAVHALRVGAAYLLMLAIMSFNGGVLLVAVAGHAAGFLAFKAGLFGHGRAQVEDGRGKEELEPAAC

SEQ ID NO: 43330 - DNA, 1122 bp, Panicum virgatum
  misc_feature: Ceres CLONE 2016217
  misc_feature: Encodes the peptide sequence at SEQ ID NO. 43331
agatagccccgtcaatttcttcgtcttctcatcatctcatacgtttgtctccatggcggcggccaacccaccctcggcgacaaacccgctcttcaccgtcaccttcgacgtgcagggcagcgacaactacggtgacttcatcgccggcatccgtcgcagggtggccaacccgaggcacttctcccacaaccgccccgtgctgccgccggtggagcccccgccacggcgctggttccacatcgtgctcaggacccagatcgccacgctcacgctgaccactcacgccgacaacctctacctggagggcttccggagcagcgacggcacgtggtgggagctcacccggggcctcatcccgggcgccacctacgtgggcttcggcggctcctacggcgacctgctcggcaacacgttccgcctcgccggcggcgcgctcgagcggctcggcccgcagcagcaggcggacgccgccaaggcgctcgccgcgcgcgccagcctcggcctcgccggcgtcgagctcggcccgcagcagatggcggacgccgccaacgctctcgccgcgcgcgccaggggcgacctcgcctccggcaaagagcagcagcgggcgagcgaggcgctggtcgtgatcctgctgatggtgcacgaggccacgcggttcgccaccgtgtcggcgttcgtggccgcgctgatgcaccccagggcggcgatgaagaggggcaccatcaccgcgcagatggagaagcaggtgaacgggtgggaggacctgtccaaatcgctgctcatggcggacgccgtgcggccgccgggcccgttcaagccgttcccggacatgggcgtgagtacggtggaggaggccgccgcgacgatcgcgatattgctgttcgttgagttgccgggcgggatgacggcggccaaggcgctgcagctgttccatggaaactaagctccgcgtgcgccagccagtatgttgctgcttgaggcagagcatgaacgacttgttgctgtaaaactacgaataagagcggtgccgtatctcaaatctgaatcacctaaaaataatgagattgatacctaatcaatgcatgtaatttgtgactgatatttattcaaagtgtttcttct

SEQ ID NO: 43331 - protein, 296 aa, Panicum virgatum
  misc_feature: Ceres CLONE 2016217
  misc_feature (13)..(283): Pfam Name: RIP Pfam Description: Ribosome inactivating protein
  misc_feature: SWISSPROT Homolog: EC 3.2.2.22 rRNA N-glycosylase
MAAANPPSATNPLFTVTFDVQGSDNYGDFIAGIRRRVANPRHFSHNRPVLPPVEPPPRRWFHIVLRTQIATLTLTTHADNLYLEGFRSSDGTWWELTRGLIPGATYVGFGGSYGDLLGNTFRLAGGALERLGPQQQADAAKALAARASLGLAGVELGPQQMADAANALAARARGDLASGKEQQRASEALVVILLMVHEATRFATVSAFVAALMHPRAAMKRGTITAQMEKQVNGWEDLSKSLLMADAVRPPGPFKPFPDMGVSTVEEAAATIAILLFVELPGGMTAAKALQLFHGN

SEQ ID NO: 43332 - DNA, 665 bp, Panicum virgatum
  misc_feature: Ceres CLONE 2016220-R
  misc_feature: Encodes the peptide sequence at SEQ ID NO. 43333
gagctccatgagggagcacgccgatctcctcagctccgtgcgtgaagacattaccgagtccaagggcaccggtggcatgtcgccaagagtgcatttactcagggagagggcttccattcatggcagcatcaaccagattgatgaggtaatcggccaagctcaaagcacaagggtgtccctttcaaatcagagggccttgtttggagatgttcaaggaaaagtcaagcagttgggtgaaaagttcccgataatcagaggtcttcttggcgccattaagaggaagaaatcaaaggatgctataattctttcagcagtgatcgcggcttgcaccatgtttttgattatttactggctttcaaaatgatgccatctcacccagaggaaatttcccaacatgaaggcagaagatcatgcctttggcacagattagctggtatcttatggcgtgtcatttgtcatgctgagaaagagggaaagagagatcagtttcttcagctttcattgatttgcctttgacttctatactaccttgtatctgaaattcctcatcaagcgtatgtagagaatttttgctggttgagtaaatatacatggtaacatcgagctcatgctgtagctgttgttgctgcgtgtgtgtttttttatatatatttcctgtcttctag

SEQ ID NO: 43333 - protein, 120 aa, Panicum virgatum
  misc_feature: Ceres CLONE 2016220-R
  misc_feature (1)..(98): Pfam Name: V-SNARE Pfam Description: Vesicle transport v-SNARE protein
SSMREHADLLSSVREDITESKGTGGMSPRVHLLRERASIHGSINQIDEVIGQAQSTRVSLSNQRALFGDVQGKVKQLGEKFPIIRGLLGAIKRKKSKDAIILSAVIAACTMFLIIYWLSK

SEQ ID NO: 43334 - DNA, 258 bp, Panicum virgatum
  misc_feature: Ceres CLONE 2016220
atttcctccgtctcattctgctgtgcatctcagtattcagcccaggatcgattgcgctcaatcccccaactccaccccgatcgacgccacacccaaatcggaagctactcctagctccccatttcttcttcagatcacagcggattggatccgatccgatcccagtcggcgccggcgtcggagacgatgatgtcgtcgtcggacgatgcggcggcagcggcgctggagctgcaggagtccgggtgggaggagctgcgg

SEQ ID NO: 43335 - DNA, 527 bp, Panicum virgatum
  misc_feature: Ceres CLONE 2016225
  misc_feature: Encodes the peptide sequence at SEQ ID NO. 43336
gtcctcctcattccaggcctccccgcatcaccgggcgccgcccgccgtgcggcgcctccgcagtcccttcaccggccgtcgtcgccccgcccttcatggccgggcagtccgacccgcacctatccatcttctcgccctccgaggtggagttcgtggcggatgatgagatcgtcaacatcggcccccacatccgcatggacgccctcgacatgatctgcggggacttcggacccttctacccgcgagtcgagagcaaagggccgctctggctcgctgtcgcgctcaggaagcgtggcaagtgcaccatccgcaccgaggactggatgactgatgaccgtgtgacaaacgtactggaagcacagagagagtcctcgcgagaattccagccattaccattcaactacattaagatttctgagctgctgtttgatcatgcacgtgatgacatctcagatgcgtacttggtgagatctttgattgatgacatcagagatataacattgctcaaggtagagactgtgattaga

SEQ ID NO: 43336 - protein, 143 aa, Panicum virgatum
  misc_feature: Ceres CLONE 2016225
  misc_feature (20)..(143): Pfam Name: Psf2 Pfam Description: Partner of SLD five, PSF2
MAGQSDPHLSIFSPSEVEFVADDEIVNIGPHIRMDALDMICGDFGPFYPRVESKGPLWLAVALRKRGKCTIRTEDWMTDDRVTNVLEAQRESSREFQPLPFNYIKISELLFDHARDDISDAYLVRSLIDDIRDITLLKVETVI

SEQ ID NO: 43337 - DNA, 966 bp, Panicum virgatum
  misc_feature: Ceres CLONE 2016228
  misc_feature: Encodes the peptide sequence at SEQ ID NO. 43338
cgaaatctgtcactaaagattattcactcaaatgggtaaagtcattagaggtcaaagaagaggtaagaagaactcaatcttcaagccccaccaacaccacagagtcgctcctgctgctttcagagttctcgatttcgctgaaaagaacggttacatcaagggtgtcgttagagagatcctccacgatcccggccgtggtgctcccctcgccaaggtcgtcttcagagacccctataaatatagactcaagactgcctacttcttggctgctgaaggcatgtacactggtcaattcgtctactgtggaaataaagctaccctctccactggtaacgtcctccccatcaacaagatccccgaaggtactgccgtctgcaacgttgaatccaagcctggtgatcaaggtaaattggccagatgctccggtacttccgctgtcatcatcggtcactccgacgatctttccaagaccagagtcaagcttccttctggtaccagaaagaccctcgctggtcacgccagagccatggttggtttgattgcctccggtgaaagagtcgacaagcccatccttaaggctggtagagtctatcacaagatgaagagactcagaaagagatggcctagagttagagctgttgccatgaatcccgttgaccatcccttcggtggtggtaaccaacaacacgtcggtgttccctctaccgtctccagatatgctcctcccggtagaaaggtcggtcttattgccgccagaagaactggttccgttagaggtggtagagacatcaagagattcgatgaaaaataaacaagaagacagtgacagcagcagcattcggaaagaatttttactaagaatattaggtgaaaagagctattttgttctctaaagatctatatatattatgctggatatggttattgcatccaaaattaagactaaaaagacagtttaagcagcag

SEQ ID NO: 43338 - protein, 259 aa, Panicum virgatum
  misc_feature: Ceres CLONE 2016228
  misc_feature (97)..(232): Pfam Name: Ribosomal_L2_C Pfam Description: Ribosomal Proteins L2, C-terminal domain
  misc_feature (11)..(91): Pfam Name: Ribosomal_L2 Pfam Description: Ribosomal Proteins L2, RNA binding domain
  misc_feature: Functional homolog of the protein sequence given in SEQ ID NO 51015
  misc_feature: Useful for making plants with modulated nitrogen use efficiency
MGKVIRGQRRGKKNSIFKPHQHHRVAPAAFRVLDFAEKNGYIKGVVREILHDPGRGAPLAKVVFRDPYKYRLKTAYFLAAEGMYTGQFVYCGNKATLSTGNVLPINKIPEGTAVCNVESKPGDQGKLARCSGTSAVIIGHSDDLSKTRVKLPSGTRKTLAGHARAMVGLIASGERVDKPILKAGRVYHKMKRLRKRWPRVRAVAMNPVDHPFGGGNQQHVGVPSTVSRYAPPGRKVGLIAARRTGSVRGGRDIKRFDEK

SEQ ID NO: 43339 - DNA, 1233 bp, Panicum virgatum
  misc_feature: Ceres CLONE 2016237
  misc_feature: Encodes the peptide sequence at SEQ ID NO. 43340
cccatcgacagcagagctcgcaaaacctccacaccttcctgaaatagccactagcttcaggttctctgagctccctgatcactctcgctctcagccttcctcgctgatccatataggttgccagctaccagccccattaactgatggagtttgacctgctcaattacagcccggaagcgcagctggagctgatgaacacgatgctccagctggagcagctcaccaagctcgacggcggccatgagtcgttgatggcgcccgtctcgccgccggtatccccggtgcaaacccatgcagcccactgcttctcgcctccgccacacgtgtcggcgaccgcggccgccaccggctactaccccgatcagggcacaccgctggccgcgtacgccggcagtatcggcctcgagcacctccaggtcgactacgtgctgtccccgtgcgccgacaccgcggcgcggccggcggggtcgccgtcgccgacgtcgtccgcggacgcgatgcgggaggtgatcttccacatcgcggcgctgcagccggtggagatcgagccggaggcggtgcggcccccgaagcggcgcaacgtgcgcatctccaaggacccgcagagcgtggcggcgcggctgcggcgggagcgcatcagcgagcgcatccgcaccctgcagcggctcgtcccgggcggcaccaagatggacacggcgtcgatgctggacgaggccatccactacgtcaagttcctaaagtcccaggtgcagtccctcgagcgcgccgccgccgccgccacccaccgcgccgccgcgctcggcgccgccttccaccccgccctccacgcgccgtggcagtacgcggtcccccacggcgacatgtgactaccacaacccaagcctctcgatcgttaccctcgagcgcgcgcgctcgtcgattcgccgccggcatcttccgatcggtcgacgacgtacgacggcctcttctccatctgccgccgccggtgctgattcttttctgctgtagtgttgtgtgtgtgtgcatcatctgtgcatgatcgcatgcgcgtgtatagagatgtagaagagcctttggtacattctattgttgtagccgcatacgacgtggccgctcgatccaattttttgttggagtcgcagcccgtgcatgcgcgcgcgtacgtgccctaccctacgtagtaggctgtacatttccttgtacctgccctctatccatccatcagttcgttgc

SEQ ID NO: 43340 - protein, 240 aa, Panicum virgatum
  misc_feature: Ceres CLONE 2016237
  misc_feature (152)..(199): Pfam Name: HLH Pfam Description: Helix-loop-helix DNA-binding domain
  misc_feature: Functional homolog of the protein sequence given in SEQ ID NO 51593
  misc_feature: Useful for biocontainment applications
  misc_feature: The sequence is a functional homolog of SEQ ID NO 120 in the 10/225,066 US patent application
  misc_feature: The sequence is a functional homolog of SEQ ID NO 218 in the 10/374,780 US patent application
  misc_feature: The sequence is a functional homolog of SEQ ID NO 130 in the 10/225,066 US patent application
  misc_feature: The sequence is a functional homolog of SEQ ID NO 414 in the 10/374,780 US patent application
  misc_feature: The sequence is a functional homolog of SEQ ID NO 1938 in the 10/374,780 US patent application
MEFDLLNYSPEAQLELMNTMLQLEQLTKLDGGHESLMAPVSPPVSPVQTHAAHCFSPPPHVSATAAATGYYPDQGTPLAAYAGSIGLEHLQVDYVLSPCADTAARPAGSPSPTSSADAMREVIFHIAALQPVEIEPEAVRPPKRRNVRISKDPQSVAARLRRERISERIRTLQRLVPGGTKMDTASMLDEAIHYVKFLKSQVQSLERAAAAATHRAAALGAAFHPALHAPWQYAVPHGDM

SEQ ID NO: 43341 - DNA, 700 bp, Panicum virgatum
  misc_feature: Ceres CLONE 2016241
  misc_feature: Encodes the peptide sequence at SEQ ID NO. 43342
tatgggttttactggcacttctatcaggatggaaaaatagaagcagaagtaaagcttactgggattctcagcttaggagccctgatgcccggggaatcaaggaaatatggcacaactattgcccctggtctgtatgcaccagttcatcagcatttctttgttgcccgtatggacatggctgtggattgcaaacctaatgaggctcataatcaggtggtcgaggttaatgttaaagtggaaagtgcaggcacgcataatgtgcataacaatgctttctatgctgaagagaagttgctgaagtctgagctgaaagcaatgcgggattgtgacccttcatctgcacgccattggattgtaaggaacacgcgaactgtaaaccgcactgggcagccaactggttacaggctcgtgcctggttcaaactgcctgccattggctctgccggaggcgaaatttctgaggagagctgggttcttgaagcacaatctctgggtcacccaatacaagagcgacgagatgttccctggaggggagtttcccaaccagaatcctcgaatccacgagggtttggctacatgggtccagaaggataggcccctggaggaaaccaacattgttctctggtacatgttcgggcttacccatatcccaaggctggaagactggccggtcatgccggtagagcgcatcggcttcatgc

SEQ ID NO: 43342 - protein, 233 aa, Panicum virgatum
  misc_feature: Ceres CLONE 2016241
  misc_feature (1)..(233): Pfam Name: Cu_amine_oxid Pfam Description: Copper amine oxidase, enzyme domain
  misc_feature: SWISSPROT Homolog: EC 1.4.3.6 Amine oxidase (copper-containing)
YGFYWHFYQDGKIEAEVKLTGILSLGALMPGESRKYGTTIAPGLYAPVHQHFFVARMDMAVDCKPNEAHNQVVEVNVKVESAGTHNVHNNAFYAEEKLLKSELKAMRDCDPSSARHWIVRNTRTVNRTGQPTGYRLVPGSNCLPLALPEAKFLRRAGFLKHNLWVTQYKSDEMFPGGEFPNQNPRIHEGLATWVQKDRPLEETNIVLWYMFGLTHIPRLEDWPVMPVERIGFM

SEQ ID NO: 43343 - DNA, 671 bp, Panicum virgatum
  misc_feature: Ceres CLONE 2016242
  misc_feature: Encodes the peptide sequence at SEQ ID NO. 43344
gtccacctcctgagccctccccaccctccaaccccggcggcggcagcggcggcggcggcgcagcagcagcagctgaagatggtgaagttcctgaagcccggcaaggccgtgatcctccttcagggccggttcgccggccggaaggcggtgatcgtgcgcgtgttcgaggagggcacacgcgaccgcccctacgggcactgcctcgtcgccggcctcgccaagtatcccaagaaggtgatccgcaaggactccgccaagaagacggccaagaagtcccgtgtcaagtgcttcatcaagctcgttaacttcacccacctcatgcccacccgctacacccttgacgtcgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagatgccaggcgtccagcatagtacctgctttagttgtcaatttcatatatcggacacccttatctctgttttggtattgccgtgaagacttcgtgcttactgttatggatcttggagaggttgacatgtcgctgatgtttttaatgatgtccatcgtagaccttgtccaaaaaaaagcag

SEQ ID NO: 43344 - protein, 137 aa, Panicum virgatum; identical to SEQ ID NO: 10158
  misc_feature: Ceres CLONE 2016242
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 43345 - DNA, 1118 bp, Panicum virgatum
  misc_feature: Ceres CLONE 2016250
  misc_feature: Encodes the peptide sequence at SEQ ID NO. 43346
cttctttccacattcctagggaagtttccatatgcttccccttttctcggtgaggtttggtctcctcatttcctgatagctcaccttttcgcaggccaacaaagctggtgctcatctccgatatctccccgtcaaaactgtaatttttccgccgccaggaacctccattcccgcgccattcttaaatttggcgcagcgaattcgttcttgcgaggattgaaatccttgcggctttctcgagcacgcgcggccaagccggggttgaagaatcatcgcagattggtagtagagagggacgccgcagccagtccaaggtatgattcagctgctgttcctcgtgctgttcgcggagggcgcggtggcgctgcttctcatggtgaaggtcgggccgctgagggagctggcgatgcgcggcgtggaccaggtgaagacgggcaagggcccggccaccgtaaagaccctggcgtgcacgctcaccgtgatcctcatgtccgacgttgccagcatcctcaagatccagaacagggggctcaaggtcggcaccgtcagccccatggaccaggtgctctggaggacgcaccttctcgaggcatccctcattggatatactctattccttgcatttgtaatcgaccggctgcaccactacctgcgaaagctcatgacacttaggaaaacatccaacacatccagggaggaggtcgagaaacttcagatggagaaccgatccctccgcgagaaggaggagaaatcctccagcgaaatgaagaagcttcagcgggagaatgcaaagctgaacgagagcatgaagaagctgaaatccgaaaccgaagaacatgagaggaaggcatcggtagcagaggcccatgtgaacgcgctgcagaagcagtcggaggagctgctcctggagtacgaccggttgctggaagacaaccagatcctacagactcggctccttagcagaggctgagctattagctggtctatgcagcttcaattgttcattagcaagagtcttaccagatggcgtcagagagctgaggacttgccctgtttcgaatgaggaatgatgtgattcttggcgcccatgctgttcctaacttatgatcttgttggtg

SEQ ID NO: 43346 - protein, 217 aa, Panicum virgatum
  misc_feature: Ceres CLONE 2016250
  misc_feature (4)..(200): Pfam Name: Bap31 Pfam Description: B-cell receptor-associated protein 31-like
MIQLLFLVLFAEGAVALLLMVKVGPLRELAMRGVDQVKTGKGPATVKTLACTLTVILMSDVASILKIQNRGLKVGTVSPMDQVLWRTHLLEASLIGYTLFLAFVIDRLHHYLRKLMTLRKTSNTSREEVEKLQMENRSLREKEEKSSSEMKKLQRENAKLNESMKKLKSETEEHERKASVAEAHVNALQKQSEELLLEYDRLLEDNQILQTRLLSRG

SEQ ID NO: 43347 - DNA, 625 bp, Panicum virgatum
  misc_feature: Ceres CLONE 2016251
  misc_feature: Encodes the peptide sequence at SEQ ID NO. 43348
aactgatcgcccgcaaaacggagtagcagccgcagcaaggcaggctggcggcttggttcgccgaattcgaaggcgcaggccgctgccgtccactcccagctcgtcgcccgatctgggcatcgaccgcctgtccatgcttcgaatttgcccctgtgtcagtttgcaagcgcgcagggaaagggaatatcttggaccgaacccggatcacttttatctgttatcagaccttattagtttcagacactgagttcacaccatgacttctttggacactgtgggaggagatcttgctctcgtcattctgtacctaaacaaggctgaagcaagagataagatctgcagagctatacagtatggatcaaagtttctgagtaacggagaaccagggccggcgcagaatgtcgacaagtcaactagtctagctcggaaagttttcaggctttttaagtttgtcaatgacctgcatgctctcattagtcctcctgccaaaggaactccacttccactgatcttactcggaaagtcgaagaatgcaatgctgtcaactttcctcttcctggatcagattgtgtgggctgggaggacaggaatatacaagaacaaggagcgagcggagttcctcagc

SEQ ID NO: 43348 - protein, 122 aa, Panicum virgatum
  misc_feature: Ceres CLONE 2016251
  misc_feature (11)..(121): Pfam Name: PEX11 Pfam Description: Peroxisomal biogenesis factor 11 (PEX11)
MTSLDTVGGDLALVILYLNKAEARDKICRAIQYGSKFLSNGEPGPAQNVDKSTSLARKVFRLFKFVNDLHALISPPAKGTPLPLILLGKSKNAMLSTFLFLDQIVWAGRTGIYKNKERAEFL

SEQ ID NO: 43349 - DNA, 677 bp, Panicum virgatum
  misc_feature: Ceres CLONE 2016252
  misc_feature: Encodes the peptide sequence at SEQ ID NO. 43350
gccatttccttcttcccgtgggatcccagccgccgccgcgagaagaagagctcggcgactcacggtctcacgagaagatgccgaagcagatccatgagatcaaggacttccttctcaccgcgaggaggaaggatgcccggtctgtgaagatcaagaggagcaaggatgttgtcaaattcaaggtgcgctgctccaagtacttgtacaccctctgcgtcttcgatgctgagaaggcaatcaagttgaagcaatctcttcccccaggtttgaccgtccaggaggtttgaagggacacaagacaacatcaagatgggaactaccaaagcttccttatcatcagcagcgcattctcttctatgtacctttggaacctatgcttttagacctgtcagtcatggatttgtatatcttggattttgggagaaataccattttaccgtattccaggatgcagcttttcaatttgattctttaatgagctacatgctgcttgagaatttgtttgtcctacttcctttcggtttaccactcaggactcagcaatttagatgggtgtaaagaagctacgcattgggcagtagctagaggagacatggttgcgtcgacctttggccggttgcaactcgattccctttctgcttattctgttgttgtctgcgtgtagtagatgtagatgt

SEQ ID NO: 43350 - protein, 69 aa, Panicum virgatum
  misc_feature: Ceres CLONE 2016252
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKAIKLKQSLPPGLTVQEV

SEQ ID NO: 43351 - DNA, 628 bp, Panicum virgatum
  misc_feature: Ceres CLONE 2016255
  misc_feature: Encodes the peptide sequence at SEQ ID NO. 43352
gaagaagaaggggaggagagcaaggaactcggcggcaagggggaggacgacgctgacaagagcaagaaaggggcggcggcggcggggaaggccaagggcaagggcgagaagcggcagcggcagccgcggttcgcgttcatgaccaagagcgaggtcgaccacctcgaggacggctaccggtggcgcaagtacggccagaaggccgtcaagaacagcccatacccctggagctactaccggtgcacgacgcagaagtgcctggtgaagaagcgggtggagcggtcgtaccaggacccggcggtggtgatcaccacgtacgagggcaagcacacgcaccccatcccggccacgctccgcggcagcacccacctcctcgccgcgcagctgcaccaccactaccacgccggcggcggcggcggcggacaccacctcggcggcgccttcccgccgctgccgcagatgggcgcgccgttcgggcggtcgtcgtccggtgtcggcggcggcagcgtcatcgacgtgctcggccttctgccgccccgcggcgcccacagcaaccacaccgtgccgccggcgataggcctcgcgtcgtcccacggcatgagcggtccgacgagcaccgtcgcgggcg

SEQ ID NO: 43352 - protein, 209 aa, Panicum virgatum
  misc_feature: Ceres CLONE 2016255
  misc_feature (55)..(114): Pfam Name: WRKY Pfam Description: WRKY DNA -binding domain
  misc_feature: The sequence is a functional homolog of SEQ ID NO 450 in the 10/666,642 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
EEEGEESKELGGKGEDDADKSKKGAAAAGKAKGKGEKRQRQPRFAFMTKSEVDHLEDGYRWRKYGQKAVKNSPYPWSYYRCTTQKCLVKKRVERSYQDPAVVITTYEGKHTHPIPATLRGSTHLLAAQLHHHYHAGGGGGGHHLGGAFPPLPQMGAPFGRSSSGVGGGSVIDVLGLLPPRGAHSNHTVPPAIGLASSHGMSGPTSTVAG

SEQ ID NO: 43353 - DNA, 694 bp, Panicum virgatum
  misc_feature: Ceres CLONE 2016284
  misc_feature: Encodes the peptide sequence at SEQ ID NO. 43354
gagagtatggtcgcaaggctgaaacttaaaggaattgacggaaatccaagctgcagagaccttactgcttaagtatacgcagcttcagttcactgagccagcaggcagcagcacaggttgccatggcggctcggggtcctgccttgatgcaatggctgctcgccgtctccctcctctccttggccgccaacgcgcagctctcgacgaccttctacgcgacctcctgccccaacctggagagcatcgtgcgggcggccatgacccaggccgtcagcaacgagcgaaggatcggcgcctccctgctcaggctcttcttccacgactgcttcgtgcaaggatgcgacggctcgattcttctcgacgccggaggggagaagaccgccggcccgaacgccaactcggtgcgcgggttcgaggtcatcgacaccatcaagaggaacgtcgaggccgcgtgccccggcgtcgtgtcgtgcgccgacatcctcgcgctcgccgcgcgcgacggcacgactcttctcggcgggccgaactggaacgtgccgctcggctggcgggactcgacgacggcgagcgcgtccctcgccaaccagaacctgccgccgccgacggccagccttgccacgctcgtctcgctgttcggccggcagggcctgtcggcgcgcgacatgacggcgctgtcgggcgcgcacaccat

SEQ ID NO: 43354 - protein, 190 aa, Panicum virgatum
  misc_feature: Ceres CLONE 2016284
  misc_feature (42)..(190): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 51417
  misc_feature: Useful for making plants with modulated oxidative stress sensitivity
MAARGPALMQWLLAVSLLSLAANAQLSTTFYATSCPNLESIVRAAMTQAVSNERRIGASLLRLFFHDCFVQGCDGSILLDAGGEKTAGPNANSVRGFEVIDTIKRNVEAACPGVVSCADILALAARDGTTLLGGPNWNVPLGWRDSTTASASLANQNLPPPTASLATLVSLFGRQGLSARDMTALSGAHT

SEQ ID NO: 43355 - DNA, 668 bp, Panicum virgatum
  misc_feature: Ceres CLONE 2016290
  misc_feature: Encodes the peptide sequence at SEQ ID NO. 43356
tttcaaaccctcttcttagtttgcctcccaaaaaaaaaaaacacttagcgcccctcctcgcggcaacacgatgctcaccacagcacacagccggcagcatcatcacgccttcgagaagagccctagcagccacatgaagaacctcgacaggaagctgcagcaggccatgagcaatgcgaccaacaagtacatgcagaggatctaccctctgggcatccagaggagcagctccaacctcacattgtcgtcgctctccctgtcgcagaactccaacgactcctcgctcagcagctccaactccagctgggagcccaaggtgccgcttctgtatggcggcaccttcagcccctggggcgatgtgctggtgtctctggagatgaggagagaggaggacgacaaggccagcgaccacgacgttgaagggggtgaggacttcgattgcagcgagccggggagcttgcataggtgcagctggatcaccaagaacagtgatgaggcgtacgttcagttccacgacgagtgctggggcgtccccgtgtacagcgacaaccgcctcttcgagcttctgtcgctgtccgggatgctcatagactacaactggaccgagatactcaagaggcgagacatgtacagggaggtgttcgccgacttcgaccccagcacggtgg

SEQ ID NO: 43356 - protein, 178 aa, Panicum virgatum
  misc_feature: Ceres CLONE 2016290
  misc_feature (114)..(178): Pfam Name: Adenine_glyco Pfam Description: Methyladenine glycosylase
  misc_feature: SWISSPROT Homolog: EC 3.2.2.20 DNA-3-methyladenine glycosylase I
MKNLDRKLQQAMSNATNKYMQRIYPLGIQRSSSNLTLSSLSLSQNSNDSSLSSSNSSWEPKVPLLYGGTFSPWGDVLVSLEMRREEDDKASDHDVEGGEDFDCSEPGSLHRCSWITKNSDEAYVQFHDECWGVPVYSDNRLFELLSLSGMLIDYNWTEILKRRDMYREVFADFDPSTV

SEQ ID NO: 43357 - DNA, 1221 bp, Panicum virgatum
  misc_feature: Ceres CLONE 2016292
  misc_feature: Encodes the peptide sequence at SEQ ID NO. 43358
agagctcctatttctcattccccatttcctccctcaaatccggtaacagaaaaagggggctctccgcagccaccgccgccgccgccgccgatggcaaccctcctccggcgatccgccaccccagtgcgccagctcctcctcccgcgccacctcgccgccgccggctccgcccccgcctcgtcccgcgccttctcccgctactacccccgcgacgacagcgccaggtacgatccgccgggcacgccggtgaactggggcgtggccatagtcccagagaagaaggcgttcgtggtggaaagattcggcaagtacatcaggaccctcggctccgggattcacctgctgatccctgccgttgaccgcatcgcctacgtgcactcgctcaaggaggaggccatccccatccccaaccagtccgccatcaccaaggacaacgtcctcatacagatcgatggtgtgatctacatcaagatcattgacccctaccttgcttcctatggcgcagaaaatccaatttttgcagtcatacaactcgcacaaacaacgatgaggagtgagcttgggaaaatgacattggacaaaacatttgaggagagagatgcactaaatgagaacattgtgagggctatcaatgaggcagcaacagattggggcctgaagtgtctccgttatgaaatcagggacatatctcctccacatggtgttaaggtggctatggagatgcaagttgaagcagaaaggaaaaagcgtgcccaaattcttgaagcagaagggaaaaagcgtgcccaaatccttgaatcagaaggtgaggctggagcggttcttgccttatcagaagcttcagctcgtggaattagattggtttcagaggctatgacaactaaaggcagtactaaggctgcgaacctgagagttgcagagcaatacgtcagagccttctctcaagtggccaaaaagggcaccactgttctgcttccaagtgatggtggcaatccgtcatctttcgtggcccaggctatcaagatcttccagcaactccaggctaacaacccccaggtagacgagctggaggaatcagaagaagagactgatcctgctgaaacaagcgagatgccacttctcatccctgatgcagatcctgggacgaacttctcgctccaacgccgcaagaacaagatttgagttgcactcgagtgcctgaaggaagcccccccccccccc

SEQ ID NO: 43358 - protein, 363 aa, Panicum virgatum
  misc_feature: Ceres CLONE 2016292
  misc_feature (58)..(230): Pfam Name: Band_7 Pfam Description: SPFH domain / Band 7 family
MATLLRRSATPVRQLLLPRHLAAAGSAPASSRAFSRYYPRDDSARYDPPGTPVNWGVAIVPEKKAFVVERFGKYIRTLGSGIHLLIPAVDRIAYVHSLKEEAIPIPNQSAITKDNVLIQIDGVIYIKIIDPYLASYGAENPIFAVIQLAQTTMRSELGKMTLDKTFEERDALNENIVRAINEAATDWGLKCLRYEIRDISPPHGVKVAMEMQVEAERKKRAQILEAEGKKRAQILESEGEAGAVLALSEASARGIRLVSEAMTTKGSTKAANLRVAEQYVRAFSQVAKKGTTVLLPSDGGNPSSFVAQAIKIFQQLQANNPQVDELEESEEETDPAETSEMPLLIPDADPGTNFSLQRRKNKI

SEQ ID NO: 43359 - DNA, 231 bp, Panicum virgatum
  misc_feature: Ceres CLONE 2016292-R
cccacccttttttttgtctcttattgttctgcaaacatgggggtgtcactgataactccagtagcgctagttttctgagtctgagaaatttactgtgcaacgcataagttaggatgcctaggcaattggtttctaggagataaatggaagcaagtttggtgacgggagaggaagattttgattccggtgaaagttaaactttggctcgttcttaatctgatgggaatttgc

SEQ ID NO: 43360 - DNA, 670 bp, Panicum virgatum
  misc_feature: Ceres CLONE 2016293
  misc_feature: Encodes the peptide sequence at SEQ ID NO. 43361
gcatcagcgtagcaggcaacagcaatctcgaggagcaggtagtagagcgctaagcttccggtgcgtggagcgaatagcggaagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgctcgctccttcggccccgccgtcgcg

SEQ ID NO: 43361 - protein, 191 aa, Panicum virgatum
  misc_feature: Ceres CLONE 2016293
  misc_feature (11)..(191): Pfam Name: MIP Pfam Description: Major intrinsic protein
MVKLAFGSVGDSFSATSIKAYVAEFIATLLFVFAGVGSAIAYGQLTHGGALDPAGLVAIAIAHALALFVGVSIAANISGGHITILTGLFYWVAQLLGASVACLLLKFVTHGKAIPTHGVAGISALEGVVFEIIITFALVYTVYATAADPKKGSLGTIAPIAIGFIVGANILAAGPFSGGSMNPARSFGPAV

SEQ ID NO: 43362 - DNA, 657 bp, Panicum virgatum
  misc_feature: Ceres CLONE 2016304
  misc_feature: Encodes the peptide sequence at SEQ ID NO. 43363
gctccgcagtgtcagatcggccgtcgcgcgccgagcccgagccctagcgccgccgctcgccccgcctcccagtcctgacctctgaggaacagcgagggccttgcgcttgcggatcggggatcgcgcctcggcggcgggacgacggcgggacgacccgatgggcgaggaagccaagtacctggagacggcgcgggccgaccgctctgtgtggctcatgaagtgccccccggtcgtctcccgcgcctggcaggccgcctccgcctcgtcctcctccgacgccgccaaccccaaccccgtcgtcgccaaggtcgtcctctccctcgacctgcccagcggcgaagagcagcaagagccttccctccagttcaagatggagttggctcaaactaacactggcaatacacctaaaagctactctttgaacatgttccaagatttcgtgcccatgtgtgttttctcggaatctaaccaagggaaactttcatgtgaaggaaaagttgagcataaatttgacatggaaccacacagtgataatttggtgaactatggaaagttatgccgtgaaagaacacagaaatatatggttaaatccagacaagtgcaggtacttgacaatgaccacggcatgagcatgagaccaatgcccggcatggtcgg

SEQ ID NO: 43363 - protein, 166 aa, Panicum virgatum
  misc_feature: Ceres CLONE 2016304
  misc_feature: Functional homolog of the protein sequence given in SEQ ID NO 50628
  misc_feature: Useful for making plants with altered lignin content
MGEEAKYLETARADRSVWLMKCPPVVSRAWQAASASSSSDAANPNPVVAKVVLSLDLPSGEEQQEPSLQFKMELAQTNTGNTPKSYSLNMFQDFVPMCVFSESNQGKLSCEGKVEHKFDMEPHSDNLVNYGKLCRERTQKYMVKSRQVQVLDNDHGMSMRPMPGMV

SEQ ID NO: 43364 - DNA, 610 bp, Panicum virgatum
  misc_feature: Ceres CLONE 2016308
  misc_feature: Encodes the peptide sequence at SEQ ID NO. 43365
gagcggaagcctcctcctcctcctcccgacctgctcagctccagatctccgcgccgcgccgccgtcccaccccaaccccatggagcacgacgccgaggcgcgccgcgggttcgccaggatgggcttcgggtgcaagcactaccggaggcggtgccggatccgcgcgccctgctgcggcgacgtcttccactgccgccattgccacaacgagtccacgaaagacgggcacgagctcgaccggcacgccgtccaatcggtcatctgccttgtttgcgacaccgagcaggaggttgcgcaggtgtgctgcaactgcggagtttgcatgggcgagtacttctgcaggacgtgcaagttcttcgacgacgatgttgacaaggagcactaccattgcaaagactgcggcatctgcagagttggagggagggaaaacttcttccactgccagaagtgcggatcctgctactcgacgaccctgcgggagaagcactgctgcatcgagaactcgatgaagaacaactgccccatctgctacaagtacctgtttgattcgttgcgggagacgtccgtgctccggtgtgggcacacgatgcacctgccgtgcttccaccag

SEQ ID NO: 43365 - protein, 176 aa, Panicum virgatum
  misc_feature: Ceres CLONE 2016308
  misc_feature (18)..(94): Pfam Name: zf-CHY Pfam Description: CHY zinc finger
MEHDAEARRGFARMGFGCKHYRRRCRIRAPCCGDVFHCRHCHNESTKDGHELDRHAVQSVICLVCDTEQEVAQVCCNCGVCMGEYFCRTCKFFDDDVDKEHYHCKDCGICRVGGRENFFHCQKCGSCYSTTLREKHCCIENSMKNNCPICYKYLFDSLRETSVLRCGHTMHLPCFH

SEQ ID NO: 43366 - DNA, 686 bp, Panicum virgatum
  misc_feature: Ceres CLONE 2016316
  misc_feature: Encodes the peptide sequence at SEQ ID NO. 43367
agtgggcccccgggaggccgggagccaccacctaccagagcctgagcccggaatcgacggcgccgccggagatggagacggaggcggctgcggcgaggcaggccaaggagtccctggagctggcgttccagatgtcccagatcctcgacaccggcctcgaccgccacaccttgtcgctgctcatggcactgtgtgaccgcggcgccaaccccgaggccctcgccgccctcgtccgcgagctctcctccgccgctcccccaaccgcagcggcgtcgacccctctactgtgagcaacggcaccgcggccccggccccggccccatcatccgtgtctctgttcccctccggctccggccttcgccgttcctagggtttgtgatatccccttcttctccggtattgctgaatactgaacgggactatgtcatcattgtgtaacaaatgcaaatgtaaagctggaattgctggatgaaaaggagtgccttctgcattgttgtggcttttgttgagacaagaaatctgtggttcacagaggcactgaaattgacgtatccttccaaggacttgtgcgggttaacagttgtgatcatgaggtgtcgttttctttttcattcatcattagattacgtccatcagttgtatgcatcagtttcgcagtcggtcttccgtccaatatcctcactttg

SEQ ID NO: 43367 - protein, 95 aa, Panicum virgatum
  misc_feature: Ceres CLONE 2016316
  misc_feature: Functional homolog of the protein sequence given in SEQ ID NO 50417
  misc_feature: Useful for making plants with modulated nitrogen use efficiency
WAPGRPGATTYQSLSPESTAPPEMETEAAAARQAKESLELAFQMSQILDTGLDRHTLSLLMALCDRGANPEALAALVRELSSAAPPTAAASTPLL

SEQ ID NO: 43368 - DNA, 713 bp, Panicum virgatum
  misc_feature: Ceres CLONE 2016320
  misc_feature: Encodes the peptide sequence at SEQ ID NO. 43369
gcagaaattgaaggaatgaagaattcacacctaagagatgctgctgctttagcagaattctggtgctggctagaggatgaagtctgtaaaagtgttccccttacagaggtacaagttgctgaaaagcttctagaatttcgtaaaaagcaagatggatttatagagacaagcttcgacactataagtggttatggtgcaaatggtgctataatacactacaggccaaccccagaggactgtagttctgttggaagtgacaatctatttttactggatagtggggctcaatacattgatggaactactgacataacaaggacagtacattttggcgagccttctccaaggcaaaaggaatgcttcacaagagttttacagggccatatagctcttgatcaggcagtgttccctgagagaactccaggctttgtgctagatgttctggcacgctcatctctatggaagattggactcgattatagacatggtacaggccatggagttggagcagcactaaatgtacatgagggccctcagagcataagctatcgatacggaaatttgacagccttacagaagggcatgattgtcagcaatgaacctggctattatgaagataattcgtttggcattcgtatcgagagcaagcttattgatgtgtccttgctttcaccttcggagatcaactgggtcaatgattaccatgaaaaggt

SEQ ID NO: 43369 - protein, 237 aa, Panicum virgatum
  misc_feature: Ceres CLONE 2016320
  misc_feature (9)..(216): Pfam Name: Peptidase_M24 Pfam Description: metallopeptidase family M24
AEIEGMKNSHLRDAAALAEFWCWLEDEVCKSVPLTEVQVAEKLLEFRKKQDGFIETSFDTISGYGANGAIIHYRPTPEDCSSVGSDNLFLLDSGAQYIDGTTDITRTVHFGEPSPRQKECFTRVLQGHIALDQAVFPERTPGFVLDVLARSSLWKIGLDYRHGTGHGVGAALNVHEGPQSISYRYGNLTALQKGMIVSNEPGYYEDNSFGIRIESKLIDVSLLSPSEINWVNDYHEK

SEQ ID NO: 43370 - DNA, 1001 bp, Panicum virgatum
  misc_feature: Ceres CLONE 2016322
  misc_feature: Encodes the peptide sequence at SEQ ID NO. 43371
atccgacctcctcaagtcctaacgaatcttcaagatggtcaacctcagaacacagaagcgcctcgcggcctcggtccttggatgcggtaagcgcaaggtctggctcgaccccgccgagcagaacgacattggcaacgccaactcgcgtgccaacatccgcaagctcatccgcgacggccagatcatccgcaagcccgtcgtcggcggctcgcgatcgcgtgcccgcgccaccgccgccgccaagcgtgccggccgtggtaccggacagggtcaccgcaagggttcgtcggaggcccgcatgcccaccaaggtcatgtggatgcgccgccagcgtgtcctgcgccgtctgctgcgcaagtaccgcgagtcgggcaagatcgacaagcacctctaccacgagctctacctcaagtccaagggtaacgtgttcaagaacaagcgtgtcctcatggagcacatccacaaggctaaggccgaggctgcccgatccaagcaccttgccgaccagatggaggcccgccgtatgcgcaacaaggccatgcgcgagcgccgtgctcagcgtgtgctcgagaagcgtgctgccatcatcgccgtcgagaacgaggccgaggagaagaagtaagctggttcagcacgcccgtcgctgttcccgcctgcattttctctcttgtcctgccctttcctctccggccgcaacattctttctcgccatgccatattagccctcacctcctctcctctcgcacggtgcgcgagttccgagatctgccttgccggcatgtcgggctctctcgtcgtgcatccacaacccgcctatgcatttgctcgtcgccttcgtcgcggcgattgcatcttccttgtgttacatcacgcacccctggccttggtggttgattcccacctctggtcccacgactcctccacacacgatactatccaatcccccctacatatcggcctggaagtcgtacaaaaaagcaatcgcatctgcacattgaccc

SEQ ID NO: 43371 - protein, 195 aa, Panicum virgatum
  misc_feature: Ceres CLONE 2016322
  misc_feature (2)..(149): Pfam Name: Ribosomal_L19e Pfam Description: Ribosomal protein L19e
MVNLRTQKRLAASVLGCGKRKVWLDPAEQNDIGNANSRANIRKLIRDGQIIRKPVVGGSRSRARATAAAKRAGRGTGQGHRKGSSEARMPTKVMWMRRQRVLRRLLRKYRESGKIDKHLYHELYLKSKGNVFKNKRVLMEHIHKAKAEAARSKHLADQMEARRMRNKAMRERRAQRVLEKRAAIIAVENEAEEKK

SEQ ID NO: 43372 - DNA, 663 bp, Panicum virgatum
  misc_feature: Ceres CLONE 2016328
  misc_feature: Encodes the peptide sequence at SEQ ID NO. 43373
cgaccgaattgaagcagcatcgggagttcgatcagtagcagcgtgcaggaaagaaactagctaggagggtcacttggttcactagctactactgccatggcggccgcttccacgcgtggccgctgcctcgccctgctgtgtctcgtgttccccgtcgtcctcctcgccggcgccgcccgcggccacccgtggggcggcctgttcccgccgttctacgaccactcgtgcccgcaggcgaaggagatcgtgaggtccgtcgtggcgcaggccgtcgccagggagaccaggatggcggcgtccctggtcaggctgcatttccacgactgcttcgtccagggatgcgacgcctctttgctgctggacaacagcagcagcatcgtgagcgagaaagggtccaaccccaacagcaactccgccagagggttcgaggtgatcgacgagatcaaggccgccctcgagaccgcctgccccggcaccgtctcctgcgccgacatcctcgccctcgccgcccgcgactccaccgtcctcgtcggcgggccgtactgggacgtgccgctggggcggcgggactcgctgggcgccagcatccagggctccaacaacgacatcccggcgcccaacaacacgctccccaccatcgccaccaagttcaggcgccagggc

SEQ ID NO: 43373 - protein, 188 aa, Panicum virgatum
  misc_feature: Ceres CLONE 2016328
  misc_feature (51)..(188): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51032
  misc_feature: Useful for making plants with altered carbohydrate content
  misc_feature: Functional homolog of the protein sequence given in SEQ ID NO 51033
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
MAAASTRGRCLALLCLVFPVVLLAGAARGHPWGGLFPPFYDHSCPQAKEIVRSVVAQAVARETRMAASLVRLHFHDCFVQGCDASLLLDNSSSIVSEKGSNPNSNSARGFEVIDEIKAALETACPGTVSCADILALAARDSTVLVGGPYWDVPLGRRDSLGASIQGSNNDIPAPNNTLPTIATKFRRQ

SEQ ID NO: 43374 - DNA, 1031 bp, Panicum virgatum
  misc_feature: Ceres CLONE 2016357
  misc_feature: Encodes the peptide sequence at SEQ ID NO. 43375
ctctttctcgcactagaaaaatggtgcgcgggcccaagaagcacctgaagcgcttgaatgcgcccaagcactggatgctggacaagcttgggggcatcttcgcccccaagccgtccgctggtccccacaagcagcgcgagtgcctgcctctgctgctcattctgcgcaaccgcctgaagtatgccctgacttacaaggaggtgatgcagatcctgaagcagcgcctggtcaaggtggacggcaagacccgcactgacaccacctaccccgctggcttcatggacgtcatcgagattgagaagaccgatgagcacttccgcctggtgtacgacaccaagggccgctttgtggtgcaccgcatcaccaaggaggaggcgtcctacaagctgtgcaaggtcaagcgcatggagttcggcaagggtggcgtgccctacatcggcacccacgacggccgcaccatccgctaccccgaccctgagatcaaggtgaacgacaccgtgatgctcgacattgagactggcaaggtcaaggacttcgtcaagttcgacatcggcaacatggtcatggtcaccggcgggcacaacaacgggcgtgtgggcaccattgtgcagaaggagaagcacaagggctccttcgacattgtgcacgtggaggacgccgccggcaaccgcttcgcgacgcgccagaccaacgtgtttgtgatcggcaagggctccaagcccctggtgtccctgcccaaggccaagggtatccgcctgaccattctgcaggagcaggccaagcgttacgcaaccgcataaagcgggctgtgtgacgaggcttggttgatggcagccgtgtggggactggggcgtggggcagatggatgcgcagctggcaagagttaggcccgcttggcggctgcgcgcctcgtgccagcccagctagcatcacgtgcaccctgggtagctgtgtgtctgggggcatggacggtgcgcctgcacaatcaggttggttggcgacagcacacctgtaaaacttttctaaatgcc

SEQ ID NO: 43375 - protein, 259 aa, Panicum virgatum
  misc_feature: Ceres CLONE 2016357
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (177)..(211): Pfam Name: KOW Pfam Description: KOW motif
  misc_feature (42)..(90): Pfam Name: S4 Pfam Description: S4 domain
MVRGPKKHLKRLNAPKHWMLDKLGGIFAPKPSAGPHKQRECLPLLLILRNRLKYALTYKEVMQILKQRLVKVDGKTRTDTTYPAGFMDVIEIEKTDEHFRLVYDTKGRFVVHRITKEEASYKLCKVKRMEFGKGGVPYIGTHDGRTIRYPDPEIKVNDTVMLDIETGKVKDFVKFDIGNMVMVTGGHNNGRVGTIVQKEKHKGSFDIVHVEDAAGNRFATRQTNVFVIGKGSKPLVSLPKAKGIRLTILQEQAKRYATA

SEQ ID NO: 43376 - DNA, 444 bp, Panicum virgatum
  misc_feature: Ceres CLONE 2016361
  misc_feature: Encodes the peptide sequence at SEQ ID NO. 43377
ctgcagcctgcatttaaattaacagtagccgagtgagctgtgagcaccgaccccgccgcccacctcgtgtcctcatactcatcgatggcggcgaggagactcctggaggctgcgttcctggctctggcggtgccggcggtgctgtgccaggcgcctggtccggcggcgcccaagggcccgccgaacgtgacggcgatcctggataagggcgggcagtacgcaaccttcatccggttgatgaaggcaacgcatcacgacacgcagctcaacagccagctcaacaactccttcggcagcggctacaccgtgttcgcgcccgccaacaacgccttctgcatgctctagcccagcacgctcaacaagctgtcgcagcaggagcaggtgtcgctggtgcagaaccacatcctcccgctattctactctctcgactccttcgagaccgcc

SEQ ID NO: 43377 - protein, 86 aa, Panicum virgatum
  misc_feature: Ceres CLONE 2016361
  misc_feature: Functional homolog of the protein sequence given in SEQ ID NO 51625
  misc_feature: Useful for making plants with altered carbohydrate content
  misc_feature: Functional homolog of the protein sequence given in SEQ ID NO 50209
  misc_feature: Useful for making plants with altered cell wall content and/or composition
MAARRLLEAAFLALAVPAVLCQAPGPAAPKGPPNVTAILDKGGQYATFIRLMKATHHDTQLNSQLNNSFGSGYTVFAPANNAFCML

SEQ ID NO: 43378 - DNA, 1329 bp, Panicum virgatum
  misc_feature: Ceres CLONE 2016380
  misc_feature: Encodes the peptide sequence at SEQ ID NO. 43379
gccaggcagacgtcggcgatgacgacatcccggacagccacttgttgggtttcctcctcctctttgcgccccccggctccggcggcggccacgcatcctcctcccccacctgcacctgctgctgccttccctcgctcccgtccatccctttcctccacctgtcgcctccgcctccgctgctccggcgaccgcatcatggtgaaggccaaggccatcagggtccatgagctcggcggccccgaggtgatgaggtgggaggaggtggagctcggggaccccaaggaaggggagatccgtatcaggaccaccgccatcggcgtcaacttcatcgatgtctatttccggaagggggtctacgccgcgcccgcgctgcccttcaccccaggcatggaagctgttggcgttgtcactgcagttggccctggtctcactggcagaaaagttggggatgttgttgcttacgctggcaaccccatgggatcctatgcccaggagcagatccttccagccagcgttgctgttcctgtgccgccttcagttgatcacaagcaagcagcttcggtcatgctcaagggcatgactgcccatgtcttgcttcgccgtgtattcaaggttgagagtggccacactgtcctggtgcacgctgctgctggtggagttggctcactcctttgtcagtgggcaaatgcacttggtgccactgtcattgggactgtttccaatgaagagaaggcggctcaggcgacccaggatggatgccaccatgtgataatttacacaaaggaagatgttgtggcaagagtcaaggaggttacttctggaaaaggtctgaacgtggtctacgattccgttggaaaggatacatacaaggcttccatagagtgcttggcgccccgcggcttcctggtgtcatttgggcagtcctcaggcaaacctgatccgattccaatgagcgacctggcttccaagtcgctgttcctgactcggcctagcctgatgcattacactgctacccgcgatgagctgctggagtctgctggcgaggtgtttgccaatattgctaacggggtgctgcgcgttcgagtgaaccacacctatctgttgtcggaagctgcccgggcccatgcagatctggagggcaggaagacctctgggtccatagtactcatcccggatacggatagctaggctagggatcggcctcaactcgaatgaagcatggttgggggaacagggtgatgatatgtttcgatctgtttatgttgcatttgttcatgtttgtttctctaaaggaataaatttgccatccttgtgttattggatgatcag

SEQ ID NO: 43379 - protein, 330 aa, Panicum virgatum
  misc_feature: Ceres CLONE 2016380
  misc_feature (142)..(283): Pfam Name: ADH_zinc_N Pfam Description: Zinc-binding dehydrogenase
  misc_feature (30)..(111): Pfam Name: ADH_N Pfam Description: Alcohol dehydrogenase GroES-like domain
  misc_feature: SWISSPROT Homolog: EC 1.6.5.5 NADPH:quinone reductase
MVKAKAIRVHELGGPEVMRWEEVELGDPKEGEIRIRTTAIGVNFIDVYFRKGVYAAPALPFTPGMEAVGVVTAVGPGLTGRKVGDVVAYAGNPMGSYAQEQILPASVAVPVPPSVDHKQAASVMLKGMTAHVLLRRVFKVESGHTVLVHAAAGGVGSLLCQWANALGATVIGTVSNEEKAAQATQDGCHHVIIYTKEDVVARVKEVTSGKGLNVVYDSVGKDTYKASIECLAPRGFLVSFGQSSGKPDPIPMSDLASKSLFLTRPSLMHYTATRDELLESAGEVFANIANGVLRVRVNHTYLLSEAARAHADLEGRKTSGSIVLIPDTDS

SEQ ID NO: 43380 - DNA, 1409 bp, Panicum virgatum
  misc_feature: Ceres CLONE 2016398
  misc_feature: Encodes the peptide sequence at SEQ ID NO. 43381
gctagcaaagtacattcctgatgcttcagctgatggtaacaaggctgataacaaggacccaggggatttgcttgcgggacttgaggggtcctcgtatgaacacacaactcaagttttttttaattcatttaagaaagtctatttattgtattccttatgaggcaacctttggtgtagttttactggaatagcggcatgacataagataaaaatatgcaaatttataacacattttaatttactaagaaaaagaaaacatgtagcatattggattcactttggctgtattgtcctcactatgtgtgtgctgtttggaataataacactgataactgtaattatttttaaacatcaagcggtagcaggccctgactagtgactagaccaaaactgaaacaaccactatactgatttctgcaaaatgaatttgcagccagatgttactttcttctcatcagttttttggcttaaagcatcttaaggtacataaatgttagaaaaaaataggtccaataattttaaaataaccaatagtgcattatttatttcttatagtgaaaacatatttttttatcccttttaattttctttcctcaaggacatctaatcgttaaaacttttgattgacagtggattgccaatatctgaagccctcaagctgcagatggaggtccaaaagcgactgcatgaacagttagaagtacaaaggcagctgcaactgcgtattgaggctcagggaaagtacctccagaagatcattgaagagcagcagcgcttaactggcgtgaaatctgaaactcctgctgcaggtgcttctgtcacagtatcaagtgatcaattccctgactctgagcggactgagccctcgactcctgcgccaacatccgagtctccaactaaagttggcacttccaatagggatactggagaacggactgaagcaaccaagagcacctgtcgtggtgattcactctcccgtcacgagccactgacccctgattccaactgccagaacggcgcgcctcctgctagtccaaaccatgagagggcagcaaagaggcaacgaggcagtggtaatgatttcttggatgccgaggctgatttttcccttactcacaacatcttcgagtcgagttcaggctccgagttccagccgtattcaatgtcctactcaggcaattagcttctgatgctcccatcattgctagcttgttgagcacaatgcgcatgatctgatccatgtctgtaggtctgggtagaatgatgctatctcaaggattgtattgttggtagacagttgtagggggttcagtgattgtttacatgatatacatgacatccacaagtgcttaggtttgtaacatctatgtcccatctgtagttcagtggagatgtattggtggaaggct

SEQ ID NO: 43381 - protein, 52 aa, Panicum virgatum
  misc_feature: Ceres CLONE 2016398
  misc_feature: Functional homolog of the protein sequence given in SEQ ID NO 50243
  misc_feature: Useful for making plants with altered lignin content
  misc_feature: Useful for making plants with altered terpenoid content
LAKYIPDASADGNKADNKDPGDLLAGLEGSSYEHTTQVFFNSFKKVYLLYSL

SEQ ID NO: 43382 - DNA, 703 bp, Panicum virgatum
  misc_feature: Ceres CLONE 2016401
  misc_feature: Encodes the peptide sequence at SEQ ID NO. 43383
aaaacggaacgagaaaaagaggggaggagccggaggaggaaacgaggaaggaggagacggcagccaccgagcgaaaactggaaggggaagagctccactagcgcgtgcgttgcgaggagatgtggcggaggcggctgggagctctccttctccgatctccgccgtcttcctcctccacagccgcctcttcttgccagcatcgccgccgccacctcctccccagcgaggaacctcttgctgtcaatcgtcttgcacggctcttcacgtcccaagctggaagtgatggtggcaattcccagaagccgttcattgctttcgtcttagggggtcctggtagtggcaaaggaacacaatgcaccaaaattgcttcggatttcggatttgcccatttgagcgctggtgaccttctgcgccatgaaatagcatctggcagtgagaaaggggagttgatcctggacaccattaaggaagggaggatcgtcccatcagagataaccgtggaactcataaggaaagctatggaaacgagcaatgccaataaggttcttattgatggcttcccaaggtgtgaggaaaacagaatcgcttttgaaagaattgttggaagagaaccagacgttgtggttttctttgactgtcctgaggatgagatggtaaaacgccttctaggccgtaaccaggggcgggttgatgataacattga

SEQ ID NO: 43383 - protein, 194 aa, Panicum virgatum
  misc_feature: Ceres CLONE 2016401
  misc_feature (67)..(189): Pfam Name: ADK Pfam Description: Adenylate kinase
  misc_feature: SWISSPROT Homolog: EC 2.7.4.3 Adenylate kinase
MWRRRLGALLLRSPPSSSSTAASSCQHRRRHLLPSEEPLAVNRLARLFTSQAGSDGGNSQKPFIAFVLGGPGSGKGTQCTKIASDFGFAHLSAGDLLRHEIASGSEKGELILDTIKEGRIVPSEITVELIRKAMETSNANKVLIDGFPRCEENRIAFERIVGREPDVVVFFDCPEDEMVKRLLGRNQGRVDDNI

SEQ ID NO: 43384 - DNA, 643 bp, Panicum virgatum
  misc_feature: Ceres CLONE 2016402
  misc_feature: Encodes the peptide sequence at SEQ ID NO. 43385
gagcagagccgcgccagcaagtgacacgcgggcaggtcaacgatcctcgcgcctccatggcgtcctcgccctccgcgctcgcgtccgtcgccaaggccgccgccctccccgtccctccgccaccgtcgtcgtccgcgggcgtggcagtggcgcggcggcgcgcgccggtggtggcaaccgtcctgcgcgcctgctcgggcggccacgcgcggcgcggcgcggcgctggtggcggcctccgcgctggaggacctgcgcccggccatggacgagtaccccgagggcgtcctgtccggggagtggcccgggaacttctccctgctcagctacgccgacctccgcgcctacctcgagtcccagatcaccaccgccggcgagatgagcccgacggcgaagctctgggacgtgatgtcgcgccccgtgcaggtggccaggccggggcagcgcctcgcggaggtggacgccttgttcgccgcgcagcagtactccggtctgccggtggtcgacgaggaaggcaggtgcgtcggggtcgtctccaagaaggacgtggccaaagcgccctacgggatagagtcaactgttggtgaagtgatgtcgtcccctgctataactctgacacctgacaagactgtcttggaagctgc

SEQ ID NO: 43385 - protein, 195 aa, Panicum virgatum
  misc_feature: Ceres CLONE 2016402
  misc_feature (49)..(169): Pfam Name: CBS Pfam Description: CBS domain pair
  misc_feature: SWISSPROT Homolog: EC 1.1.1.205 IMP dehydrogenase
MASSPSALASVAKAAALPVPPPPSSSAGVAVARRRAPVVATVLRACSGGHARRGAALVAASALEDLRPAMDEYPEGVLSGEWPGNFSLLSYADLRAYLESQITTAGEMSPTAKLWDVMSRPVQVARPGQRLAEVDALFAAQQYSGLPVVDEEGRCVGVVSKKDVAKAPYGIESTVGEVMSSPAITLTPDKTVLEA

SEQ ID NO: 43386 - DNA, 623 bp, Panicum virgatum
  misc_feature: Ceres CLONE 2016409
  misc_feature: Encodes the peptide sequence at SEQ ID NO. 43387
atttttttctcattctctcgtctctctcatatctcattctctacctctcatctctcccacctctcccatggccttatctctgggagtctgggagcggaggggcgcacgagcgccgccgccgcgggagctgcggagaggggcgcgcgaggcgccgccactgagggagccggccgccgccgccgcggagagggctcggccatccgcatctccgccaccttcgtcccggcggcagcaccccgccaccctggctcctccccggcggcgtcccggcgttcttcccgccgcggcgcggctgtgatgtgaggctgtaccaggacgcacacgtcggggccggcgagctgggcggcgagcccgggcggtgctgggaggagctgtgcctggcggtgctgggcgcgcagcacctcgtctacgtggtgggctggtcggcgttcaccagggtccggctactgcggggcgccatgtcaccggagatggcggccaaggcggccgaggtgagggcgctgggcggcgtggcggtggaggacatgagcctgggcgacctgctcaagtacaagtcccaggagggcgtccgggtgctgctcctcctctgcgacgacaccacctcactcccacacttcttccta

SEQ ID NO: 43387 - protein, 54 aa, Panicum virgatum
  misc_feature: Ceres CLONE 2016409
  misc_feature: SWISSPROT Homolog: EC 3.1.4.4 Phospholipase D
MSPEMAAKAAEVRALGGVAVEDMSLGDLLKYKSQEGVRVLLLLCDDTTSLPHFF

SEQ ID NO: 43388 - DNA, 669 bp, Panicum virgatum
  misc_feature: Ceres CLONE 2016410
  misc_feature: Encodes the peptide sequence at SEQ ID NO. 43389
agccgccattcctcaggcttccaaaccctacccacaccaccccgccgccgccgctcccagctcccgagcaagcagccgccatgccgcccaagttggacccctctcaggtggtggaggtcttcgtccgcgtgacgggcggcgaggtcggcgcggcgtcgtcgctggcccctaagatcggcccgctcggactctccccgaagaagatcggagaggacatcgccaaggagaccgccaaggactggaagggcctccgcgtcaccgtcaagctcaccgtccagaaccgccaggccaaggtctccgtcgtgccctccgccgcggcgctcgtcatcaaggcgctaaaggagcccgagagggacaggaagaaggtcaagaacatcaagcacagcggcaacatcagcctcgatgacgtcatcgagatcgccaggaccatgagggtcaggtccatggccaaggagatggccgggaccgtcaaggagatcctcggcacctgcgtcagcgtcggctgcaccgtcgacggcaaggaccccaaggatctgcagcaggagatcgacgatggggaggtcgaaatcccctccgcgtaaaggacttgttgccgtaagccgctcgaaagccaaattcagcattgatccctgttcattctttatgtattgctttgggattaccaaagct

SEQ ID NO: 43389 - protein, 166 aa, Panicum virgatum; identical to SEQ ID NO: 42960
  misc_feature: Ceres CLONE 2016410
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain

SEQ ID NO: 43390 - DNA, 727 bp, Panicum virgatum
  misc_feature: Ceres CLONE 2016422
  misc_feature: Encodes the peptide sequence at SEQ ID NO. 43391
attgccagcagtgctctgatctcgtgtagcaccaactatctagcagctagtcagtagttgtagtttgcagtaaccgcgtaggtcgacgcaggccaccatgccggggctcaccatcggcgacaccatccccaacctggagctggactccacccagggccggatccgcatccacgacttcgtcggcgacggctacgccatcatcttctcccaccccgccgacttcacgccggtgtgcacgacggagatggcggcgatggcggggtacgcccaggagttcgagaagcgcggcgtgaagctgctgggcatctcctgcgacgacgtggcgtcccacaaggagtggatcaaggacatcgaggccttcatgccgggggcgaagctgacgtacccgatcatggcggacccggaccggcgggccatcaaggagctcaacatggtggacccggacgagaaggacgcgcgcggggtgagcctgccctcccgcacgctccacatcgtggggcccgacaaggcggtgaagctgagcttcctgtacccggcgtgcacggggcggaacatggacgaggtgctccgcgccgtcgactcgctgctgacggccgccacgcacaaggggaaggtggccaccccggccaactggaagcccggcgaccgcgccgtcatcgggcccagcgtctccgacgaggaggccaggaagctgttcccggacggcttcgagaccgccgacctgccc

SEQ ID NO: 43391 - protein, 209 aa, Panicum virgatum
  misc_feature: Ceres CLONE 2016422
  misc_feature (6)..(142): Pfam Name: AhpC-TSA Pfam Description: AhpC/TSA family
  misc_feature: SWISSPROT Homolog: EC 1.11.1.15 Peroxiredoxin
MPGLTIGDTIPNLELDSTQGRIRIHDFVGDGYAIIFSHPADFTPVCTTEMAAMAGYAQEFEKRGVKLLGISCDDVASHKEWIKDIEAFMPGAKLTYPIMADPDRRAIKELNMVDPDEKDARGVSLPSRTLHIVGPDKAVKLSFLYPACTGRNMDEVLRAVDSLLTAATHKGKVATPANWKPGDRAVIGPSVSDEEARKLFPDGFETADL

SEQ ID NO: 43392 - DNA, 567 bp, Panicum virgatum
  misc_feature: Ceres CLONE 2016426
  misc_feature: Encodes the peptide sequence at SEQ ID NO. 43393
atttcaaggattttgaggattgcagtagcgaggaggaggtagattttggacatgaggaaaaagaattccaattgaacagttcgaatttcgtggaattcaatggccatactgccaaagtcaccagcaggaagcgaaagatccagtaccgagggatccggcggcggccttggggcaaatgggcagcagaaatcagagacccacagaagggcgtccgagtttggcttggcacgttcagcactgccgaggaagctgcaagggcatatgacgtggaagctctacgcatacgtggcaagaaagccaagatgaatttccctaccaccatcacagctgctgggaaacaccaccggcagcgtgtggctcgaccggcaaagaagacgtcacaagagagcctgaagtcaagcaatgcctctggtcatgtcatctcagcaggcagcagtactgatggcaccgttgtcaagatcgagttgtcacagtcaccagcttctccactaccagtgtccagcgcatggcttgatgcttttgagctgaagcagcttggtggagaaacccctgaagctgatgggagag

SEQ ID NO: 43393 - protein, 188 aa, Panicum virgatum
  misc_feature: Ceres CLONE 2016426
  misc_feature (46)..(97): Pfam Name: AP2 Pfam Description: AP2 domain
  misc_feature: Functional homolog of the protein sequence given in SEQ ID NO 50225
  misc_feature: Useful for making plants with altered lutein content
  misc_feature: Useful for making plants with modulated biomass
  misc_feature: Useful for making plants with modulated flowering time
FKDFEDCSSEEEVDFGHEEKEFQLNSSNFVEFNGHTAKVTSRKRKIQYRGIRRRPWGKWAAEIRDPQKGVRVWLGTFSTAEEAARAYDVEALRIRGKKAKMNFPTTITAAGKHHRQRVARPAKKTSQESLKSSNASGHVISAGSSTDGTVVKIELSQSPASPLPVSSAWLDAFELKQLGGETPEADGR

SEQ ID NO: 43394 - DNA, 576 bp, Panicum virgatum
  misc_feature: Ceres CLONE 2016432
  misc_feature: Encodes the peptide sequence at SEQ ID NO. 43395
gggttcaagctccccgtgccgtggctgcagccgcggatgtccttcgcgggccgcgccggcacccacttcgtcgacgccggcaccggcgcgccgctctacgtcaacggctggaactcctactggctcctttcggctcggtcgcccgcgctggccgccgagatgctgcgccgcggccggcgcatggggctcacggtctgccgcacgtgggccttcagcgacggcgggcccggcgcgctccagatctcccccggccggttcagcgagcccgtcttccagatgctggattatgtgatatatgaggcccgaagaaatcatattagattgattctatgccttgtcaataaccttgataactttggagggaaggctcaatatgttcagtgggcacaagcagctggtgctaatgtgatgaattctacagattcctttttctctcacccaactattagacgttactacaaggagtatgtaaaggtgatattaacaagaagaaattcttatagtggaatcaaatactgtgatgaacctgctatatttgcttgggaactcataaatgagcctaggcttggatagaag

SEQ ID NO: 43395 - protein, 190 aa, Panicum virgatum
  misc_feature: Ceres CLONE 2016432
  misc_feature: SWISSPROT Homolog: EC 3.2.1.78 Mannan endo-1,4-beta-mannosidase
GFKLPVPWLQPRMSFAGRAGTHFVDAGTGAPLYVNGWNSYWLLSARSPALAAEMLRRGRRMGLTVCRTWAFSDGGPGALQISPGRFSEPVFQMLDYVIYEARRNHIRLILCLVNNLDNFGGKAQYVQWAQAAGANVMNSTDSFFSHPTIRRYYKEYVKVILTRRNSYSGIKYCDEPAIFAWELINEPRLG

SEQ ID NO: 43396 - DNA, 663 bp, Panicum virgatum
  misc_feature: Ceres CLONE 2016439
  misc_feature: Encodes the peptide sequence at SEQ ID NO. 43397
gtcccgtcccgctcgccgcagccttcctctcgttcccgtggcgttcgctcgctctctcgcgtcgccgctggcgcccggcgctcccgcctccgccgatccgcgcatgccgagggcccaggcccggcggcgctcgggccaaggggatccagcgagggagggagcacgcgcggcggcggaggaggaaggcggtcggcaccgtctcgaggaagagatggggctctcgttcgggaacctgctcccccgcctcgtcgacgagaaggagatgaggatcctcagtgggcgggcttgatgccgccggcaagaccacgcatcctcgtacgagctcgagctcggcgagatcgtcactaccatccccacgatcggattccacggtgagactgtcaagaacaacaacattagctttgcggtgtgggatggtggcggccaggaccagatcgggcccgtgtggaggcactacttccagagcgcgcacgggctgatttttgttgtggatctcaatgacaaggagcgtgttgttgaggcgagggaggagctccgctcgatgctgaatgaggatgagctgcgtgatgctgcgatgctggtgtctgcaaacaaaggatatcttgcccatgctacgaatgctgctgaaattactgacaagcttgacctgcgttcattgcgcca

SEQ ID NO: 43397 - protein, 40 aa, Panicum virgatum
  misc_feature: Ceres CLONE 2016439
  misc_feature: Functional homolog of the protein sequence given in SEQ ID NO 50150
  misc_feature: Useful for making plants with altered alkaloid content
  misc_feature: Useful for making plants with altered lignin content
MLNEDELRDAAMLVSANKGYLAHATNAAEITDKLDLRSLR

SEQ ID NO: 43398 - DNA, 601 bp, Panicum virgatum
  misc_feature: Ceres CLONE 2016446
  misc_feature: Encodes the peptide sequence at SEQ ID NO. 43399
accaccaaccactacaagcggaagcgagcggcggcggcggcggcgatgtcgggcaggggcaagggcggcaagggtctcgggaagggcggcgcgaagcgtcaccggaaggtgctccgcagatttcgtctcctcaggggcggatccaacgtgggaccccgaacccgacggtcgccgccgcctgctcgccgtccggccgtcggccgccgctcgcctcccctcccctcgcctccccaggcctgcgcctcccggctcccgccgtccgtcgagccgccaacgccacctcgggagcggtcgcgctggccagcggcaccgcctctcctcctaccgcctgccctcccctcctctccgaccagatccacctattctaactcggaggaactgctacgccgccactgggcggccggccactcctggttggagaccggcaaaatggtttatcactctagttttgttgatgatgatagcatcaccaaagcttgtggctgtcctttgcttccactaaaaactcatataaagggtccagcccccacctctgagccagataaagcggacatagttgatgaagccataaccttctttcgagcaaatgttttcttcaaaa

SEQ ID NO: 43399 - protein, 57 aa, Panicum virgatum
  misc_feature: Ceres CLONE 2016446
  misc_feature (1)..(57): Pfam Name: P21-Arc Pfam Description: P21-ARC (ARP2/3 complex 21 kDa subunit)
MVYHSSFVDDDSITKACGCPLLPLKTHIKGPAPTSEPDKADIVDEAITFFRANVFFK

SEQ ID NO: 43400 - DNA, 681 bp, Panicum virgatum
  misc_feature: Ceres CLONE 2016452
  misc_feature: Encodes the peptide sequence at SEQ ID NO. 43401
aacgccacgcatcaacgagatggccatggcgaggcggaggcttctcgcgctcgcgtcccagctccagaggagggctccagcgccgccggcgacgcagccgtggcggcgcgccacgccccggctcctctcctcagcggcgtccggccccctcgaccgcctgaagacgccgcctttcgcgcgcccagcgcccaggaaccccgcctcctctccatgggatcgattcggaggagggcaaagaggaccatgttcatccagacacaatccactccaaacccacagtcgctcatgttctatcccggaaagccagttatggaggtcgggagctctgatttcccaaatgctcggaccgcgatgacatcccctttggctaaggcactgtttgcgatcgatggtgtaaccagggtattctttggatctgattttgtaactgttacaaaatcagaagaaacttcttgggattaccttaaacctgaggtttttgctgcgataatggatttttactcatctgggcaaccactttttctagactcaaatgctgcagctgctatggacacagcaattcatgaggatgattcagaaatagttgccatgataaaggaattgttggagactcgcattcggccagctgttcaagatgatggtggtgacattgaataccaaggatttgatccagaaacagga

SEQ ID NO: 43401 - protein, 156 aa, Panicum virgatum
  misc_feature: Ceres CLONE 2016452
  misc_feature (14)..(100): Pfam Name: Nfu_N Pfam Description: Scaffold protein Nfu/NifU N terminal
MGSIRRRAKRTMFIQTQSTPNPQSLMFYPGKPVMEVGSSDFPNARTAMTSPLAKALFAIDGVTRVFFGSDFVTVTKSEETSWDYLKPEVFAAIMDFYSSGQPLFLDSNAAAAMDTAIHEDDSEIVAMIKELLETRIRPAVQDDGGDIEYQGFDPET

SEQ ID NO: 43402 - DNA, 482 bp, Panicum virgatum
  misc_feature: Ceres CLONE 2016464
  misc_feature: Encodes the peptide sequence at SEQ ID NO. 43403
aacactggcgcactccacttgtactgttgcctctcgatcggtctcggcagctcaacgccggctagaatccccccctagctcgccgccggctgctccaccactctagcaggctgaagccggccatgggctccaccgccaccgacgtgaccgcggcctcggacgaggaggcatgcatgtacacgctgcaactggcgccttcgtccatcctgcctatgacgctcaagaactgcatcgagctgggcctgctggaggtgctccagaaagaccccggagcggcgctggccctggaggatgtggtggcgcgactgcccgtgactcccactaaccccaaagcgtccaccatggtcgaccgcatgctgcgcttgatcgcctccgacgaattcttcgggtgctagaaggaggaggccaaggactgcacgcactcacgccgctacgcctccgcgaccgtctgcagttggctgcacccccaacaaatacggcgt

SEQ ID NO: 43403 - protein, 90 aa, Panicum virgatum
  misc_feature: Ceres CLONE 2016464
  misc_feature (31)..(83): Pfam Name: Dimerisation Pfam Description: Dimerisation domain
  misc_feature: SWISSPROT Homolog: EC 2.1.1.68 Caffeate O-methyltransferase
  misc_feature: Functional homolog of the protein sequence given in SEQ ID NO 51671
  misc_feature: Useful for making plants with altered carbohydrate content
MGSTATDVTAASDEEACMYTLQLAPSSILPMTLKNCIELGLLEVLQKDPGAALALEDVVARLPVTPTNPKASTMVDRMLRLIASDEFFGC

SEQ ID NO: 43404 - DNA, 695 bp, Panicum virgatum
  misc_feature: Ceres CLONE 2016471
  misc_feature: Encodes the peptide sequence at SEQ ID NO. 43405
aagccggctgtcggggcccgcggcaactacaccgccacaccctcggcctccgacgcctacagctccggcggctggctgtccgccggcgcgacgtactacggcgcccccaacggcgacggcagtgacggcggcgcatgcggctaccagaccgccgtcgggcagcagcccttctcgtcgatgatcgccgccgggagcccgtcgctgttcaagggcggcaagggatgcggcgcctgctacgaggttaaatgcgacagcaacccggcgtgctccgggcagccggcgaccgtggtcatcaccgacgagtgccccggcatggccgacaggcttcgcgccgccggtatcctcaagatccagtacaagagggtgccgtgcaagtacagcggcgtgaacatcgccttccgggtggaccagggctccaacccgttctacttggaggtgctggtcgagttcgaggacggcgacggcgacctcagcgccgtcgacctgatggaggccgggtgcggcacctggacgccgatggtgcagaactggggcgccctgtggcgctacaactccaacaccggcaaggcgctgcgggcgcccttctcgctccggctgacctccgactccggcaaggtcctcgtcgccaacaacgtcatccccgccggctggaaggccggagccacgtaccgctccttggtgaactactcctaatt

SEQ ID NO: 43405 - protein, 230 aa, Panicum virgatum
  misc_feature: Ceres CLONE 2016471
  misc_feature (131)..(214): Pfam Name: Pollen_allerg_1 Pfam Description: Pollen allergen
  misc_feature (61)..(119): Pfam Name: DPBB_1 Pfam Description: Rare lipoprotein A (RlpA)-like double-psi beta-barrel
KPAVGARGNYTATPSASDAYSSGGWLSAGATYYGAPNGDGSDGGACGYQTAVGQQPFSSMIAAGSPSLFKGGKGCGACYEVKCDSNPACSGQPATVVITDECPGMADRLRAAGILKIQYKRVPCKYSGVNIAFRVDQGSNPFYLEVLVEFEDGDGDLSAVDLMEAGCGTWTPMVQNWGALWRYNSNTGKALRAPFSLRLTSDSGKVLVANNVIPAGWKAGATYRSLVNYS

SEQ ID NO: 43406 - DNA, 640 bp, Panicum virgatum
  misc_feature: Ceres CLONE 2016473
  misc_feature: Encodes the peptide sequence at SEQ ID NO. 43407
ctctttttcatacatctcaatatggctcctaccaagaagtccactggtaagaaggtcgctccttctccctatcctgtcaagggaaagcaaaccaccaaggctgctgccaaccctttgcttgaaaagacccccaagaactttggtgtcggtcaagatgttcaacccaagcgtgatgtctctcgtttcgtcaagtggcctcaatatgtcaagcttcaacgtcaaaagaagatcatctaccaacgtcttaaggtccctcctgctcttaaccaattcacccacgttttggataagaacactgccactcaagtcttcaagttgatgcacaagtacagacccgagtccaagaacgagaagcgtgatcgtctccgtgctgctgctcttgccaagtccgagaagaaggaagttgccaagactgacaagcctgttgtcatcaagtacggtatcaaccacatcactgctttggttgaagccaagaaggcccaattggttgtcattgctgatgatgttgaccccattgaattggttctctggctccctgctctttgccgtaagatgggtgtcccttactgtattgttaagggtaaggctcgtctcggtacactcgtccacaagaagactgccactgctctcgctttgactg

SEQ ID NO: 43407 - protein, 206 aa, Panicum virgatum
  misc_feature: Ceres CLONE 2016473
  misc_feature (121)..(204): Pfam Name: Ribosomal_L7Ae Pfam Description: Ribosomal protein L7Ae/L30e/S12e/Gadd45 family
MAPTKKSTGKKVAPSPYPVKGKQTTKAAANPLLEKTPKNFGVGQDVQPKRDVSRFVKWPQYVKLQRQKKIIYQRLKVPPALNQFTHVLDKNTATQVFKLMHKYRPESKNEKRDRLRAAALAKSEKKEVAKTDKPVVIKYGINHITALVEAKKAQLVVIADDVDPIELVLWLPALCRKMGVPYCIVKGKARLGTLVHKKTATALALT

SEQ ID NO: 43408 - DNA, 1463 bp, Panicum virgatum
  misc_feature: Ceres CLONE 2016508
  misc_feature: Encodes the peptide sequence at SEQ ID NO. 43409
gcgtgagcccaagcacaactccttcaaagccctagctactaccaacaccgcccgcctccaccatccccacgcagccgttgctgtcccttccggcagcctcgagaacctcccccattccccttcccctccgcctcgccgacggggcctccctccgctccgctccgcaccctcccctcaccgccgacgcacgcacccgcgcggcgccgcccgtcgactcggatcgaggcgttagggatggcgagtctgaccggcctcaccgcgaaccctaacccgaacaagtcattcgagatccagcccaacccgggcgactccgtctcgagcctcagcttcagccccaagagcaatctgctggtggcaacctcctgggataaccaggtgaggtgctgggagattgttggcgggaacagtcagcccaaggtgtccatatcgcatgatcagccggtcctctgctcagcttggaaggatgatggaacaactgtcttctctggaggctgtgacaagcaggtcaaaatgtggcctctgctgtcaggcgggcagcctcagacggttgcgatgcatgatgcgcctgtcaaggaggtcgcgtggattcctcagatgaatcttcttgtctctggaagctgggataagactctgaggtactgggacacaaggcaagcaaatcctgtgcatatccagcaacttccagagcgttgctatgctcttacagtgaattatccccttatgattgtgggaactgctgatcgtaatcttgtagtcttcaacttgcagaatcctcagacggagttcaagcgtattcaatcaccgctaaaataccagacacggtgtcttgctgcattccctgatcagcaaggatttctggttggctccatggaaggaagagttggtgttcaccatatcgatgattcacaacaaagcaagaatttcaccttcaaatgtcacagggaaggaaatgatatattctctgtcaattcactgaacttccaccctgtccatcacacatttgcaactgctggatctgatggtgctttcaacttctgggataaggacagcaagcagaggctgaaggcttttagtagatgccctcttcccatttcttgcagcacctttaacagtgatggttccatatttgcttacgcggtctgctatgattggagccgtggggctgaaaaccacaatcctgcagctgcaaagacatccatctacctccacagtccacaggattctgaggtcaaaggaaagccgcggattgcaacaggcaggaagtgatttggttccaacttgcgggatccattcgtctttaggccagtcaccagttttgttatgccccctcctgcattggaagtctggtagatgtaaatttcagggtacctgtagcgtctaggcactgaatatagggatcccgtttcaagatttggatccaacaccgtattcgaattcgatccggtctgaaaaggtttttatcc

SEQ ID NO: 43409 - protein, 343 aa, Panicum virgatum
  misc_feature: Ceres CLONE 2016508
  misc_feature (99)..(137): Pfam Name: WD40 Pfam Description: WD domain, G-beta repeat
  misc_feature (14)..(52): Pfam Name: WD40 Pfam Description: WD domain, G-beta repeat
  misc_feature (57)..(95): Pfam Name: WD40 Pfam Description: WD domain, G-beta repeat
  misc_feature: SWISSPROT Homolog: EC 2.3.1.48 Histone acetyltransferase
MASLTGLTANPNPNKSFEIQPNPGDSVSSLSFSPKSNLLVATSWDNQVRCWEIVGGNSQPKVSISHDQPVLCSAWKDDGTTVFSGGCDKQVKMWPLLSGGQPQTVAMHDAPVKEVAWIPQMNLLVSGSWDKTLRYWDTRQANPVHIQQLPERCYALTVNYPLMIVGTADRNLVVFNLQNPQTEFKRIQSPLKYQTRCLAAFPDQQGFLVGSMEGRVGVHHIDDSQQSKNFTFKCHREGNDIFSVNSLNFHPVHHTFATAGSDGAFNFWDKDSKQRLKAFSRCPLPISCSTFNSDGSIFAYAVCYDWSRGAENHNPAAAKTSIYLHSPQDSEVKGKPRIATGRK

SEQ ID NO: 43410 - DNA, 685 bp, Panicum virgatum
  misc_feature: Ceres CLONE 2016510
  misc_feature: Encodes the peptide sequence at SEQ ID NO. 43411
accaccaacgaaacactcgggccggagcagcaacttctcgaagtcagcaacgaaacaattcccgctccaattctgggggcatgggctccaacggccacccgctggcggcgagcgtcgccgcgcagaacgggtcccactccggcggcggcggcggcggagggggaggcggagggggcgcgaaccctagcaacggcggcacggcggcggcgctccggcacgacccgggcctggcgcgggagtggtcgccggaggagcaggccaccctcgacgagctgctcgccaagtatgcatctgatgcgcctgtcattcgttatgcaaagatagccatgaaattgccagagaaaacagttcgggatgtagccttgcgctgcagatggatgaataaaaaagagagtggcaaaagaaagaaagacgaccacaactcgtctaagaaaagcaaggataaaaaggagaaggtttcagattcttcatccaaaccacctgtacacatggccggtaggcctaacgttgctccataccctctcccagttcttcccatggacgatgatgaaatctcagccaaagctattggaggcccaacaggagaaatccttgagactattgcgcatgttttgagtcaaatctcgacaaatcttaccaatatgcagatacaagataacatctcactgttgtgccaaacgcgggg

SEQ ID NO: 43411 - protein, 201 aa, Panicum virgatum
  misc_feature: Ceres CLONE 2016510
  misc_feature: Functional homolog of the protein sequence given in SEQ ID NO 50581
  misc_feature: Useful for making plants with altered lignin content
MGSNGHPLAASVAAQNGSHSGGGGGGGGGGGGANPSNGGTAAALRHDPGLAREWSPEEQATLDELLAKYASDAPVIRYAKIAMKLPEKTVRDVALRCRWMNKKESGKRKKDDHNSSKKSKDKKEKVSDSSSKPPVHMAGRPNVAPYPLPVLPMDDDEISAKAIGGPTGEILETIAHVLSQISTNLTNMQIQDNISLLCQTR

SEQ ID NO: 43412 - DNA, 1017 bp, Panicum virgatum
  misc_feature: Ceres CLONE 2016515
  misc_feature: Encodes the peptide sequence at SEQ ID NO. 43413
agcacctccgtgtgctcctctggatttctcttccgctgcccccgaactcctcgtgcgcctcgcgggacgaagacgacaagagggcgagggcgaggggggccgatcgcgatcgccagcgcgcacccatgtcgacgtcgcggaggcgaaccctcctcaaggtcatcgtcctcggcgacagcggggtcgggaagacgtccctgatgaaccaatatgtccacaaaaagttcagtcagcagtacaaagctacaattggtgcagatttcgtcacaaaggaggttctcattgaagacaggctagtgactttgcagatctgggacacggcagggcaggagagatttcagagtcttggtgttgcgttctatagaggggcagattgttgtgtgcttgtctatgatgtcaactctaacaggtcattcaatacactcaacacatggcatgatgagtttctcaaccaagctagcccatcagatcctaaaactttccctttcatcttacttggtaacaacattgacgtagatggtggaaaaagcagagtggtttctgagaagaaagcaatggagtggtgtgcttccaaaggcaatattccttattatgaaacttctgcaaaagaggactacaatgttgacaatgcattcctgtccgttgccaagcttgctctagagcatgagcgtgatcaggacatctacttccaggccgttgctgatcctgtcccggagactgaaccgagaagtggatgtgcatgctagtatagttattcatcatccttattttccagatttttcttattggttgcggcattcttttcaagtgatgtcgagcaggcattctttcaagtgatgctggggcaggcattcttttagttttggaatgtaactgatgttccagccatccgactctcgcttttgtagccattgtaccatagttagcggccatggctttttgtacacgttataccgagtggtggccggccctgtttcttggtttgggcaataagaatgcagaggaccagaggtggac

SEQ ID NO: 43413 - protein, 206 aa, Panicum virgatum
  misc_feature: Ceres CLONE 2016515
  misc_feature (11)..(179): Pfam Name: Ras Pfam Description: Ras family
  misc_feature (11)..(129): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50193
  misc_feature: Useful for making plants with modulated water use efficiency
MSTSRRRTLLKVIVLGDSGVGKTSLMNQYVHKKFSQQYKATIGADFVTKEVLIEDRLVTLQIWDTAGQERFQSLGVAFYRGADCCVLVYDVNSNRSFNTLNTWHDEFLNQASPSDPKTFPFILLGNNIDVDGGKSRVVSEKKAMEWCASKGNIPYYETSAKEDYNVDNAFLSVAKLALEHERDQDIYFQAVADPVPETEPRSGCAC

SEQ ID NO: 43414 - DNA, 1143 bp, Panicum virgatum
  misc_feature: Ceres CLONE 2016516
  misc_feature: Encodes the peptide sequence at SEQ ID NO. 43415
aattgcttcctccccgttccgtcctcccggctagtctccgctccgcctccagaaagatgtcggcggcgacggaggtggcgccggttcagcagcggggccatgcgacggcggcggtttggcgggcggtgtcggggtggctcggtctgctcttccagatcctgctccggatcgtccgcggcacgccctcctcctgggcgcagctgctctccttcgtcggcctccgccacccgctcctcccagtcgccgcccaggcgcaacctgaggtggccttcgtgcagctcccctccgaggcccccgctgacacctcgcctccgccgctcaggcggctcacggtggtgcttgacttggatgaaactctagtttgtgcttatgaatcatctagccttcctgcgactctgcgcacccaggctgttgaagcaagattgcattgctttgacatggaatgcgcgtcgcctgaaaaggatgctgaaggaaggcagagggtaaatcgtgtaactgtcttcgaacgtcctggtttgcatgagtttttgcagcgaactagcgaatttgctgaccttgttctctttacagctggtttggaaggctatgcaaagcctctagttgacaggatagatgctcacaacagattcattcgccgtctgtatcgtccatctactgttactacggaatacagagagcatgttaaagatctttcttgtttatccaaagatttccggagaattgtccttgttgataacaatccatacagtttcttattgcagccattgaatggaataccttgtattacattttcagctggacaacctgttgatgatcagcttatgggaacaatattcccgcttctcaagcacctttctctgcaaaaagatgttaggcctgcattatatgaaacgtttcacatgccagagtggttccaaggacaaggaatcccacaaattgaacaggcagtttaggaattctgagtgacacaaattggattattggaaggctcaagacagccgagcaacttatgagaatgcttggacaatctgtatagatgcatgaagaatctgttcaatgagacctaggaaagagataaaattgaattgtaatttagcacaattatagacctttattggtgatgtgattaatttatccttgcat

SEQ ID NO: 43415 - protein, 298 aa, Panicum virgatum
  misc_feature: Ceres CLONE 2016516
  misc_feature (82)..(278): Pfam Name: NIF Pfam Description: NLI interacting factor-like phosphatase
  misc_feature: SWISSPROT Homolog: EC 3.1.3.16 Phosphoprotein phosphatase
MSAATEVAPVQQRGHATAAVWRAVSGWLGLLFQILLRIVRGTPSSWAQLLSFVGLRHPLLPVAAQAQPEVAFVQLPSEAPADTSPPPLRRLTVVLDLDETLVCAYESSSLPATLRTQAVEARLHCFDMECASPEKDAEGRQRVNRVTVFERPGLHEFLQRTSEFADLVLFTAGLEGYAKPLVDRIDAHNRFIRRLYRPSTVTTEYREHVKDLSCLSKDFRRIVLVDNNPYSFLLQPLNGIPCITFSAGQPVDDQLMGTIFPLLKHLSLQKDVRPALYETFHMPEWFQGQGIPQIEQAV

SEQ ID NO: 43416 - DNA, 666 bp, Panicum virgatum
  misc_feature: Ceres CLONE 2016517
  misc_feature: Encodes the peptide sequence at SEQ ID NO. 43417
atggttctaaacaacacgaacaacccaagaaaaactttacgcaaccgtgaacaatgtgcggaggcgccatcctcgcggagctgatcccgccgccgcggcgcgcggcggcgtcgaagtcgaagccggtgaccgcgggccacctctggccggcgggctccgatcccaagaaagccagcggcgcaaggaacaagaggccccaccacatcgatgactttgaggccgccttcgaggacttcgacgacgaatttgacgtggaggaagacgaggacgaggtgaagaaggaccaccgcttcgtgttctcggccaaatccacattctctccagtagcccacggcgcgagctcgaagaagcgcgggcgccgccacttccgcggcatcaggcagcggccatggggcaagtgggcggcggagatccgcgacccgcacaagggcacccgcgtctggctcggcaccttcgactccgccgaggacgccgcccgtgcctacgacgtcgaggctcgccgcctccgcggcaccaaggccaagctcaacttccccgccatgtccggcgctcgaccacgccgcggcaacccaccaagaaccgcgccgaagccgcagcaccatgccgcagcgcagcccaagaggcaggaggagatcgccgtgaagcccgagatcactgagtcgttcg

SEQ ID NO: 43417 - protein, 204 aa, Panicum virgatum
  misc_feature: Ceres CLONE 2016517
  misc_feature (103)..(154): Pfam Name: AP2 Pfam Description: AP2 domain
  misc_feature: Functional homolog of the protein sequence given in SEQ ID NO 50249
  misc_feature: Useful for making plants with altered lignin content
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Functional homolog of the protein sequence given in SEQ ID NO 50227
  misc_feature: Useful for biocontainment applications
MCGGAILAELIPPPRRAAASKSKPVTAGHLWPAGSDPKKASGARNKRPHHIDDFEAAFEDFDDEFDVEEDEDEVKKDHRFVFSAKSTFSPVAHGASSKKRGRRHFRGIRQRPWGKWAAEIRDPHKGTRVWLGTFDSAEDAARAYDVEARRLRGTKAKLNFPAMSGARPRRGNPPRTAPKPQHHAAAQPKRQEEIAVKPEITESF

SEQ ID NO: 43418 - DNA, 615 bp, Panicum virgatum
  misc_feature: Ceres CLONE 2016532
  misc_feature: Encodes the peptide sequence at SEQ ID NO. 43419
ccccccccccccccccacggtgaggcggaggagatggcgaggcacttcgtgctcaacaccggcgccgagatcccttcggtggggctcggcacctggcagtccaagcctgacgacgtaggcgactccgtctacgccgctgtcaaggcagggtaccggcacatcgattgtgccagggcttaccgcaacgagaaggagattggtttggctctgcaaaagctgttcgaagagggtgtagtgaagcgtgaagacttgtttatcacctctaagctatggcatgatcatcatgctccagaagatgtgccagagtcgctaggcaaaagcctgaacgacttgcagcttgagtacttggatctttaccttatccattggccatttagactcaagaaggggactgactggagtaaccctgaaaactttgtcccacctgacatccctgctacttggggagcaatggaaaagttatatgatactggcaaagctcgtgcaatcggtgtgagtaacttctcaacaaagaaactgggtgaccttcttgctgtagctcgtataccacctgctgttaatcacgtggaatgccgtccgggttggcagcaaacttaagctccataacttctgtca

SEQ ID NO: 43419 - protein, 187 aa, Panicum virgatum
  misc_feature: Ceres CLONE 2016532
  misc_feature (7)..(187): Pfam Name: Aldo_ket_red Pfam Description: Aldo/keto reductase family
  misc_feature: SWISSPROT Homolog: EC 1.1.1.21 Aldehyde reductase
MARHFVLNTGAEIPSVGLGTWQSKPDDVGDSVYAAVKAGYRHIDCARAYRNEKEIGLALQKLFEEGVVKREDLFITSKLWHDHHAPEDVPESLGKSLNDLQLEYLDLYLIHWPFRLKKGTDWSNPENFVPPDIPATWGAMEKLYDTGKARAIGVSNFSTKKLGDLLAVARIPPAVNHVECRPGWQQT

SEQ ID NO: 43420 - DNA, 692 bp, Panicum virgatum
  misc_feature: Ceres CLONE 2016536
  misc_feature: Encodes the peptide sequence at SEQ ID NO. 43421
tattcaacatgatgactttcaagactatgacaacatttatgcctccaccaccggcagcaacttttcttgcatttcaccctcaagataacaatataattgcaattggaatggacgattcgaccatccaaatctacaatgtccgaattgatgaggtcaaaagcaagcttagaggtcactctaaaagaatcacgggtcttgccttttcaaatgttttaaatgtgttggtctcttctggagctgatgcacagttgtgtgtttggaacaccgatggatgggagaagcaaaagaacagatttttgcagataccatcaggtcgcccatccaacatcctagacactcgtgttcagttccaccaagatcagatgcacttccttgttgtgcatgaaacccagattgccatctatgatactacaaagctagaaccggtgaagcagtggcctgttcgagagaattcacctccaataacacatgccacattctcgtgtgatagtcaactgatctatgcaagctttatggatgctactgttggtatatttaatgcatcgagtttgagactccaatgtcgaattcttccagcttcatatcttcctccaaacatcagttcaagtgttcatcctgttgtggttgcggcacacccttcggaagcaagccagtttgctctaggattgacagatggtggtgtttatgtattt

SEQ ID NO: 43421 - protein, 229 aa, Panicum virgatum
  misc_feature: Ceres CLONE 2016536
  misc_feature (49)..(87): Pfam Name: WD40 Pfam Description: WD domain, G-beta repeat
  misc_feature: SWISSPROT Homolog: EC 2.3.1.48 Histone acetyltransferase
FNMMTFKTMTTFMPPPPAATFLAFHPQDNNIIAIGMDDSTIQIYNVRIDEVKSKLRGHSKRITGLAFSNVLNVLVSSGADAQLCVWNTDGWEKQKNRFLQIPSGRPSNILDTRVQFHQDQMHFLVVHETQIAIYDTTKLEPVKQWPVRENSPPITHATFSCDSQLIYASFMDATVGIFNASSLRLQCRILPASYLPPNISSSVHPVVVAAHPSEASQFALGLTDGGVYV

SEQ ID NO: 43422 - DNA, 701 bp, Panicum virgatum
  misc_feature: Ceres CLONE 2016545
  misc_feature: Encodes the peptide sequence at SEQ ID NO. 43423
accactcaacaagctaagcaagcttcagaagcgagtgccgcggcatagcattctgagagctgagctatcggcatggcgaaggacatcgaggcgtcggggcccgagaccggcgagttctcggccaaggactacacggaccccccgccggcgccgctgatcgacgcggaggagctgaccaagtggtcgctgtaccgcgcggtcatcgccgagttcatcgcgacgctgctcttcctctacatcaccgtggccaccgtgatcgggtacaagcaccagacggacgcggcggcgtcgggccccgacgcggcgtgcggcggcgtgggcgtcctcggcatcgcgtgggccttcggcggcatgatcttcatcctcgtctactgcaccgccggcatctcgggcgggcacatcaacccggccgtcaccttcggcctgttcctggcgaggaaggtgtcgctggtgcgcgcgctgctctacatcgtggcgcagtgcctcggcgccatctgcggcgtggggctcgtcaagggcttccagagcgcctacttcgtgcgctacggtggcggcgccaacgagctcagcgacggatactccaagggcacggggatcgccgccgagatcatcggcaccttcgtgctcgtctacaccgtcttctccgccaccgaccccaagcgccacgcccgcgactcccacgtcccggtgttggctcctct

SEQ ID NO: 43423 - protein, 209 aa, Panicum virgatum
  misc_feature: Ceres CLONE 2016545
  misc_feature (33)..(209): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
MAKDIEASGPETGEFSAKDYTDPPPAPLIDAEELTKWSLYRAVIAEFIATLLFLYITVATVIGYKHQTDAAASGPDAACGGVGVLGIAWAFGGMIFILVYCTAGISGGHINPAVTFGLFLARKVSLVRALLYIVAQCLGAICGVGLVKGFQSAYFVRYGGGANELSDGYSKGTGIAAEIIGTFVLVYTVFSATDPKRHARDSHVPVLAP

SEQ ID NO: 43424 - DNA, 644 bp, Panicum virgatum
  misc_feature: Ceres CLONE 2016553
  misc_feature: Encodes the peptide sequence at SEQ ID NO. 43425
acggatccaaaggaaggctcggctcctctctcgcggcggcggcgcacccctcttctccatctccggcaaggcatttggcatctgacctcaacagcaagcaaatggcaggtggcagggttgcacatgccaccctcaagggcccgagcgtggtgaaggagatcttcattggagtcaccctcgggctgattgccggtggcatgtggaagatgcaccactggaacgagcagaggaagactagatccttctacgacatgctggacaagggccagatcagcgttgttgtcgaggagtagctttcacgcgccaagtctgaagttattttctcacagttgtttctgaaactctggagagcatgatgaagtgaatgctgtggagatttgtcttgaaaaataagcataaccatttgaggacaccagattttgttgaatttccttccgtttcatgaatattagaacatgtccaggtcataccgatcaactgaaaaaaaaaaaagaggcgcgcccttccctcgccgccggcgacgccgaccaaacgaacgcgcagtgagagcctgagaggacggctgcccaatccgcaaggaagcgaagctcctcggctccggtcggatcggctcccttttctgctgattccgatggacggcgccg

SEQ ID NO: 43425 - protein, 63 aa, Panicum virgatum; identical to SEQ ID NO: 9844
  misc_feature: Ceres CLONE 2016553
  misc_feature (2)..(63): Pfam Name: COX5C Pfam Description: Cytochrome c oxidase subunit Vc (COX5C)
  misc_feature: SWISSPROT Homolog: EC 1.9.3.1 Cytochrome-c oxidase

SEQ ID NO: 43426 - DNA, 635 bp, Panicum virgatum
  misc_feature: Ceres CLONE 2016555
  misc_feature: Encodes the peptide sequence at SEQ ID NO. 43427
gggcagggtctcttcctccctagcacagctagcgcgcgccgcggccaccaccatgcagctcgccgagctctgcgccgaccccgtggtgctctcctgcgccttcctctgcctcctcctccacctcgcgctccgccggctggaggagtcggacctggtggcgctcccgtacctgcaggccgtctgcaaggaggcgatgcggctgcacccgtcgacgccgctcagcctcccccacttctccttcgacgcctgcgacgacgtcgacggctaccgcgtcccggccaacacccgcctgctcgtcaacatctgggccatcggccgggacccggccgcgtgggaggcgccgctcgagttccggcccgagcggttcctccccggcggcgcggcggagaaggtggacccgctcgggaactacttcgagctcatcccgttcggcgccggccggaggatctgcgccgggaagctggccgggatggtgttcgtgcagtacttcctgggcacgctgctgcacgcgttcgagtggcgcctgccggagggggaggagaagctggacatggccgagaccttcgggctcgcgctgcccaaggccgtgccgctccgcgccggcgtcacgccgcgcctcgtgccgggagcctacg

SEQ ID NO: 43427 - protein, 194 aa, Panicum virgatum
  misc_feature: Ceres CLONE 2016555
  misc_feature: SWISSPROT Homolog: EC 1.14.13.88 Flavonoid 3',5'-hydroxylase
MQLAELCADPVVLSCAFLCLLLHLALRRLEESDLVALPYLQAVCKEAMRLHPSTPLSLPHFSFDACDDVDGYRVPANTRLLVNIWAIGRDPAAWEAPLEFRPERFLPGGAAEKVDPLGNYFELIPFGAGRRICAGKLAGMVFVQYFLGTLLHAFEWRLPEGEEKLDMAETFGLALPKAVPLRAGVTPRLVPGAY

SEQ ID NO: 43428 - DNA, 687 bp, Panicum virgatum
  misc_feature: Ceres CLONE 2016557
  misc_feature: Encodes the peptide sequence at SEQ ID NO. 43429
agattctgatgttagaacagcaattggatgcaaaacaaaagcttgaattagaaatacagcagctgaagggaaaactaaaagtgatggagcatatgccaggtgatgaaaattcggcgtcaaagaataaaattaatgagctaagtgaggcattgcaagaaaagatagatgaactggatggcatggagtcacttaaccaaactctggttattaaagaaagcaaaagcaacattgaactgcaagaagctcggaatgagctagaaaatggtttgcttggtatttcaggtgaccagccacatataggaatcaagagaatgggtgaacttgatctgaaagcattttcaaaggcatgccgaaagaagtgctcagaagaagacgcagaagttactgctgcctttctttgttcaaagtgggaagctgaaattaaaaaccctgattggtaccctttcaggattgtcatggctgatggaaaggagatggaaataattgaggatgatgcaaagcttcgaggactcagagaagaacatggggaagaaatctacacattggtaacaaaggcgctgtgtgaaattaatgagtacaaatctaagggtagctatcccgtgggagaactgtggaactttaaagaaggccgagaggtgaccctgaaggaagctgtccagttcgtcctgaaacagtggcgagcaaaca

SEQ ID NO: 43429 - protein, 228 aa, Panicum virgatum
  misc_feature: Ceres CLONE 2016557
  misc_feature (99)..(228): Pfam Name: XH Pfam Description: XH domain
ILMLEQQLDAKQKLELEIQQLKGKLKVMEHMPGDENSASKNKINELSEALQEKIDELDGMESLNQTLVIKESKSNIELQEARNELENGLLGISGDQPHIGIKRMGELDLKAFSKACRKKCSEEDAEVTAAFLCSKWEAEIKNPDWYPFRIVMADGKEMEIIEDDAKLRGLREEHGEEIYTLVTKALCEINEYKSKGSYPVGELWNFKEGREVTLKEAVQFVLKQWRAN

SEQ ID NO: 43430 - DNA, 627 bp, Panicum virgatum
  misc_feature: Ceres CLONE 2016559
  misc_feature: Encodes the peptide sequence at SEQ ID NO. 43431
agtgactggactaggttagagcattatgcaagtactggggaaaaagttgaggtggagctgataaattgcagtccaaagggatttgttgtgtcacttgactcactgataggtttcttgccataccgtaatcttgctacaaaatggaaattcttagcttttgagacttggttaagaaggaagggtggtgatccttcctcgtacaagcagagtctgggattagaggatggttatgaggttcatgacagtaacatagaacctgaatctagctcagtctcagaagtagctggtgaggatcaagaatctcttccatctaagccgaagtttgaagatcttcttcgggcatacaaccaagagaaatccaagtttttgtcttcatttattggtcaaagactccgagtgtcagttgtcctggctgacagaaactcaaagaagatatttttctctatgaagccaaaagagagtgaagaattgattcagaagaagaaaactctgatggctaagcttaatgttggagatattgttcaatgcactatcaagcgatttgtttactttgggatatttgtcaaggttgaaggggttcctgcattgattcagcaatgggaagtatcttgggatgataccttaaat

SEQ ID NO: 43431 - protein, 208 aa, Panicum virgatum
  misc_feature: Ceres CLONE 2016559
  misc_feature: SWISSPROT Homolog: EC 1.17.1.2 4-hydroxy-3-methylbut-2-enyl diphosphate reductase
  misc_feature: Functional homolog of the protein sequence given in SEQ ID NO 51370
  misc_feature: Useful for making plants with altered terpenoid content
SDWTRLEHYASTGEKVEVELINCSPKGFVVSLDSLIGFLPYRNLATKWKFLAFETWLRRKGGDPSSYKQSLGLEDGYEVHDSNIEPESSSVSEVAGEDQESLPSKPKFEDLLRAYNQEKSKFLSSFIGQRLRVSVVLADRNSKKIFFSMKPKESEELIQKKKTLMAKLNVGDIVQCTIKRFVYFGIFVKVEGVPALIQQWEVSWDDTL

SEQ ID NO: 43432 - DNA, 591 bp, Panicum virgatum
  misc_feature: Ceres CLONE 2016561
  misc_feature: Encodes the peptide sequence at SEQ ID NO. 43433
aagagcattactcctgcccacagcccacactcctcatccggaggcactcactcgcacacactgactgactgctgcccagtgctcgcccggatcccaccgctctggcgcctgctgtgccctgcctgcctgctctgtccttccctcccctggcagagaatctgcagggcttgccgggaggagggagcagcgctaccatggtagcgtcgaagaagaagttccgcggcgtcaggcagcgccactggggctcctgggtctccgagattaggcacccgctgctgaagaggagggtgtggctgggcaccttcgagacggcggaggaggcggcgcgggcgtacgacgaggccgccgtcctcatgagcggccgcaacgccaagaccaacttccccgtcccgaggaccgccaccagggagctggcgcccgtgccgcccgcgcgggacgcccgcggcggctcgtcgtcggctgctgcctccgccggcggcaataacagcagcagcctgtcgcagatcctcagcgccaagctccgcaagtgctgcaagacgccgtccccgtcgcttcacctgcctccgcctcgacccggagaagtcccacatt

SEQ ID NO: 43433 - protein, 132 aa, Panicum virgatum
  misc_feature: Ceres CLONE 2016561
  misc_feature (6)..(57): Pfam Name: AP2 Pfam Description: AP2 domain
  misc_feature: The sequence is a functional homolog of SEQ ID NO 1302 in the 10/374,780 US patent application
  misc_feature: The sequence is a functional homolog of SEQ ID NO 1447 in the 10/412,699 US patent application
  misc_feature: The sequence is a functional homolog of SEQ ID NO 150 in the 11/375,241 US patent application
  misc_feature: The sequence is a functional homolog of SEQ ID NO 908 in the 10/666,642 US patent application
  misc_feature: Functional homolog of the protein sequence given in SEQ ID NO 51503
  misc_feature: Useful for making plants with modulated biomass
  misc_feature: Functional homolog of the protein sequence given in SEQ ID NO 51504
  misc_feature: Useful for making plants with modulated flowering time
  misc_feature: The sequence is a functional homolog of SEQ ID NO 1444 in the 10/666,642 US patent application
  misc_feature: The sequence is a functional homolog of SEQ ID NO 146 in the 11/375,241 US patent application
  misc_feature: The sequence is a functional homolog of SEQ ID NO 1860 in the 10/412,699 US patent application
  misc_feature: The sequence is a functional homolog of SEQ ID NO 2106 in the 10/374,780 US patent application
  misc_feature: The sequence is a functional homolog of SEQ ID NO 272 in the 10/714,887 US patent application
  misc_feature: The sequence is a functional homolog of SEQ ID NO 272 in the 11/435,388 US patent application
  misc_feature: The sequence is a functional homolog of SEQ ID NO 144 in the 11/375,241 US patent application
  misc_feature: The sequence is a functional homolog of SEQ ID NO 1516 in the 10/666,642 US patent application
  misc_feature: The sequence is a functional homolog of SEQ ID NO 19 in the 10/225,068 US patent application
  misc_feature: The sequence is a functional homolog of SEQ ID NO 1928 in the 10/412,699 US patent application
  misc_feature: The sequence is a functional homolog of SEQ ID NO 194 in the 10/225,066 US patent application
  misc_feature: The sequence is a functional homolog of SEQ ID NO 284 in the 10/714,887 US patent application
  misc_feature: The sequence is a functional homolog of SEQ ID NO 284 in the 11/435,388 US patent application
  misc_feature: The sequence is a functional homolog of SEQ ID NO 450 in the 10/374,780 US patent application
  misc_feature: Functional homolog of the protein sequence given in SEQ ID NO 51051
  misc_feature: Useful for making plants with altered alkaloid content
MVASKKKFRGVRQRHWGSWVSEIRHPLLKRRVWLGTFETAEEAARAYDEAAVLMSGRNAKTNFPVPRTATRELAPVPPARDARGGSSSAAASAGGNNSSSLSQILSAKLRKCCKTPSPSLHLPPPRPGEVPH

SEQ ID NO: 43434 - DNA, 646 bp, Panicum virgatum
  misc_feature: Ceres CLONE 2016563
  misc_feature: Encodes the peptide sequence at SEQ ID NO. 43435
cccacacgagtcacgagcgcgtcctctcctccactcccacccaccgcagccgggtcctctcttcccccacgccacccctcttccgcgccgtaggcgctcccccgccgatcgcccttctgccctgcggaggcgtgattgctggagatccatcgatccggagttggattggcctcatctttcttggcacgaagattttgccaagatcgtcaacattgtggaaatgggaggtgtaatcggtggtgagtcgccaaggaacagttccccggcatcaaagttagagaggaagatggttgaggcaatgcagcagagggcattgaaaggaacttctgtgaaatcgttcaacagtgtcatcatgaaattccctaaaattgacgagagcttgagaaactgcaggaccatctttcagcaatttgatgaagattccaatggtgaaatagatcaacaggaactcaagcactgtttccagaaattgggtatcgaatctactgatgatgaaataaaagatctgtttcaggcatgcgacatttatgaacacatgggcatgaagttcaatgaatttattgtcttcctgtgccttgtttatcttctcaatgatcctgcggtgtctgaagcagtatccttcatacagtaaaaaaacattactgtt

SEQ ID NO: 43435 - protein, 136 aa, Panicum virgatum
  misc_feature: Ceres CLONE 2016563
  misc_feature (56)..(84): Pfam Name: efhand Pfam Description: EF hand
  misc_feature: SWISSPROT Homolog: EC 2.7.11.1 Non-specific serine/threonine protein kinase
MGGVIGGESPRNSSPASKLERKMVEAMQQRALKGTSVKSFNSVIMKFPKIDESLRNCRTIFQQFDEDSNGEIDQQELKHCFQKLGIESTDDEIKDLFQACDIYEHMGMKFNEFIVFLCLVYLLNDPAVSEAVSFIQ

SEQ ID NO: 43436 - DNA, 662 bp, Panicum virgatum
  misc_feature: Ceres CLONE 2016590
  misc_feature: Encodes the peptide sequence at SEQ ID NO. 43437
ggccaaccgaaccattcgcccccgcccccgatcgatctcttccccccccccccgtcgcgattccctcgtagcatcccctcacgcgcgcatcgaccatgtcggcctactgcgggaagtacaaagacgagctcatcaagaacgctgcctacattggcacccctggcaagggtatccttgctgctgacgagtccactggcaccattggcaagcgcctttcaagcatcaatgttgagaacattgaggagaaccggcgtgccctccgtgagctcctcttctgcacccctggtgccctccagtacctcagtggtgtgatcctctttgaggagaccctctaccagaagaccaaggacggcaagcccttcgttgatgttcttaaggagggaggtgtcctccctggcatcaaggtcgacaagggtaccatcgagatcgctggcaccaacaaggagaccaccacccagggccatgatgaccttgggaagcgctgcgctaagtactacgaggctggtgcccgctttgccaagtggcgtgctgtcctcaatatcggccccaatcagccatcacagcttgccattgacctgaatgctcagggtcttgctcgttacgccatcatctgccaggagaatggtctggtacaaattgttgagcctgagatcccttgtgaa

SEQ ID NO: 43437 - protein, 188 aa, Panicum virgatum
  misc_feature: Ceres CLONE 2016590
  misc_feature (11)..(188): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
  misc_feature: Functional homolog of the protein sequence given in SEQ ID NO 50217
  misc_feature: Useful for making plants with modulated biomass
MSAYCGKYKDELIKNAAYIGTPGKGILAADESTGTIGKRLSSINVENIEENRRALRELLFCTPGALQYLSGVILFEETLYQKTKDGKPFVDVLKEGGVLPGIKVDKGTIEIAGTNKETTTQGHDDLGKRCAKYYEAGARFAKWRAVLNIGPNQPSQLAIDLNAQGLARYAIICQENGLVQIVEPEIPC

SEQ ID NO: 43438 - DNA, 638 bp, Panicum virgatum
  misc_feature: Ceres CLONE 2016592
  misc_feature: Encodes the peptide sequence at SEQ ID NO. 43439
actcccattccctgattgctgcagcagcgcctcctccagcggcgtcacctaccggctcaccggcgcacgtccgggctgagggcgttgccgtgttggcgaggaccagacacctggcagtcgaggcgcctgctgaagctccggcagccatggagagcagccgcgacaagcacttgatcctcgtgcacggcctgtcccacggcgcgtggtgctggtacaaggtggtggcgaggttgcgcgccgcggggcaccgggcgaccgcgctcgacatggccgcgtccgaggtgcgcccggcgcgcctccacgaggtggcctcgttcgaggagtactcgcgcccgctgctcgacgccgtggccgcggcgcccgacggcgagaggctcgtcctcgtgggccacagcctcggcgggctcagcgtcgccctcgccatggagaggttcccaggcaaggtagccgccgccgtgttcctggccgcgtccatgccgcgcatcggcagccacatgggcatcaccatccaagagttcatggagacgatcaaaccaggttttttcatggacagcgaaacgatgcttctaaatacagagcaaggacctcgagctgcagttctacttggccccaacttattggcgggcagagtgtatgat

SEQ ID NO: 43439 - protein, 163 aa, Panicum virgatum
  misc_feature: Ceres CLONE 2016592
  misc_feature: SWISSPROT Homolog: EC 3.1.1.78 Polyneuridine-aldehyde esterase
MESSRDKHLILVHGLSHGAWCWYKVVARLRAAGHRATALDMAASEVRPARLHEVASFEEYSRPLLDAVAAAPDGERLVLVGHSLGGLSVALAMERFPGKVAAAVFLAASMPRIGSHMGITIQEFMETIKPGFFMDSETMLLNTEQGPRAAVLLGPNLLAGRVY

SEQ ID NO: 43440 - DNA, 474 bp, Panicum virgatum
  misc_feature: Ceres CLONE 2016597
  misc_feature: Encodes the peptide sequence at SEQ ID NO. 43441
atccggctgcatcgtgcccaaccattctccccccatcttcctagctatcccagtgcccgccccacaagcgtacaacatgtccggctactgcgaaaaggacaaggatgatctcatctcgaatgctgcctactttgtcacccctggaaagggtatccttgcagctgatgagtccactggcaccattggcaagcggctttccagcatctagatggagaacatcgaggagaaccgccgtgccctccgtgagctcctgttctgctgccctggcgcccttcactacataatgggtgtgatcctcttcgaggagaccctgtgacataataccaaagatggtgagcccgtctgtgatgtcctcaaggagggaggcgttctccctggcatcatggtaaacaagggcaccattgatgtggctggcactgaccaggataccaccacccaacgtcatgatgaccttggctagcgctgagccaagta

SEQ ID NO: 43441 - protein, 43 aa, Panicum virgatum
  misc_feature: Ceres CLONE 2016597
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
  misc_feature: Functional homolog of the protein sequence given in SEQ ID NO 50217
  misc_feature: Useful for making plants with modulated biomass
MSGYCEKDKDDLISNAAYFVTPGKGILAADESTGTIGKRLSSI

SEQ ID NO: 43442 - DNA, 911 bp, Panicum virgatum
  misc_feature: Ceres CLONE 2016603
  misc_feature: Encodes the peptide sequence at SEQ ID NO. 43443
tctccaccacccgaagtcgcgaaccaaatcttccttcgctgatggcgccactcctcccccaagcggtccccaaaaccttcgcaccaccgattccccgcgcccgccaccgcctcgcgccgagaccgccctgcgccgccgccttcctccgcgggctgttccccgcccgcccgccgccggcgaaggccgaactcctccgcctcatcgccgaccagggccgcggcctcgagacgcagtccgaccccgcgcgcctggccgacatcgtctcctgcatcgacgcgctcgccgcggtatcccccggcgcggacaccgtctccgacgccgccaagctgtccgggacctggcgcctgctctggaccaccgagcaggagcagctcttcatcgtgcgcaacgcccccttcttccgcaccgccgccggcgacgtgctccaggtcatcgacgtccccggcggcgcgctcaacaacgtcatcacgtttccgccctcaggcgcgtttgttgtcaatggcgtcatcgaggtccagccgccccagcgagtcaattttaggttcacacgcgctgcgctgagaggaaacaactgggaggtaccttttccaccgtttgggaaaggatggtttgacactgtctatttggatgatgacatacgggtcgccaaggacataagaggggactatttagtagttgaccgtgctccatattcttgggatggatagtgtctgaagttcaaagctgaccaaaagaacacttggagaaccttatgctttcccagatttgacttcacatttttactatgccatttattttcctgtacattgtttttttttctacggatactatgtggtaagtctgactcatgctgtactcgctgtaagatattctccaaagaaattgataaatcaagttgatattgtccgtac

SEQ ID NO: 43443 - protein, 221 aa, Panicum virgatum
  misc_feature: Ceres CLONE 2016603
  misc_feature (44)..(213): Pfam Name: PAP_fibrillin Pfam Description: PAP_fibrillin
MAPLLPQAVPKTFAPPIPRARHRLAPRPPCAAAFLRGLFPARPPPAKAELLRLIADQGRGLETQSDPARLADIVSCIDALAAVSPGADTVSDAAKLSGTWRLLWTTEQEQLFIVRNAPFFRTAAGDVLQVIDVPGGALNNVITFPPSGAFVVNGVIEVQPPQRVNFRFTRAALRGNNWEVPFPPFGKGWFDTVYLDDDIRVAKDIRGDYLVVDRAPYSWDG

SEQ ID NO: 43444 - DNA, 1042 bp, Panicum virgatum
  misc_feature: Ceres CLONE 2016609
  misc_feature: Encodes the peptide sequence at SEQ ID NO. 43445
catccgttgatccccgacacttcagccgacgacctgacgagctgagctcctctggaagttgtggttatcgatccatggcggacatacagtgcgaccagcagcccaccaagctgaggccgagcgcgtcgtcgtcgctgaggatcttcggctacgacgtggccggcggtggcactaccgacatcgtcgtgccgcgggacggccggccggcggcggacgggcgcaggttcgagtgccagtactgctgccgcgagttcgccaactcgcaggcgctaggcgggcaccagaacgcgcacaagaaggagaggcggcagctgaagcgcgcgcgccagctcgccgtcgccgcccgtcccgttgcgggcggcttggcggcgttctgcgctgcgggtttcgtcgcgccgccgccgcccgggcacctgatggccctgggccacgccgggtcgaacgcgtatgcgccgggccctatcccaagctgggtgtacctcgcgcaccagcccaccatgggtccacctcgcgcacctccggctgatgtcgacgccgaggaagcctcggcgatggggctgaacctgcgtctcagccttgctccagccagttcatggtgaacggaatacaaaccgttccccaccctctcgcccactgcgaaacggaacaacatgtcgctcgcacgccagaatcaaagatctatgtttgagttcctttcttctcttcttttctttatcttcgcaagtcccattttctttgcatataccatagctcagttgatgttgcgcaaagtgcaggaggagaacatctactagttgttttgacaccactgcagtgttcattgtttggtggactgaaatgcgagctcgttttttttagagcgcactgattataacggaatataagacttcttgacaaggagttctagcacctgcggttatattacaacgaaaccgagcaattgttgaaaaaagtagctgtcagcttcatatatgttagaacaaatgggccaggagccaatttttttaaaaaatgatcaataaatcccaaggcccatattttt

SEQ ID NO: 43445 - protein, 174 aa, Panicum virgatum
  misc_feature: Ceres CLONE 2016609
  misc_feature: The sequence is a functional homolog of SEQ ID NO 1090 in the 10/412,699 US patent application
  misc_feature: The sequence is a functional homolog of SEQ ID NO 635 in the 10/374,780 US patent application
  misc_feature: The sequence is a functional homolog of SEQ ID NO 760 in the 10/666,642 US patent application
  misc_feature: The sequence is a functional homolog of SEQ ID NO 1092 in the 10/412,699 US patent application
  misc_feature: The sequence is a functional homolog of SEQ ID NO 637 in the 10/374,780 US patent application
  misc_feature: The sequence is a functional homolog of SEQ ID NO 761 in the 10/666,642 US patent application
  misc_feature: The sequence is a functional homolog of SEQ ID NO 1093 in the 10/412,699 US patent application
  misc_feature: The sequence is a functional homolog of SEQ ID NO 638 in the 10/374,780 US patent application
  misc_feature: The sequence is a functional homolog of SEQ ID NO 762 in the 10/666,642 US patent application
MADIQCDQQPTKLRPSASSSLRIFGYDVAGGGTTDIVVPRDGRPAADGRRFECQYCCREFANSQALGGHQNAHKKERRQLKRARQLAVAARPVAGGLAAFCAAGFVAPPPPGHLMALGHAGSNAYAPGPIPSWVYLAHQPTMGPPRAPPADVDAEEASAMGLNLRLSLAPASSW

SEQ ID NO: 43446 - DNA, 1294 bp, Panicum virgatum
  misc_feature: Ceres CLONE 2016610
  misc_feature: Encodes the peptide sequence at SEQ ID NO. 43447
acagcagctagcacaggtgatccaccgaccaacagctgaccgcctacgcgacacactcatcggtctcgtccactgacgtccaagcctgtgtcatggccaggaacgcggtgcaagccgtcagggcggcgctctacctgctgctcgcgctcgccgtggcgaactgcgcgttcgctggccgcgtcctcgacgagcagcccgcggctccagcggaggctccccagccggtcgacccgctgcccgcccccacggatccccccaccgacccggtggtggtggcgccagcggccggcccagccgctaccgcgggcgcgggcgcggcgggggcagcggccgctggtgccgccgccactggcaatgcaggagttgccagcggcggcgctgcagtggcgaacgcgggagccggcgcgggcgcgggcgaccacccgctgacgttcttcatgcacgacatcctcgggggctcgcagccgtcggggcgcatcgtgaccggcgtggtggcgagcgcggcggccaacgggcagctcccgttcgcgcgccccaacaccaacatcttcccgatccagggcgcggtgccgctgccacagggcgccgccaacctcatcaacagcaacaacgccccctacgtcgcgggcctcggcggcagcggcgcctccggcaccctcgtccagaacaacggcaaccccgtcaacggcggcaacaagaacatcccctacgtcaacgccggggacctcccgtcgggcgtcacgctccagaacctcctcttcggcaccaccaccgtcatcgacgacgagctcaccgagggccacgagatcggcgccggggtcatcggcagggcgcaggggttctacgtcgccagctcgcaggacggcaccagcaagaccatcgtgctcacggccatgttcgagggccccgaggcgccgcacggcgacacgctcagcttcttcggggtccaccggatggccgcgccagagtcccacatcgccatcatcgggggcaccggcaagtacgagaacgccaagggcttcgccgccatccagacgctgcaccccggcgaccagcacaccaccgacggcgtcgagactatcctccagttcaacgtgcacctcatctgagctgccccgtcacaagctcctgtccttccaggttacgatgctctgcagtttcgtgcaatgtttgtatttccaagtacctcacttttctgccatgtatgtagtgtgataggtgctttgatcgcatcagcatattgtgacattgtatggagtaaattaagtatctttaatacgatgaaatctcccag

SEQ ID NO: 43447 - protein, 338 aa, Panicum virgatum
  misc_feature: Ceres CLONE 2016610
  misc_feature (151)..(337): Pfam Name: Dirigent Pfam Description: Dirigent-like protein
MARNAVQAVRAALYLLLALAVANCAFAGRVLDEQPAAPAEAPQPVDPLPAPTDPPTDPVVVAPAAGPAATAGAGAAGAAAAGAAATGNAGVASGGAAVANAGAGAGAGDHPLTFFMHDILGGSQPSGRIVTGVVASAAANGQLPFARPNTNIFPIQGAVPLPQGAANLINSNNAPYVAGLGGSGASGTLVQNNGNPVNGGNKNIPYVNAGDLPSGVTLQNLLFGTTTVIDDELTEGHEIGAGVIGRAQGFYVASSQDGTSKTIVLTAMFEGPEAPHGDTLSFFGVHRMAAPESHIAIIGGTGKYENAKGFAAIQTLHPGDQHTTDGVETILQFNVHLI

SEQ ID NO: 43448 - DNA, 384 bp, Panicum virgatum
  misc_feature: Ceres CLONE 2016621
  misc_feature: Encodes the peptide sequence at SEQ ID NO. 43449
agcaaaccgtgtgcgcccgcccccagcagcagctagcgtcccaacgggcaaaaaccacgcccgcctcgcgacccgcctccggccaccgccatggcctcctgcgcggacgcccagccccaccccgcgtgggcgctggcgctcgctgcgctcgggctcctcgcatccgcgcgcgccgcggcgcgcctcgcgctgcggctgtacgcggcgttcttccgccccgcgaggccgctgcgctgccggtaccgcgcgtgggcggtcgtcacgggcgccacggacggcatctgccgcgcgcacgacttccgcctcgccgcagctggcctcggggtcgtcctcgtcggccggaaccaggacaagctcgccgcggtcgcggacgagctcgaggcc

SEQ ID NO: 43449 - protein, 97 aa, Panicum virgatum
  misc_feature: Ceres CLONE 2016621
  misc_feature: SWISSPROT Homolog: EC 1.1.1.64 Testosterone 17-beta-dehydrogenase (NADP(+))
MASCADAQPHPAWALALAALGLLASARAAARLALRLYAAFFRPARPLRCRYRAWAVVTGATDGICRAHDFRLAAAGLGVVLVGRNQDKLAAVADELE

SEQ ID NO: 43450 - DNA, 578 bp, Panicum virgatum
  misc_feature: Ceres CLONE 2016638
  misc_feature: Encodes the peptide sequence at SEQ ID NO. 43451
agcaacaagctaagcaagaattgaagaagcaatcatccatcagcattcagcaatggcggttgcaagcccccggaggctaggcaccctgctggccctcgcggcggccctcctctccctcctcgccggcccggccgcggcgacggggaagacggggcaggtgacagtgttctggggccggaacaaggccgagggctcgctccgggaggcctgcgacaccggcacctacaccttcgtcgtcatctccttcctcagcgtcttcggccacagcacgaccagcctggacctctccggccaccccatcggccccgtcggcgccgacatcaagcactgccagtccaagagcatcctcgtcttcctctcgatcggcggccccggcggccagtactcgctccccagcgcccaggccacgacggacctcgccgaccacctctggttcgcgtacctcgccggccgccgcgccggcgtgcgccgcccgttcggcgacgcggagctcgacggcatcgacctcttcatcgaccagggcgcccccgaccactacgacgagctggcggcgcggctgtggaactacaacaaggagt

SEQ ID NO: 43451 - protein, 175 aa, Panicum virgatum
  misc_feature: Ceres CLONE 2016638
  misc_feature (34)..(174): Pfam Name: Glyco_hydro_18 Pfam Description: Glycosyl hydrolases family 18
  misc_feature: SWISSPROT Homolog: EC 3.2.1.14 Chitinase
MAVASPRRLGTLLALAAALLSLLAGPAAATGKTGQVTVFWGRNKAEGSLREACDTGTYTFVVISFLSVFGHSTTSLDLSGHPIGPVGADIKHCQSKSILVFLSIGGPGGQYSLPSAQATTDLADHLWFAYLAGRRAGVRRPFGDAELDGIDLFIDQGAPDHYDELAARLWNYNKE

SEQ ID NO: 43452 - DNA, 1037 bp, Panicum virgatum
  misc_feature: Ceres CLONE 2016646
  misc_feature: Encodes the peptide sequence at SEQ ID NO. 43453
ctcggcgttccatcaggaattcaggattcattcagttcgaaacaaagccattctttgccaacgaacaaggtagctaagcacggcatggccggagcctgcgcccgcgcggcgctcgcgctcgcgctcgcgctctggtgcgcgctggccgccgcggcggccgggcagaccggccagcagtggctccgggcgcacgccacgttctacggcggcgccgacgcctccggcaccatgggaggagcgtgcgggtacgggaacctgtacgcgcaggggtacggaacgcggacggcggcgctgagcacggcgctgttcgccggcggcgcggcgtgcgggcagtgctacaagctggtgtgcgaccgcaagacggacccgacgtggtgcaagcccggggtgtcggtcaccgtcacggccaccaacttctgcccgcccaactggagcatccccagcgaccgcggcggctggtgcaacccgccgcggccgcacttcgacatggcgcagccggcgtgggagaagatcggcgtctaccgcggcggcatcatccccgtcatctaccgaagggtgtcgtgcgtgaagaagggaggggtgcgcttcgccatcaacgggcacgactacttcaacctggtgctggtgaccaacgtcgccgggccggggtccatcagggccatggacgtgagggggtcccggacgccggactggatgtccatggcgcgcaactggggagccaactggcactccctcacctacctcaacggccaggggctgtccttcagggtcaccgtcaccgacggccagaccatcgtcttcgccaacgtcgtgccgcccagctggaggttcggccagtctttcgccagcaacctgcagttcagcctctgagaaacttattattacctgctgcttgaatggatcgaattcaatcaagagatatttttgttgattgcttgcgcttgttgcttgtagagtatgctgtgtgatgtgtacataaagagatttcattacttatttcatgacgaagctatatgctcaaattaattactccgatt

SEQ ID NO: 43453 - protein, 261 aa, Panicum virgatum
  misc_feature: Ceres CLONE 2016646
  misc_feature (67)..(155): Pfam Name: DPBB_1 Pfam Description: Rare lipoprotein A (RlpA)-like double-psi beta-barrel
  misc_feature (166)..(244): Pfam Name: Pollen_allerg_1 Pfam Description: Pollen allergen
  misc_feature: Functional homolog of the protein sequence given in SEQ ID NO 51623
  misc_feature: Useful for making plants with altered carbohydrate content
  misc_feature: Functional homolog of the protein sequence given in SEQ ID NO 51670
  misc_feature: Useful for making plants with altered cell wall content and/or composition
  misc_feature: Functional homolog of the protein sequence given in SEQ ID NO 50489
  misc_feature: Useful for making plants with altered lignin content
MAGACARAALALALALWCALAAAAAGQTGQQWLRAHATFYGGADASGTMGGACGYGNLYAQGYGTRTAALSTALFAGGAACGQCYKLVCDRKTDPTWCKPGVSVTVTATNFCPPNWSIPSDRGGWCNPPRPHFDMAQPAWEKIGVYRGGIIPVIYRRVSCVKKGGVRFAINGHDYFNLVLVTNVAGPGSIRAMDVRGSRTPDWMSMARNWGANWHSLTYLNGQGLSFRVTVTDGQTIVFANVVPPSWRFGQSFASNLQFSL

SEQ ID NO: 43454 - DNA, 1314 bp, Panicum virgatum
  misc_feature: Ceres CLONE 2016647
  misc_feature: Encodes the peptide sequence at SEQ ID NO. 43455
accgcagctcccgccgccggagttgcccgacgacgccgtcgctgagatcctcctccgcctcacgccggacgagccccgctgcttcttccgcgcctccctcgtctgcaagctctggcagcgcctcctcaccgacgccgccttcctccgccggtaccaccgcttccaccggaaccctccactgctcgggttcttctctgttgccgacgtacgcggcgaggccatccccttattcacccccacgatgccagcttcccctttcccccagccgatgctcgactgccgcccctgggtctccctcgactgccgccatgggcgtgtgctcctccagaagatgcaggggcgcgacttcactgtctgggacccaatcaccggtgcccgggaggagttccgtgagcccggcgtcgcgaactcatccgtcgtggtgctctgcgccgcgtccggatgcgaccaccgcgactgccacggcggcccgttcctcgtcgtctgggcgtggatggatgctacggagcggcgcgcgcatgtgcgcgtgtactggtcgctagtgggttcctggagcacgtccgcttctgtaggcctaagcatcgatgaaatcctcagcctgagccgcggcgcccatgttggagaccgtatctacttcaagcttcggatgggtcctagaatcctcaagtacgacctggtcaagcatcacttgtctgtgatcgaaccgccggaatcgtgcggcatgtccatcttcatcgtgccaactgaggacggtttgctcggggtcgctggcgtcaggggttccagccattacctgtggtcgaggaaggcaaatgcagggggagttgaaggatggacacgatacagagtgatcgagttacggactctgttaccagctgacagccttcgcaaaacacctatggtggttggttttgctgaggatgtccgtgtcatcttcgtgcacacagttgttggtcactttgctatcgacctcagctcagagcaggcgaggaaggtcagcgggcctgggatgcaatatcctatcgtacccttcatgagcttctacacaccggattgtgcttgtgggaaatctccattaccagcagagtcaaattaactaatcactgctaagcttgaagtatggtagtaccttgccagtttacaaatctgccaacgtaaatattccactgttggcatgttatagcctataaggctgatgctttgacatgtttgtcagtattctgttgtggaatttaattccttttaatgtatgttgtgtgatcatgaccgcgatgactagaggtttagagttggtgtaacagtgtttagagctat

SEQ ID NO: 43455 - protein, 364 aa, Panicum virgatum
  misc_feature: Ceres CLONE 2016647
  misc_feature (3)..(53): Pfam Name: F-box Pfam Description: F-box domain
PQLPPPELPDDAVAEILLRLTPDEPRCFFRASLVCKLWQRLLTDAAFLRRYHRFHRNPPLLGFFSVADVRGEAIPLFTPTMPASPFPQPMLDCRPWVSLDCRHGRVLLQKMQGRDFTVWDPITGAREEFREPGVANSSVVVLCAASGCDHRDCHGGPFLVVWAWMDATERRAHVRVYWSLVGSWSTSASVGLSIDEILSLSRGAHVGDRIYFKLRMGPRILKYDLVKHHLSVIEPPESCGMSIFIVPTEDGLLGVAGVRGSSHYLWSRKANAGGVEGWTRYRVIELRTLLPADSLRKTPMVVGFAEDVRVIFVHTVVGHFAIDLSSEQARKVSGPGMQYPIVPFMSFYTPDCACGKSPLPAESN

SEQ ID NO: 43456 - DNA, 660 bp, Panicum virgatum
  misc_feature: Ceres CLONE 2016649
  misc_feature: Encodes the peptide sequence at SEQ ID NO. 43457
accagccggtagccgcacacacctaccccaggccccagctagccactgccacgcccgttgcatttcctcgaccgagctgagctcttgcactcctaagtcctaaccgtcgacatcatcgcgcatcgaactctgctaccagccagagcatcatcgatcgtcggggccaggcggcgtcaggcctccgtgacgacatggtgaagggcggcgcgcatcagctgcagacggacgcggcggcccaaggcaatgcggcggcggcggcgaggcagcacggctgcggcggcgggaagcggcagtacaagggcgtgcgcatgcggagatggggctcgtgggtgtcggagatccgggcgcccaaccagaagacgcggatatggctcggctcctactccaccgccgaggccgccgcccgcgcctacgacgccgcgctgctctgcctcaagggctccgccgccgacctcaacttccccgtgcacctcccgttccacatccccgccgccgccatgtcgcccaagtccatccagcgcgtcgccgccgcggcggccgccagtaccggcggatgcagcccgctgcaggccggcgcgccctgctaccccgccgccgcggccaccaacgccgccactaccccgccctgcagctacggcgacgcctcgtcgggcgcgagct

SEQ ID NO: 43457 - protein, 156 aa, Panicum virgatum
  misc_feature: Ceres CLONE 2016649
  misc_feature (33)..(84): Pfam Name: AP2 Pfam Description: AP2 domain
  misc_feature: Functional homolog of the protein sequence given in SEQ ID NO 51672
  misc_feature: Useful for making plants with modulated flowering time
  misc_feature: The sequence is a functional homolog of SEQ ID NO 182 in the 11/375,241 US patent application
  misc_feature: Functional homolog of the protein sequence given in SEQ ID NO 51610
  misc_feature: Useful for making plants with altered lignin content
MVKGGAHQLQTDAAAQGNAAAAARQHGCGGGKRQYKGVRMRRWGSWVSEIRAPNQKTRIWLGSYSTAEAAARAYDAALLCLKGSAADLNFPVHLPFHIPAAAMSPKSIQRVAAAAAASTGGCSPLQAGAPCYPAAAATNAATTPPCSYGDASSGAS

SEQ ID NO: 43458 - DNA, 1051 bp, Panicum virgatum
  misc_feature: Ceres CLONE 2016653
  misc_feature: Encodes the peptide sequence at SEQ ID NO. 43459
acatcgcgtcccttctccttaagcctcgcaatccccacgccttccagaagtgccccaacccctaaaccccgtaaaccctagcaaggttcacacgccaccgctcctctcgccatggccctcttcgccgcagcccgccgcgccgcggcatccgcggcccccctgatcctgcgcgcctccgcctccacctccacgggggcccaccgcggcgtggccctgctccggcccctcgccgccgccgcggcgcggccgcatccccgcgcgatgccgttctcgtcggcgcccgcggcgaggcccagctccgacgccgagctcctcagcgtcatcgactccgagatcaagtacgccgaggactgcgacgaccacgacagggttgaggagattccagataatttccctttcaaaatcactgatgaaaaggggatgaatgcaattacccttaaaaggacatatcatggtgagcagattgaggttgtggctcacatgcccagcctagtcactggagatgatcctgatcatgaccggaatgacgaggacaagggtgaggagggagatggcagcaatgaagatcaaggcgagaagcccccccagtcgagcattcctctcacggtcactatcaccaagggtgatggccccatccttgaattcacctgcactgcctatcctgatgaggtcatcatcgactccttgtccgtgagccagccaaccgggaacgatgaaattgacttaattgcatatgagggtcctgatttcaatgaccttgatgagaacctgcagagggcattccacaagtacctggaactgcgtggcatctcacccctgacgacaaacttcttgcatgagtacatgatcaacaaggacagccgtgagtacctcctctggctgaggaagctgaaggatttcttcaagcagtagagatcatggctgtcacttccctcttcccaggcatgagatagtcaagtttctttgcacattcagattttggagcgacaagctgcttatattaggatgcgtatgcacttacatgtgctgtcataagttcattttcgtgact

SEQ ID NO: 43459 - protein, 216 aa, Panicum virgatum
  misc_feature: Ceres CLONE 2016653
  misc_feature (21)..(214): Pfam Name: MAM33 Pfam Description: Mitochondrial glycoprotein
MPFSSAPAARPSSDAELLSVIDSEIKYAEDCDDHDRVEEIPDNFPFKITDEKGMNAITLKRTYHGEQIEVVAHMPSLVTGDDPDHDRNDEDKGEEGDGSNEDQGEKPPQSSIPLTVTITKGDGPILEFTCTAYPDEVIIDSLSVSQPTGNDEIDLIAYEGPDFNDLDENLQRAFHKYLELRGISPLTTNFLHEYMINKDSREYLLWLRKLKDFFKQ

SEQ ID NO: 43460 - DNA, 687 bp, Panicum virgatum
  misc_feature: Ceres CLONE 2016660
  misc_feature: Encodes the peptide sequence at SEQ ID NO. 43461
gatgctgccgtcattgaagagcttattgcaaagttggaagcaatttccaaaacattgccaccaggattccacatgaacccaatacagtttgagaaggatgatgacaccaatttccatatggacttgatagctggctttgctaacatgcgggcacggaactacagcatccctgaagttgacaagctgaaggcaaagttcatagctggaaggatcatcccagccatcgccacctcgaccgcaatggccaccggccttgtctgcctggagctttacaaagtcctcgctgggggtcacaaggttgaagactaccggaacacatttgcaaacctcgcaatccccctcttctccatggcggagcctgtgccacccaagaccatcaagcaccaggacatgtcctggaccgtgtgggaccgctggaccataactggcaacatcacgctaagggagctcctagagtggctcaaggagaagggtttgaatgcttacagcatatcctggggcacctcactgctgtacaactccatgttccccaggcacaaggagcggctggacaagaaggtcgtggatgtggcaagggaggtggccaaggtggaggtgccctcttatcgccgccatctggatgtcgtggtggcctgtgaggatgacgatgacaatgatgtggacattcctcttgtgtccatttacttc

SEQ ID NO: 43461 - protein, 228 aa, Panicum virgatum
  misc_feature: Ceres CLONE 2016660
  misc_feature (29)..(97): Pfam Name: UBACT Pfam Description: Repeat in ubiquitin-activating (UBA) protein
DAAVIEELIAKLEAISKTLPPGFHMNPIQFEKDDDTNFHMDLIAGFANMRARNYSIPEVDKLKAKFIAGRIIPAIATSTAMATGLVCLELYKVLAGGHKVEDYRNTFANLAIPLFSMAEPVPPKTIKHQDMSWTVWDRWTITGNITLRELLEWLKEKGLNAYSISWGTSLLYNSMFPRHKERLDKKVVDVAREVAKVEVPSYRRHLDVVVACEDDDDNDVDIPLVSIY

SEQ ID NO: 43462 - DNA, 646 bp, Panicum virgatum
  misc_feature: Ceres CLONE 2016661
  misc_feature: Encodes the peptide sequence at SEQ ID NO. 43463
gtgaatatcatccgcaccgtatcaagccaacatgatctccgtctctacccttgctctggcccttctggccgccgcccaggccgtcgagtccgcctcggccggttgtggcaagaaccccccgacgtcgggcaccaagtccatcaacgtcaacggcaagcagcgccaatacattctccaactccccaacaactatgactccagcaaagcccaccgtgttgtctttggataccactggcgtgatgggtccatgaacgacgtggcaaacggcggcttctacggcttgcgctccctgtccggcgacagcaccatcttcatcgcccccaacggcctgaacgctggttgggccaacaacggcggcgaggacatcaccttcaccgaccagctcgtggccatgctcaagaacgacctctgcgtcaacgagggcgagttctttgccacaggttggagctacggcggatccatgagccacaacgtggcctgctcccggccggacgtcttcagcgccgtttccgtcatcgccggcgcccagctctcgggctgctccggcggcaccacgcccgtgccctacctcggcatccacggcgcggccgacaacgtgctgcccatctccatgggccagcagctgcgcgacaagtggctgcaaacc

SEQ ID NO: 43463 - protein, 204 aa, Panicum virgatum
  misc_feature: Ceres CLONE 2016661
  misc_feature: SWISSPROT Homolog: EC 3.1.1.73 Feruloyl esterase
MISVSTLALALLAAAQAVESASAGCGKNPPTSGTKSINVNGKQRQYILQLPNNYDSSKAHRVVFGYHWRDGSMNDVANGGFYGLRSLSGDSTIFIAPNGLNAGWANNGGEDITFTDQLVAMLKNDLCVNEGEFFATGWSYGGSMSHNVACSRPDVFSAVSVIAGAQLSGCSGGTTPVPYLGIHGAADNVLPISMGQQLRDKWLQ

SEQ ID NO: 43464 - DNA, 573 bp, Panicum virgatum
  misc_feature: Ceres CLONE 2016696
  misc_feature: Encodes the peptide sequence at SEQ ID NO. 43465
agagatggttgagaagggattaacaccgaatgcagcatcatattccccccttatatgctggtttatgccgaaaaggggattcagccagtgcagtgcaacttcacaaggagatggacaggaatggagtttcagggaatatctatacacttacagcacttatcaattgtttctacgaggacaataatatggatgaagctgctatgttgtttgataagatgattgacagctccatagtacctaatgtaactgacttttaatgtcttgatagaaggctattgccgcgcaggcaatcttacgaatgtatttgacttatatgatcaaatggtggataggggtctaaaacctgataattacacttacatgtcaatgattagtgtactttgtttaactttaggtgccttgaaagcacatgaattcgttgatgatctagaaaacaacactgccatgctaaatagtcttagcctaacagcacttttgcatggattgtccaaataatgaaggctaactgaaacataccatgtttggaacatgatgggagcgccaggggtcaagcttgatcttaccagtttcact

SEQ ID NO: 43465 - protein, 75 aa, Panicum virgatum
  misc_feature: Ceres CLONE 2016696
  misc_feature (38)..(72): Pfam Name: PPR Pfam Description: PPR repeat
MQHHIPPLYAGLCRKGDSASAVQLHKEMDRNGVSGNIYTLTALINCFYEDNNMDEAAMLFDKMIDSSIVPNVTDF

SEQ ID NO: 43466 - DNA, 511 bp, Panicum virgatum
  misc_feature: Ceres CLONE 2016697
  misc_feature: Encodes the peptide sequence at SEQ ID NO. 43467
atcagcgtagcaggcaacagcaatctcgaggagcaggtagtagagcgctaagcttccggtgcgtggagcgaatagcggaagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacctgaaccccgccgtgaccttcggcctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgc

SEQ ID NO: 43467 - protein, 139 aa, Panicum virgatum
  misc_feature: Ceres CLONE 2016697
  misc_feature (11)..(139): Pfam Name: MIP Pfam Description: Major intrinsic protein
MVKLAFGSVGDSFSATSIKAYVAEFIATLLFVFAGVGSAIAYGQLTHGGALDPAGLVAIAIAHALALFVGVSIAANISGGHLNPAVTFGLGASVACLLLKFVTHGKAIPTHGVAGISALEGVVFEIIITFALVYTVYAT

SEQ ID NO: 43468 - DNA, 676 bp, Panicum virgatum
  misc_feature: Ceres CLONE 2016708
  misc_feature: Encodes the peptide sequence at SEQ ID NO. 43469
gcttcgactgcccaacgcacgtcaagtccacctgggtgcccgccgccaagcgccgcgagcgccagcagcagcttgccaccggcgccgccgagccatccaagcgaccgcgcgacgccggcgcccagccttcgtccactacagccacaaccacttcctcgggagagcagcagcagcagatggccatggtgggcgagcgattcccacgggaggtgagctcggaggcggtgttccgctgcgtgcgcctgggccccgtcgacgaggccgacgccgaggtggcgtaccagaccaccgtcagcatcgccggccacgtcttcaagggaatcctgcacgacgtcggcccggacccgtccgtcgcggccgccggtggcttccgccacgccgccgaggggtcctccccgagcacggccgcggcgggcgaaggcagcgtcgcggggcccgtgtcgtcatcggctgtggtcatggacccgtatccgacgcccggcccctacggcggcgctcccttcttccacggccatcagaggtgatcaaacggccacctcgattgacgggtagctcagtcttagcttgcttcattattccctttagacatgacatgttgatcgccttccaatccatgtcttgatatttgcttatttactaaaagtattatcatcatcatctctaaattgtcagtaga

SEQ ID NO: 43469 - protein, 173 aa, Panicum virgatum
  misc_feature: Ceres CLONE 2016708
  misc_feature: The sequence is a functional homolog of SEQ ID NO 480 in the 10/666,642 US patent application
  misc_feature: The sequence is a functional homolog of SEQ ID NO 822 in the 11/435,388 US patent application
FDCPTHVKSTWVPAAKRRERQQQLATGAAEPSKRPRDAGAQPSSTTATTTSSGEQQQQMAMVGERFPREVSSEAVFRCVRLGPVDEADAEVAYQTTVSIAGHVFKGILHDVGPDPSVAAAGGFRHAAEGSSPSTAAAGEGSVAGPVSSSAVVMDPYPTPGPYGGAPFFHGHQR

SEQ ID NO: 43470 - DNA, 911 bp, Panicum virgatum
  misc_feature: Ceres CLONE 2016715
  misc_feature: Encodes the peptide sequence at SEQ ID NO. 43471
aaacatcacaatctgaacttgcatcgccattcgccattgtcaactgcctgtcaagaagactgaagaactgcagggagttatctatcgatcgatcgatccagctcgaaagacgaaaatgacgctcgtggagatgtgcgtgcacatggactgcccggggtgcgagaagaaggtccggaaggcggtgcagcgcctggagggcgtgcacgacgtggaggtcgacatggcgcagcagaaggtgacggtgaacggcgacgtggagcagaagaaggtgctcaaggcggtgcgccggacggggcgccgcgccgtgctgtggccgcagcccttcgccggcggcgccgccggggccgcgcacgtcctggcgcagcagcagctcttgtacaatcccgccggcgcggcgggcccggcgcacgccacccacgcggcgcggccggggtcctcgtacaactaccacaagcacggctacgacgactcgcggctgtacggcgcctactaccaccacggcgccagctcggccgtcgccggcaccagggccaccgactacttcagcgacgagaacgcgcaggggtgcgccgtcatgtgagaatgactggcaggatcgcacgtcgccgctcgttggctgttcttcctgtgtctactctttcggctggaagggaagacggggaggacagcggcggcgacggccgccggggaacgggtcggagccgaagccgtacgaatcagggggctaggtcgaaatctacattgtaaagtttacaaatagccctctactaatttgaatcgcagctattatttacaattcaaagtagagttttccgaaaatattccgattaggtatttattaggtacagttcgggtcgtgattatttaatcgcgatctttaatcttctatataattttagaatccattattt

SEQ ID NO: 43471 - protein, 154 aa, Panicum virgatum
  misc_feature: Ceres CLONE 2016715
  misc_feature (4)..(65): Pfam Name: HMA Pfam Description: Heavy-metal-associated domain
  misc_feature: SWISSPROT Homolog: EC 1.16.1.1 Mercury(II) reductase
MTLVEMCVHMDCPGCEKKVRKAVQRLEGVHDVEVDMAQQKVTVNGDVEQKKVLKAVRRTGRRAVLWPQPFAGGAAGAAHVLAQQQLLYNPAGAAGPAHATHAARPGSSYNYHKHGYDDSRLYGAYYHHGASSAVAGTRATDYFSDENAQGCAVM

SEQ ID NO: 43472 - DNA, 594 bp, Panicum virgatum
  misc_feature: Ceres CLONE 2016718
  misc_feature: Encodes the peptide sequence at SEQ ID NO. 43473
ttaatactgctaagcgatcgagaagccagttgggttgtgccaggcgatccatagatagagctagcagcaatggcgacctccctcccggccgcgcccctcctcgcccataccattaccagcctccggcatagtggcgccgccgcacgagctcctaatcctcggtccgttgccacggcgaggcccgcgggcgccaggaggagctcgctccgcaccgtcgccgtcaggtacggtgtcgacgaggcgttgcgccccgaggcggaggcggcggcggcgatgccgcgctccgtgccggtgcgcgtcgcctacgagctccatcaggccggccaccggtacctcgacgtcagaaccgaggccgagttcagcgctgggcatcccgaaggagctgtaaatatcccctacatgaacaagaccggctcagggatgaccaaaaacacccactttcttgagcaagtatcgagcatcttcggcaaggatgatgagatcatcgttggatgccaaagtggcaagaggtctctcatggcagcaactgaactctgctctactggtttcactgctgtgaccgacatcgctggtggattttcttcttggagggat

SEQ ID NO: 43473 - protein, 174 aa, Panicum virgatum
  misc_feature: Ceres CLONE 2016718
  misc_feature (73)..(174): Pfam Name: Rhodanese Pfam Description: Rhodanese-like domain
  misc_feature: SWISSPROT Homolog: EC 2.8.1.1 Thiosulfate sulfurtransferase
MATSLPAAPLLAHTITSLRHSGAAARAPNPRSVATARPAGARRSSLRTVAVRYGVDEALRPEAEAAAAMPRSVPVRVAYELHQAGHRYLDVRTEAEFSAGHPEGAVNIPYMNKTGSGMTKNTHFLEQVSSIFGKDDEIIVGCQSGKRSLMAATELCSTGFTAVTDIAGGFSSWR

SEQ ID NO: 43474 - DNA, 657 bp, Panicum virgatum
  misc_feature: Ceres CLONE 2016723
  misc_feature: Encodes the peptide sequence at SEQ ID NO. 43475
gggaagtctgtagcaagtcagcaagatgcaagctagagacgcacgcacggcacacggcacccacgccatggcttccggggcggcggacgacgacggcaccgaaacgcagcagcaaggcgcagcaccggcgccggcgccagcggctccgccttcctcgcccccacaggagcaggaggaggagatggcgccggcgccggcgctggagtcgctgcccctggagacccggtgcccgccgttcccgctccgccagctcaacggcttctggcttcccgagatcacgctggcggcgggcgtccccgccctccgcgcccgcttcacgccgcgccccacggacgtgctgctggcgagcttccccaagtccggcaccacctggctcaaggccctcgccttcgccgcgcggaaccgggccgcgcacccgccgtccgaccccgcccgccacccgctccgccgcagcaacccccacgacctcgtccggttcctcgaggtggagttcgcgctcgcggggggacgctccgccgccgccgccgccgccgcggacctcgaggacgagttcgaagcgctcccttccccgcgcaccatcgccacccacctccccctactccctgcttgccggagcgggtcaagtccgggtgccggatcgcctacgtctgcccggga

SEQ ID NO: 43475 - protein, 158 aa, Panicum virgatum
  misc_feature: Ceres CLONE 2016723
  misc_feature (7)..(65): SWISSPROT Homolog: EC 2.8.2.1 Aryl sulfotransferase
  misc_feature (45)..(65): SWISSPROT Homolog: EC 2.8.2.4 Estrone sulfotransferase
MAPAPALESLPLETRCPPFPLRQLNGFWLPEITLAAGVPALRARFTPRPTDVLLASFPKSGTTWLKALAFAARNRAAHPPSDPARHPLRRSNPHDLVRFLEVEFALAGGRSAAAAAAADLEDEFEALPSPRTIATHLPLLPACRSGSSPGAGSPTSAR

SEQ ID NO: 43476 - DNA, 944 bp, Panicum virgatum
  misc_feature: Ceres CLONE 2016726
  misc_feature: Encodes the peptide sequence at SEQ ID NO. 43477
aacgctgcatttctcgaacccattaaacaaagacaatcctcgatctttcgcctacctccagatctcagatccgaagagctccggccctctccaatggcggtcaaggtctacgtcgtgttctactccacttacgggcatgttgccaagctagctgaggagatcaagaaaggtgctgcctctgtcgaaggtgtggaggtgaagatatggcaggtccctgagattctgtccgacgaggtgctcggcaagatgggcgctcccccgaagacggacgcgccggtcatcacaccgcaggagctcgcggaggcggacgggatcctcttcgggttccccacgcgcttcggcatgatggcggcgcagatgaaggccttcttcgacgccaccggcggcctgtggcgggagcagagcctggccggcaagcccgccggcatcttctacagcaccggcacccagggcggcgggcaggagaccacgccgctgacggcggtgacgcagctgacgcaccacgggatggtgttcgtgccggtggggtacacgttcggcgccaagatgttcggcatggacagcgtgcagggcggcagcccgtacggcgccggcacgttcgccggggacggctcgcggtggcccacggaggtggagctggagcacgccttccaccagggcaagtacttcgccggcatcgccaagaggctcaagggcggctccgcctgatggctcgcgcgccatctatcgtcaccggcggcggcgcggcggcgatcgccatgcccttgctcgcgcggagctgcgcctacatatacgtaccatgttcttgtggatcttgttcgccactctatacggcggctagtgattcggtcggtcttatcgtggtcttgattgaactgctcgtggattggattaggtatgcggattgtgcatttgtgcttgatataccagggtatgatcgtatc

SEQ ID NO: 43477 - protein, 204 aa, Panicum virgatum
  misc_feature: Ceres CLONE 2016726
  misc_feature (7)..(138): Pfam Name: Flavodoxin_1 Pfam Description: Flavodoxin
MAVKVYVVFYSTYGHVAKLAEEIKKGAASVEGVEVKIWQVPEILSDEVLGKMGAPPKTDAPVITPQELAEADGILFGFPTRFGMMAAQMKAFFDATGGLWREQSLAGKPAGIFYSTGTQGGGQETTPLTAVTQLTHHGMVFVPVGYTFGAKMFGMDSVQGGSPYGAGTFAGDGSRWPTEVELEHAFHQGKYFAGIAKRLKGGSA

SEQ ID NO: 43478 - DNA, 636 bp, Panicum virgatum
  misc_feature: Ceres CLONE 2016727
  misc_feature: Encodes the peptide sequence at SEQ ID NO. 43479
gaagcaaggtgcaagcagagcccagagcagagagagccagcgagctgccgcggcgttcccgtgcgaagaatctccggcacgccggcgacggaggccgatcaggcaggcaagatggggcaccaagaagccgccaaggaggtgatcccgctgatgacgccgtacaagatgggccagttccagctctcccaccgggtggtgctcgcgccgctcacgcgctgccgctcctacggcaacgtgccgcagccgcacgccgccgtctactactcgcagcgcgccaccaggggcggcctcctcatcgccgaggccacgggcgtgtccgccaccgcgcaggggtacccggagacccccggcatctggacgccggagcaggtcgaggcgtggaagcccatcgtcgacgccgtccaccacaagggcggcatcttcttctgccagatctggcacgtcggcagggtctccaccaacgagctccagcctgacgggcaggcgcccatctcgagcacggacaggcagatttccccggaccccgagtccggcacggtgtactcgaagccgcgccggctggggaacgaggagatccggggcgtcgtcgacgacttccggcgcgccgcgcggaacgccatcgaggccggcttcgac

SEQ ID NO: 43479 - protein, 174 aa, Panicum virgatum
  misc_feature: Ceres CLONE 2016727
  misc_feature (12)..(174): Pfam Name: Oxidored_FMN Pfam Description: NADH:flavin oxidoreductase / NADH oxidase family
  misc_feature: SWISSPROT Homolog: EC 1.3.1.42 12-oxophytodienoate reductase
  misc_feature: Functional homolog of the protein sequence given in SEQ ID NO 51061
  misc_feature: Useful for making plants with modulated water use efficiency
MGHQEAAKEVIPLMTPYKMGQFQLSHRVVLAPLTRCRSYGNVPQPHAAVYYSQRATRGGLLIAEATGVSATAQGYPETPGIWTPEQVEAWKPIVDAVHHKGGIFFCQIWHVGRVSTNELQPDGQAPISSTDRQISPDPESGTVYSKPRRLGNEEIRGVVDDFRRAARNAIEAGF

SEQ ID NO: 43480 - DNA, 1359 bp, Panicum virgatum
  misc_feature: Ceres CLONE 2016731
  misc_feature: Encodes the peptide sequence at SEQ ID NO. 43481
gagacacaagctcacttcgtctccctcccctcctccgacctcccctgccatggaggccgacgccgcccaaaaccctaaccctaaccctagccccgccccgccgcccatttccgcctactaccagacgcgcgcggagcaccacgccgtcatctccagcgactggctggcccacgccgcggccgccgcggccgccaaccccggcgccgatgcggcggcggacgcggccgccgctccgcccccgtcccctgggggcgccggcggcgtgatcgaggagttcaacttctggcgccgcaagcccgaggctgcggaggcggtcgccgccatcatggcgctcgccgccgtcatccgctccagcagggccaccaccatgatggagctcgagatcgagctgaagaaggcctccgacaagctcaagtcctgggatgctacttccatttctctgtctgctgcttgcgatttgttcatgcggtttgtaacgagaacctcacatctggagcatgagaagtttgatgcagcaaaatcacgcttaattgagcgtggagaaaaatttggagagatatcattaaaggctcgcaagacaattgcaatgctcagccaggatttcatttatgatggatgtactatgcttgtacatgggtattccagagtggtattggaagttctaaagctagctgcatcaaatcgcaagctcttccgggtgctatgcacagagggcaggccagacagaactggtttaagaatgtcaaatgaacttgcagcattgggcatccctgttaaggtgctaattgattctgctgttgcttattccatggatgaaattgacatggtatttgttggtgctgatggggttgttgagagcggaggaataatcaacatgatgggcacttatcagatagctcttgtggctcatagtatgaacaaacctgtttacgtggcagctgaaagttacaagtttgctcgtctatatcccttggaccaaaaggacatgacgccagctcaccggccgatagattttggagtcccagtacccactggtgtggaagttgagacatcagcaagagactacacccctccgcaatatctcacgcttctcctgaccgatcttggtgttctcacaccatctgttgtgagcgatgagctcattcaattgtacctatgatcattgatgtggaaactgttgtctcaatcgaggtgttactgctattgaatccagggtttttcctgtcagttttgactatggtgtatcacctttatggtactgatgcgatgcttgaaaaactcttgagaatagttgtgcaagagaagataacaattttgtcatacacactttgtgtagctagctgtgataatttggtagcc

SEQ ID NO: 43481 - protein, 369 aa, Panicum virgatum
  misc_feature: Ceres CLONE 2016731
  misc_feature (80)..(357): Pfam Name: IF-2B Pfam Description: Initiation factor 2 subunit family
  misc_feature: SWISSPROT Homolog: EC 5.3.1.23 S-methyl-5-thioribose-1-phosphate isomerase
MEADAAQNPNPNPSPAPPPISAYYQTRAEHHAVISSDWLAHAAAAAAANPGADAAADAAAAPPPSPGGAGGVIEEFNFWRRKPEAAEAVAAIMALAAVIRSSRATTMMELEIELKKASDKLKSWDATSISLSAACDLFMRFVTRTSHLEHEKFDAAKSRLIERGEKFGEISLKARKTIAMLSQDFIYDGCTMLVHGYSRVVLEVLKLAASNRKLFRVLCTEGRPDRTGLRMSNELAALGIPVKVLIDSAVAYSMDEIDMVFVGADGVVESGGIINMMGTYQIALVAHSMNKPVYVAAESYKFARLYPLDQKDMTPAHRPIDFGVPVPTGVEVETSARDYTPPQYLTLLLTDLGVLTPSVVSDELIQLYL

SEQ ID NO: 43482 - DNA, 651 bp, Panicum virgatum
  misc_feature: Ceres CLONE 2016734
  misc_feature: Encodes the peptide sequence at SEQ ID NO. 43483
ctgtcctcttcctctcccttcttccccagccgcgcgaaaagacgagactacccagctgcctcgaagtcagagggggatagggtagcgcatcgtcgtcgctccggtcgtcggcgagccagcaggcagcgatggcggtggaggtagcggagctgtgggagacgctgaagcaggcgatcttcgcttacacggggctatccccggcggccttcttcacggccgtggcggtggcggccgcgctgtaccacatcgtgtcggggctcttcgcgcccccgcccccgccgccgccgcgcccgcgggaggagcccgaggcggagccgctcccgccgcccgtgcagatgggggaggtctccgaggaggagctccgccagtacgacgggtccgaccccaagaaaccgctcctcatggccatcaagggccagatctacgacgtctcccagagcagaatgttctatggtcctggtggaccttatgctctattcgctggtaaagacgccagcagggctctagccaagatgtccttcgagccacaggacttaaccggcgacatctctggccttggtccctttgagctggacgccctgcaggactgggaatacaagttcatgaggcagtacgtgaaagttggtaccgtcaagaagactgtcccagttg

SEQ ID NO: 43483 - protein, 174 aa, Panicum virgatum
  misc_feature: Ceres CLONE 2016734
  misc_feature (72)..(169): Pfam Name: Cyt-b5 Pfam Description: Cytochrome b5-like Heme/Steroid binding domain
MAVEVAELWETLKQAIFAYTGLSPAAFFTAVAVAAALYHIVSGLFAPPPPPPPRPREEPEAEPLPPPVQMGEVSEEELRQYDGSDPKKPLLMAIKGQIYDVSQSRMFYGPGGPYALFAGKDASRALAKMSFEPQDLTGDISGLGPFELDALQDWEYKFMRQYVKVGTVKKTVPV

SEQ ID NO: 43484 - DNA, 654 bp, Panicum virgatum
  misc_feature: Ceres CLONE 2016746
  misc_feature: Encodes the peptide sequence at SEQ ID NO. 43485
ggaggggagggcaatggcggtggtgggcgtcctcgcgctgcagggctcctacaacgagcacctggccgcgctgcggaggatcggggtgaggggcgtggaggtgcggaagccggagcagctcctcggcctcgactcgctcatcatccccagcggcgagagcaccaccatggccaagctcgccaactaccacaacctgtttccagcacttcgagagtttgtcagtggtggaaagcctgtctggggaacctgtgctgggcttatctttcttgcaaacaaagcagtagggcaaaaaacagggggccaggaacttgtcggaggactagattgtactgtccaccgtaacttttttgggagtcagctccaaagctttgagacagagctttctgtgccgaagcttgctgagaaggaaggagggaatgatacatgccgtggtgtttttatacgggcacctgctatattggaagaagaagtgtattcgaaagatcgggtaattgttgcggtacgacaagggaacattctagcaactgcctttcacccagaattgacatcagattcccgatggcatcgcttcttcttggacatggataaagaatcccaggcaaaggccttggccgcactatcattatcatcatcttcaagagacacagaacacct

SEQ ID NO: 43485 - protein, 213 aa, Panicum virgatum
  misc_feature: Ceres CLONE 2016746
  misc_feature (6)..(193): Pfam Name: SNO Pfam Description: SNO glutamine amidotransferase family
  misc_feature: SWISSPROT Homolog: EC 6.3.5.3 Phosphoribosylformylglycinamidine synthase
MAVVGVLALQGSYNEHLAALRRIGVRGVEVRKPEQLLGLDSLIIPSGESTTMAKLANYHNLFPALREFVSGGKPVWGTCAGLIFLANKAVGQKTGGQELVGGLDCTVHRNFFGSQLQSFETELSVPKLAEKEGGNDTCRGVFIRAPAILEEEVYSKDRVIVAVRQGNILATAFHPELTSDSRWHRFFLDMDKESQAKALAALSLSSSSRDTEH

SEQ ID NO: 43486 - DNA, 756 bp, Panicum virgatum
  misc_feature: Ceres CLONE 2016767
  misc_feature: Encodes the peptide sequence at SEQ ID NO. 43487
aagcggagcagccgacgcgagaccaggaccagggcgataggtaatcgagttctcggatcggtcgacgcgacgagatgtcttcgccagccgagtactacaattcacttccacctataagcaaggcatatgggacattgtgtttctttaccaccgtcctgtttcatctccacatactgaacccagaatttatttacttgtattacccctttgtgttcaagaagtttgagatatggaggttatttacaaatttcttttttctgggcccgttttccatcaactttggtattcgttttctgatgatagcaaggtatggtgtgcagttggaaaagggggcgttcgaaaagcgcactgctgatttcttgtggatgatgatatttggtgccatctcactactggtactgtcagctattcccctatttaagcttccgttcttgggaatacctatggtcagcatgcttctatatgtctggagccgagagtatccaaatgctcagataaatatgtatggtctcgtccaattgaggtctttttatcttccatgggctatgcttggattggatgtgatatttggctcaccattactgcctggctttatgggtatcatagttggacatctatactacttccttgcagttttgcacccgctagccaccggaaagaattacctgaagactccgaaatgggtacacagcatcgttgctcgattcagaataggtgtgcaggcaaacgctcccggtccgaccagcagccaacgct

SEQ ID NO: 43487 - protein, 227 aa, Panicum virgatum
  misc_feature: Ceres CLONE 2016767
  misc_feature (11)..(202): Pfam Name: DER1 Pfam Description: Der1-like family
MSSPAEYYNSLPPISKAYGTLCFFTTVLFHLHILNPEFIYLYYPFVFKKFEIWRLFTNFFFLGPFSINFGIRFLMIARYGVQLEKGAFEKRTADFLWMMIFGAISLLVLSAIPLFKLPFLGIPMVSMLLYVWSREYPNAQINMYGLVQLRSFYLPWAMLGLDVIFGSPLLPGFMGIIVGHLYYFLAVLHPLATGKNYLKTPKWVHSIVARFRIGVQANAPGPTSSQR

SEQ ID NO: 43488 - DNA, 845 bp, Panicum virgatum
  misc_feature: Ceres CLONE 2016771
  misc_feature: Encodes the peptide sequence at SEQ ID NO. 43489
aactaacgctaaaaaagtaacagtttctgtactttattgcttcgaggaaggatgaagctgaacatcgcgtacccgcgcaacggcacctgcaagcagttcgagtgcagcgacgaccacatccgaaagggcaacctcttcgaccaccgtctcggccacgacgtcgatggtgcgctcttcggtcccgagttcaagggctacatcttccgcctgaagggtggctcggacaaggacggcttcccgatggtccacggtgtgctcgccaacgcccgcgtgtcgctgctcctgaagcgcggcgccatcaacttcgccgccttccgtggccgctcgggcgagcgccgccgcaagtcggtccgcggctgcatcatcggtgcggacatcgcgtgcctgaacgccgtgatcctgaaggtcggcgatgccccgatcgagggtgtcacggacgtgtcggccccgaagcgcctcggcccgaagcgcgcgtcgaagatccgcaagatgttcaacctcggccgcgaggacgacgctcgccgctacgtgatcaagcgcacggttgagaagaaggacaagaagcgcgtcaaggtcgcgcacgtgcagcgcctcgtcacgaagaagaccaaggcgaaccgcgtgaagaagctgaaggcccgcaaggagtcggccaagcacaccgccgagctccgccgcgagttcctccacgccgtcggcaaggagcgcatggccgcccgccagcgcaagaacgcccgcgcccaccgcgtcgccgctgccctgcagtcgaagacgaccaagaagtcggtcaaggcgtaagcccatccagtcttgaagcttttcgcatcctccctacggatttcatg

SEQ ID NO: 43489 - protein, 248 aa, Panicum virgatum
  misc_feature: Ceres CLONE 2016771
  misc_feature (1)..(130): Pfam Name: Ribosomal_S6e Pfam Description: Ribosomal protein S6e
MKLNIAYPRNGTCKQFECSDDHIRKGNLFDHRLGHDVDGALFGPEFKGYIFRLKGGSDKDGFPMVHGVLANARVSLLLKRGAINFAAFRGRSGERRRKSVRGCIIGADIACLNAVILKVGDAPIEGVTDVSAPKRLGPKRASKIRKMFNLGREDDARRYVIKRTVEKKDKKRVKVAHVQRLVTKKTKANRVKKLKARKESAKHTAELRREFLHAVGKERMAARQRKNARAHRVAAALQSKTTKKSVKA

SEQ ID NO: 43490 - DNA, 687 bp, Panicum virgatum
  misc_feature: Ceres CLONE 2016789
  misc_feature: Encodes the peptide sequence at SEQ ID NO. 43491
gcagcagccccggaccgtgcagcggatagtcggggagaggaacatcctcgagctcatgggcgccgaccacaagcgcatccgcggcgcgctcctcgagttcctcaagccggacatgctcaggctgtacgtgggcaagatcgacggcgaggtgcgccgccacctcgacgagaactgggccggcagccggaccgtcacggtcatgcccctcatgaagaagctcacattcgacatcatctccctgctgctcttcggcctcgagcgaggcaccgtccgggacgccctcgccggcgacttcaagcacatcatggacggcacatgggccgtcgtcccctgggacctgccgctcacggcgttccgccggagcctgaaggccagcgccagtgctcgccgggtgatcgccgggatcatacgggagacgaaggccaagctggagcggggcgaggcctcccggagcagcgacctcatcgcgtgtctgctcagcttgaccgacgacagcggcgcgcggctgctgagcgacaaggagatcgtggacaacgccgtggtctccttcatcgccggccacgacacgtcctccatccttctcaccttcctgatccgccagctcgccaacgatccagacacgctcaccgccatggtccacgagcacgaggagatcgccaagagcaagggcgacggcgaggcactgac

SEQ ID NO: 43491 - protein, 228 aa, Panicum virgatum
  misc_feature: Ceres CLONE 2016789
  misc_feature: SWISSPROT Homolog: EC 1.14.13.77 Taxane 13-alpha-hydroxylase
QQPRTVQRIVGERNILELMGADHKRIRGALLEFLKPDMLRLYVGKIDGEVRRHLDENWAGSRTVTVMPLMKKLTFDIISLLLFGLERGTVRDALAGDFKHIMDGTWAVVPWDLPLTAFRRSLKASASARRVIAGIIRETKAKLERGEASRSSDLIACLLSLTDDSGARLLSDKEIVDNAVVSFIAGHDTSSILLTFLIRQLANDPDTLTAMVHEHEEIAKSKGDGEAL

SEQ ID NO: 43492 - DNA, 674 bp, Panicum virgatum
  misc_feature: Ceres CLONE 2016805
  misc_feature: Encodes the peptide sequence at SEQ ID NO. 43493
aaagcttccagcactagaagagctagctccgaacaagcacttcagcaaattcaccagcagtgtccgatccgcgctcagaaacccaaccggcaacaatgtcgctggtgaggcgcagcaacgtgttcgaccccttcgccgacttctgggaccccttcgacgtcttccgctccgtggtgcccgcggcatcgaccgaccgcgacaccgccgccttcgccaacgcgcgcatcgactggaaggagagccccgaggcgcacgtcttcaaggccgacctccccggcgtcaagaaggaggaggtcaaggtggaggtggaggacggcaatgtcctggtgatcagcggcgagcgcagcaaggaggaggacaagtacgacaagtggcaccgcgtggagcgcagcagcggcaagttcctccgccggttccgcttgccggagaacgccaagacggaccaggtgaaggccgggctggagaacggcgtgctcaccgtcgccgtgcccaaggccgaggtcaagaagcccgaggtgaaggccatcgagatctctggctgagagcttgatcttcaagaggtcgcgcaagctatgtcgtgctcgggtcagtgtctggtcgtcgtgttcctgaatcctgttctttgatgatgtcgtacgtgtcggtcgtacgtgtcggtcatgttgtggtcaatg

SEQ ID NO: 43493 - protein, 148 aa, Panicum virgatum
  misc_feature: Ceres CLONE 2016805
  misc_feature (45)..(147): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFADFWDPFDVFRSVVPAASTDRDTAAFANARIDWKESPEAHVFKADLPGVKKEEVKVEVEDGNVLVISGERSKEEDKYDKWHRVERSSGKFLRRFRLPENAKTDQVKAGLENGVLTVAVPKAEVKKPEVKAIEISG

SEQ ID NO: 43494 - DNA, 659 bp, Panicum virgatum
  misc_feature: Ceres CLONE 2016807
  misc_feature: Encodes the peptide sequence at SEQ ID NO. 43495
agttgacgaagtgatccagcgaatgaaagacagcaccgtgcagttcttcagctcgccgttggagagcaagaacaaagtggcggaccgagagaacggcttcaaagggttcgggcaccactacagcagggcgtcaggaggtaagctggactgggcagagagcgtaatcctcatcacgcagccaccccaagacaggaacatggagatgtggcctaccaacccacccacatttagggacgcgcttgaggcgtactcggtggagatgatcggtctcgcgacgaagctcctgggcttcatggcggccgacctcggggtggaccgggaggcgctcgtcggcgccttcacggggaggcggcagagcatggcgatccaccactacccgccctgcccccaccgggagaaggtgctgggcatcacgccgcacaccgacgggctgggcctgacgctgctgctgcacgtggacgacacgccgggcctgcagatcaggaggggcggccggtggttcccggtgcggccgctgccgggcgccttcgtcgtcaacgtcgctgacatcctcgacgtcctcagcaacggcgcgtacaggagcgtcgaccaccgggtgctcccggacgccgagagggcccgcaccaccgtcgtgatattccaggaggccgccgtcggag

SEQ ID NO: 43495 - protein, 219 aa, Panicum virgatum
  misc_feature: Ceres CLONE 2016807
  misc_feature (116)..(216): Pfam Name: 2OG-FeII_Oxy Pfam Description: 2OG-Fe(II) oxygenase superfamily
  misc_feature: SWISSPROT Homolog: EC 1.14.11.19 Leucocyanidin oxygenase
VDEVIQRMKDSTVQFFSSPLESKNKVADRENGFKGFGHHYSRASGGKLDWAESVILITQPPQDRNMEMWPTNPPTFRDALEAYSVEMIGLATKLLGFMAADLGVDREALVGAFTGRRQSMAIHHYPPCPHREKVLGITPHTDGLGLTLLLHVDDTPGLQIRRGGRWFPVRPLPGAFVVNVADILDVLSNGAYRSVDHRVLPDAERARTTVVIFQEAAVG

SEQ ID NO: 43496 - DNA, 662 bp, Panicum virgatum
  misc_feature: Ceres CLONE 2016827
  misc_feature: Encodes the peptide sequence at SEQ ID NO. 43497
aagaagagggaggagggcaagcgaccggcctgcccccaaaacccccgctctcatctccgtcaaaacccctagcgaagcctccccctctccagtctccaccttttcgccggtcgcctgctcgaaagcaaccgcggaggggaagaagctgctgcgcaggagaagaaacggcggcggcgtgtaggctgctgcaggccggagagggcaagcttttggcagtggcggcggttttggaatgcagcagcagcagcagcacctgatgcagatgaaccagagcatgattgggggctacgcatcccctaccgctgtcaccaccgatcacatccagcagtacctggatgagaacaagcagctgatccttgccatcctcgacaaccagaacaatgggaaggtggaagagagcgaacggcaccaagctaagctccagcacaacctcatgtacctggccgccatcgccgatagtcagccgccacagaccgcaccgctgtcacagtacccgtccaacctgatgatgcagccgggcccgcggtacatggggccgcagtcggggcagatgatgagcccgcagtcgctgatggcggcgcggtcctccatgatgtacgcgcacccgtccctgtcgccgcttcagcagcagcaggcggcgcacggccagcttggcatggccc

SEQ ID NO: 43497 - protein, 143 aa, Panicum virgatum
  misc_feature: Ceres CLONE 2016827
  misc_feature (18)..(88): Pfam Name: SSXT Pfam Description: SSXT protein (N-terminal region)
MQQQQQHLMQMNQSMIGGYASPTAVTTDHIQQYLDENKQLILAILDNQNNGKVEESERHQAKLQHNLMYLAAIADSQPPQTAPLSQYPSNLMMQPGPRYMGPQSGQMMSPQSLMAARSSMMYAHPSLSPLQQQQAAHGQLGMA

SEQ ID NO: 43498 - DNA, 682 bp, Panicum virgatum
  misc_feature: Ceres CLONE 2016832
  misc_feature: Encodes the peptide sequence at SEQ ID NO. 43499
agccaagcaagccatatgcgagcgctgcctcgcgttggccagcccgtgcgctggatgatggcctcgcgcgcgcggccgcggcgggcgatggggtcggcggcggcgggcggcgggagggatcccgccgagaacccgaaggtggggaggctgcgggagctcttcgtcggcgacgcggcagatgggtgggagaagtcttgggagtttgatgtgaccccgtgggatttgggaaagccaacacctgtcattgaacatcttgttagatcaggaacactgccgaatggaagagctttggttcctggatgcggaatgggatacgatgtggtggctctggcatgccctgaacgatttgttattggcttggatatttctgatatggctgttaagaaggctaagcagattattttacttttctggcagaagatttcttcaactgggttcttctgtgcgcttgacccaagcttgagggtggcttgggcagagacagttaaccggctgctaaaacctgatggagagcttctcaccttgatttatctgatcagtgatcaagagggaggaccaccatacaataatacagttgctgactatcagaaggtactggaaccgttgggattcagggctgttcttatggaagataatgaactggccattaaaccacggaagggctgcgagaaacttgggagat

SEQ ID NO: 43499 - protein, 198 aa, Panicum virgatum
  misc_feature: Ceres CLONE 2016832
  misc_feature (28)..(198): Pfam Name: TPMT Pfam Description: Thiopurine S-methyltransferase (TPMT)
  misc_feature: SWISSPROT Homolog: EC 2.1.1.67 Thiopurine S-methyltransferase
MGSAAAGGGRDPAENPKVGRLRELFVGDAADGWEKSWEFDVTPWDLGKPTPVIEHLVRSGTLPNGRALVPGCGMGYDVVALACPERFVIGLDISDMAVKKAKQIILLFWQKISSTGFFCALDPSLRVAWAETVNRLLKPDGELLTLIYLISDQEGGPPYNNTVADYQKVLEPLGFRAVLMEDNELAIKPRKGCEKLGR

SEQ ID NO: 43500 - DNA, 637 bp, Panicum virgatum
  misc_feature: Ceres CLONE 2016840
  misc_feature: Encodes the peptide sequence at SEQ ID NO. 43501
aggcgcaccccaacagggcccgtgcggcacgcgggcggcagcgcgacagcagcaggggagggcggcggcgcggcggcagcaggggcgagcgggaggcgcggcagcagcaggaggggggctgggcaggcggcgcaggagggggttcggggggcggggcggcgcagctcgctagacgggggtgcggaagctcggagacgaggggtatcgggggcagggggaggaaaatcccctcgcttctcgggtgcgcggctcctgggacgcggtgggaaaaatcccctttcacgttgtattcgtgattccgggagaagctacgacccacctaatcgagaaataagcagaccgtttgggtgggattttggattatttccatccacaatcggattataagcgaatacaaacacccccagagtcggagagatgcggggagtcggaggtccgctcctcaccatcggagatctcctcagcgacctcgccgtcgacggcggcgatgatcccctcgccgctggcggagatgcgtccgttccctcctctccctcggcggaacaacaggcgggggaagccgacccgtccgacctcagccggctcttctaggtatggttcttgctttcccgtttctgatgaaggcgctccaagagaa

SEQ ID NO: 43501 - protein, 57 aa, Panicum virgatum
  misc_feature: Ceres CLONE 2016840
  misc_feature: Functional homolog of the protein sequence given in SEQ ID NO 51223
  misc_feature: Useful for biocontainment applications
MRGVGGPLLTIGDLLSDLAVDGGDDPLAAGGDASVPSSPSAEQQAGEADPSDLSRLF

SEQ ID NO: 43502 - DNA, 725 bp, Panicum virgatum
  misc_feature: Ceres CLONE 2016860
  misc_feature: Encodes the peptide sequence at SEQ ID NO. 43503
accaatccactcgatcagtgaccaccacctcctccccgagctcccaacaacacttggcaagctagacctccttcctactgcctgcaatcagctgagaacgaagggaagaggatgaggtcgattgcgctcgccatcgcggcgatggcctgcctggcggcggtggcgcgggccggcaacttctaccaggacacggagatgacctggggcggcgggcgcggaaaggtcgtggacggcggccgcgggctcgacctcacgctggaccgcacctccggctccgggttccagtccaggagcgagtacctcttcggcaagatcgacatgcagatcaagctggtccccggcaactccgccggcaccgtcaccaccttctacctctcgtcgcaggggagcgcccacgacgagatcgacttcgagttcctgggcaacgtcaccggcgagccctacacgctgcacaccaacgtgttcacgcaggggcagggccagcgcgagcagcagttccgcctctggttcgaccccaccaccgcctaccacacctactccatcgtctggaacccgcagcacatcatgtgagtccccagcagtctctccctctcatcgcatcgccgccttctcaatcttctttccggagaccacagcagcagacacggtcgctgacaggcaagctcctgggttggcatgcagcttcgcggtggacggcaccccgatccgcgacttcaagaaccacg

SEQ ID NO: 43503 - protein, 152 aa, Panicum virgatum
  misc_feature: Ceres CLONE 2016860
  misc_feature (23)..(152): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50724
  misc_feature: Useful for making plants with altered carbohydrate content
  misc_feature: Functional homolog of the protein sequence given in SEQ ID NO 50385
  misc_feature: Useful for making plants with altered cell wall content and/or composition
MRSIALAIAAMACLAAVARAGNFYQDTEMTWGGGRGKVVDGGRGLDLTLDRTSGSGFQSRSEYLFGKIDMQIKLVPGNSAGTVTTFYLSSQGSAHDEIDFEFLGNVTGEPYTLHTNVFTQGQGQREQQFRLWFDPTTAYHTYSIVWNPQHIM

SEQ ID NO: 43504 - DNA, 762 bp, Panicum virgatum
  misc_feature: Ceres CLONE 2016868
  misc_feature: Encodes the peptide sequence at SEQ ID NO. 43505
aaaaaccccagccccgcacctcctcttcccccaccgccgccgcaacacagcgcgagcacccccgcctcttctgtctcgttctcgcagagggtttcaggcgttgtatgtaggatcagatggcgctggcaatctccatggaaggaatcgaggcgcgtgcgcgggagctcggggtggacctctccgccgtcgatctggactccatcaccctcccggccggcgaggacttcggcatcctcagtgatgatgaggagatacttcgaaatgaggaccctcctgaacttgaaatgggtttatccaacattatcgtagtggacaatctgccggtcgttcctccagaaaaatttgagaagcttgagaatgttattcgcaagatatacagccaaattggagtgataaaagacaatggtctatggatgccggtcaacccagatacaaagaagacatatggctactgtttcattgagtataatacccctcaggaagctgagcttgcaagggaaaaaacaaatgggtacaagctcgacaagtctcatatccttgcagttaacatgcttgatgactttgggaaatacatgaaagttcctgacacatggacgcctgcagaaataaatccatacactcttggagaaaatcttctgaaatggctaactgatgaaaaggcccgagatcagtttgtcctccgtgctggtacattgacagaagtttactggaatgatgttagaaagctggcacctgaactcgtgtttcaaaagcagggataat

SEQ ID NO: 43505 - protein, 214 aa, Panicum virgatum
  misc_feature: Ceres CLONE 2016868
  misc_feature (63)..(142): Pfam Name: RRM_1 Pfam Description: RNA recognition motif. (a.k.a. RRM, RBD, or RNP domain)
MALAISMEGIEARARELGVDLSAVDLDSITLPAGEDFGILSDDEEILRNEDPPELEMGLSNIIVVDNLPVVPPEKFEKLENVIRKIYSQIGVIKDNGLWMPVNPDTKKTYGYCFIEYNTPQEAELAREKTNGYKLDKSHILAVNMLDDFGKYMKVPDTWTPAEINPYTLGENLLKWLTDEKARDQFVLRAGTLTEVYWNDVRKLAPELVFQKQG

SEQ ID NO: 43506 - DNA, 678 bp, Panicum virgatum
  misc_feature: Ceres CLONE 2016870
  misc_feature: Encodes the peptide sequence at SEQ ID NO. 43507
tctccgaccgccgactgaatctacctcgcttcgcgcctccggttccgcgccgggcccgccagaatcggagctcgggatcgcctcggcccgtggcaatgggagctgactgcgaggacgccgtcaagcagctcagcagcctcatggagcaagtggaggcgccgctgaagagatcgtttcagaatgtgcaccagggttatcccaaagaaacattgatgcgtttcctaagggctagagagtggaacgtatctaaggctcataaaatgattgtagattctttgaattggaggattcaaaatgaaattgatagcgtgctggagagacctatagtcccagtagatttatacagatcaatacgtgattcacaacttgttggcctatcaggatacacaaaggagggtctcccggtttttgccattggtgttggacatagcacatatgacaaagcttcagtccactactacgtgcaatctcatatccaaattaatgagtaccgtgatcgtatacttttgcctaggttgtcccaacagtttgggcgccctgttaccagctgtataaaagttctggatatgactggtttgaagctatcagcactgagccaaataaagatgttgacttccatatcgacagttgatgatctgaattaccctgaaaagacagagacctattatgtagtttatg

SEQ ID NO: 43507 - protein, 194 aa, Panicum virgatum
  misc_feature: Ceres CLONE 2016870
  misc_feature (9)..(69): Pfam Name: CRAL_TRIO_N Pfam Description: CRAL/TRIO, N-terminus
MGADCEDAVKQLSSLMEQVEAPLKRSFQNVHQGYPKETLMRFLRAREWNVSKAHKMIVDSLNWRIQNEIDSVLERPIVPVDLYRSIRDSQLVGLSGYTKEGLPVFAIGVGHSTYDKASVHYYVQSHIQINEYRDRILLPRLSQQFGRPVTSCIKVLDMTGLKLSALSQIKMLTSISTVDDLNYPEKTETYYVVY

SEQ ID NO: 43508 - DNA, 765 bp, Panicum virgatum
  misc_feature: Ceres CLONE 2016876
  misc_feature: Encodes the peptide sequence at SEQ ID NO. 43509
tattctggatgtcttggcaagattttcagattcactttcggtcaatatatgtctgtcgtgtttatccacctgagatgcgttactctgtccatgggcaatggcgtggctatagtgcaggtggttgccaagattttgattcatggcatcaaaatcctcagtatcgacttagagtaacaggacgtgacgcactatatcctgttcatgtttttattacccttactcagggtgttggtttctctagaaagacgaacggtttccgaaactaccaatcgagtcatgattcttcaatgttatacattggactgaggatactcaagacacagggctgtcgggctgcctacaatatctacatgcatgaatcagcgggtggatcagattacgttaactcaagagagatatcatgtgaactagtcttggatccttatcctaaaggatacacgattgtgccaagtaccatccatcctggggaggaagcaccttttgttctgtcagttttctcaaaagcaccaatcaagctagaggctatttaattcaagattgatatcccatgtgtccagtgacagctgcggctgctgggcagggcttcttgtccgtgaaatgtccagctgtgggttctcgaaggcttgaaactgggtataagaattgcctctagatgattctgcagctctgctcttggacctgaagtgagcttcatcagatcttgctacatgcaagtacttaagtttggattgcttgctgcaaaactgatagaaaaaggcaatggtt

SEQ ID NO: 43509 - protein, 175 aa, Panicum virgatum
  misc_feature: Ceres CLONE 2016876
  misc_feature (26)..(173): Pfam Name: Calpain_III Pfam Description: Calpain large subunit, domain III
  misc_feature: SWISSPROT Homolog: EC 3.4.22.54 Calpain-3
  misc_feature: The sequence is a functional homolog of SEQ ID NO 24 in US patent 7189889
FWMSWQDFQIHFRSIYVCRVYPPEMRYSVHGQWRGYSAGGCQDFDSWHQNPQYRLRVTGRDALYPVHVFITLTQGVGFSRKTNGFRNYQSSHDSSMLYIGLRILKTQGCRAAYNIYMHESAGGSDYVNSREISCELVLDPYPKGYTIVPSTIHPGEEAPFVLSVFSKAPIKLEAI

SEQ ID NO: 43510 - DNA, 645 bp, Panicum virgatum
  misc_feature: Ceres CLONE 2016887
  misc_feature: Encodes the peptide sequence at SEQ ID NO. 43511
gcatccacttcccgggcagaacagcaaaaggaatccaagtggttggtggtgagccatggcaagcagctcccaagaagttcctgccgctgcgaggaagctggagggcaaggtggcggtgatcaccggcggcgcgagcggcatcggcgcgtgcacggcgcggctgttcgtgaagcacggcgcccgcgtcgtggtcgccgacatccaggacgagctcggcgcgagcctctgcgccgagctcggcccggagaactccagctacgtgcactgcgacgtgtccgacgaggccgacgtcgccggcgccgtggaccacgccgtggctaggttcggggggctggacgtcatgctcaacaacgccggcatctccggcgagatgtgcttcagcatccgggacggcgccaaggaggagctggagcgcgtgctggccgtgaacgtggtgggcccgttcctgggcacgaagcacgcggcgcgggtgatggtgcccgctcgccggggctgcatcatctccacgtcgagcttggtgtcggcggtgggcggcgcggggccgcacgcgtacacgacctcgaagcacgccctggtggggctcatgaagaacgcggcggcggagctgggccggcacgggatccgcgtcaactgcgtcgcccccgc

SEQ ID NO: 43511 - protein, 196 aa, Panicum virgatum
  misc_feature: Ceres CLONE 2016887
  misc_feature (18)..(185): Pfam Name: adh_short Pfam Description: short chain dehydrogenase
  misc_feature: SWISSPROT Homolog: EC 1.1.1.288 Xanthoxin dehydrogenase
  misc_feature: Functional homolog of the protein sequence given in SEQ ID NO 50862
  misc_feature: Useful for making plants with modulated salt sensitivity
  misc_feature: Functional homolog of the protein sequence given in SEQ ID NO 50863
  misc_feature: Useful for making plants with modulated drought sensitivity
  misc_feature: Useful for making plants with modulated water use efficiency
  misc_feature: Functional homolog of the protein sequence given in SEQ ID NO 50917
  misc_feature: Useful for making plants with modulated biomass
MASSSQEVPAAARKLEGKVAVITGGASGIGACTARLFVKHGARVVVADIQDELGASLCAELGPENSSYVHCDVSDEADVAGAVDHAVARFGGLDVMLNNAGISGEMCFSIRDGAKEELERVLAVNVVGPFLGTKHAARVMVPARRGCIISTSSLVSAVGGAGPHAYTTSKHALVGLMKNAAAELGRHGIRVNCVAP

SEQ ID NO: 43512 - DNA, 988 bp, Panicum virgatum
  misc_feature: Ceres CLONE 2016896
  misc_feature: Encodes the peptide sequence at SEQ ID NO. 43513
gaaaagcttaatttaagttctaaaataaaaggatcttatggctatcggcaagaataagaaattaggaaagaagaagggtgccaagaagaaggttcaagatcccttccttagaaaggaatggtacgatgttaaggcccctgccccattcaccaagagatacattggcaagacctgcgtcaccagaactaccggcacaagaatcgccaccgactacttgaagggaagagttgtcgaaacctcctatgctgaattgagcgacaaccaagacagctggagaaagatcaagctctctatcgaagatatccaaggaagagcctgcatgaccaacttccacgctatggatatgactagagacagactttgccaattcatcagaaagtggcaaactttgatcgacgctaactgcgaagccaagactaatgatggttatgttttgagagttttcgtcactgctttcaccggcagacaacaaaaccaagccagaaagaccagttatgctcaacaccaacaaatcaaggtcatcagaaagaagatcgtcgacatcatcaccgctgaagctgccaagtctgccctccccgatttcgtcgctaagctcaaccacgttgacgctttctccaagcaaatcaccaaggcctgccaattcgtctatcccttgagcgctgtcgtcatcagaaaggtcaagaccttgaagaagcccaagttcgacattgttcgtttgaacgaattatacaaggaacaacccgtcaaggttgatgccagaagaggaaaaggtaaaggtgctgaaggtgctgaacccgctgccgaaaatttgttacaataagttcaacacggttaggtgaaattgagaacagtagggtctttaaaaatagcatgttttcgtaaatgcatctctcttgtaaaattgtgatgagactttcaaaacaaagacttaaagagtagcaatagaatcataaattatttataccctattccataaagaaaatcacac

SEQ ID NO: 43513 - protein, 260 aa, Panicum virgatum
  misc_feature: Ceres CLONE 2016896
  misc_feature (10)..(221): Pfam Name: Ribosomal_S3Ae Pfam Description: Ribosomal S3Ae family
MAIGKNKKLGKKKGAKKKVQDPFLRKEWYDVKAPAPFTKRYIGKTCVTRTTGTRIATDYLKGRVVETSYAELSDNQDSWRKIKLSIEDIQGRACMTNFHAMDMTRDRLCQFIRKWQTLIDANCEAKTNDGYVLRVFVTAFTGRQQNQARKTSYAQHQQIKVIRKKIVDIITAEAAKSALPDFVAKLNHVDAFSKQITKACQFVYPLSAVVIRKVKTLKKPKFDIVRLNELYKEQPVKVDARRGKGKGAEGAEPAAENLLQ

SEQ ID NO: 43514 - DNA, 560 bp, Panicum virgatum
  misc_feature: Ceres CLONE 2016907
  misc_feature: Encodes the peptide sequence at SEQ ID NO. 43515
aggtagtattgcctcctcgctcattctctcactaactttactaaacccaaagaattgggccattcttcctgagcggagggggaggaggaggattgggtatacatatagtggtttggatatataggaggatatatatagatcgatagctataggggtaggaatggggctgagggagatggacgcggcggtggcgcggggtttccgcttgggcccgggcgaggaggagcgggtgtgcgtgtacctgcgcaacaaggtcgcgaaccagaggttcgcctcggggaccttggtcgaggtcgacctccatgcccgcgagccatgggagcttcccgatgtcgctaagcttaccgcagaggagtggtacttcttcagcttccgggacaggaagtactccacaggcttgcgaacaaaccgcgcaacaaagacgggttattggaaggcgactgggaaggatcgggctgtccccgagcagggcacacgtgcattggttggcatgaggaataccctggtgttccaccgtggtcgtgcttcccattgggcagaagaacatttgggttcttgca

SEQ ID NO: 43515 - protein, 133 aa, Panicum virgatum
  misc_feature: Ceres CLONE 2016907
  misc_feature (10)..(131): Pfam Name: NAM Pfam Description: No apical meristem (NAM) protein
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 476 in the 10/666,642 US patent application
  misc_feature: Functional homolog of the protein sequence given in SEQ ID NO 51050
  misc_feature: Useful for making plants with altered lignin content
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Functional homolog of the protein sequence given in SEQ ID NO 50639
  misc_feature: Useful for making plants with altered terpenoid content
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Functional homolog of the protein sequence given in SEQ ID NO 50642
  misc_feature: Useful for biocontainment applications
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 1729 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
MGLREMDAAVARGFRLGPGEEERVCVYLRNKVANQRFASGTLVEVDLHAREPWELPDVAKLTAEEWYFFSFRDRKYSTGLRTNRATKTGYWKATGKDRAVPEQGTRALVGMRNTLVFHRGRASHWAEEHLGSC

SEQ ID NO: 43516 - DNA, 728 bp, Panicum virgatum
  misc_feature: Ceres CLONE 2016910
  misc_feature: Encodes the peptide sequence at SEQ ID NO. 43517
cctcccagcgccgtcctcgagccgcttgcctgccccgccgaagggcggaatggcctcgctgcctcccggcgccgactccgaccagcttttgatagaagcaaatggctctacacggacactgattttgaacaggccaaagcagctgaatgctctctcctcctcaatgattatgggactcttgaggtgtttcactgcttacgagaaagatgatggagttaaagtgttgattatgaaggggaaaggaagagcattttgtgctggaggtgatgttgctgctgttgtccgggatataaacaatgacacctggaaatacggtgctgatttcttccgaaatgaatttttgttaaactacatcatcgcaacttatagcaaacctcaggtttctcttcttgctggaattgttatggggggaggtgctggtgtttctttacatggaaggtttcgagttgcgaccgaaaacacggtttttgcaatgccagagacagcattgggactctttccagatataggggcttcttattttctgtctcggctacctggtttctatggagagtatgttgctcttgccggtgcaagattggatggtgcagaaatgcatgcgtgtggtctggcaactcattttgtccagttaaataggctgccgttactggaggaatcgcttaaaaggtggacacctccaatccttttgctttgtgtggtattattgatcaattttctcatcagccatc

SEQ ID NO: 43517 - protein, 226 aa, Panicum virgatum
  misc_feature: Ceres CLONE 2016910
  misc_feature (22)..(193): Pfam Name: ECH Pfam Description: Enoyl-CoA hydratase/isomerase family
  misc_feature: SWISSPROT Homolog: EC 3.1.2.4 3-hydroxyisobutyryl-CoA hydrolase
MASLPPGADSDQLLIEANGSTRTLILNRPKQLNALSSSMIMGLLRCFTAYEKDDGVKVLIMKGKGRAFCAGGDVAAVVRDINNDTWKYGADFFRNEFLLNYIIATYSKPQVSLLAGIVMGGGAGVSLHGRFRVATENTVFAMPETALGLFPDIGASYFLSRLPGFYGEYVALAGARLDGAEMHACGLATHFVQLNRLPLLEESLKRWTPPILLLCVVLLINFLISH

SEQ ID NO: 43518 - DNA, 671 bp, Panicum virgatum
  misc_feature: Ceres CLONE 2016915
  misc_feature: Encodes the peptide sequence at SEQ ID NO. 43519
agctcagataatagtaacagctcctttcctccctctcgaggtgtctcccaaaacacaccccaccccaccccatcgccgcagtcactgagccaagaacaagagcagcgcgatgagaggaggagcggggcccacggtggcgttcgtcgccggcgactcgcctccggatgcagcggcggaggaggaggtggaggagaactctggcggcgaggaggagcagcaggaggacgacgagctggagctggggctctgcctaggctccaagaaacagcagcagcccccgtcgccagcgccgtgccggatcctgacggccagggacctgcagccgggggccctatctccggactcctccgtgtcctcctcctcccccgcggcaggggcagcggcggccagcaagagggccaaggcggatacagcgcccaacgccaccacctcgccggggacggtcgcttctggccacccacagagcagctttggagttgtcggatggccacccataagaactttcaggatgaacagcctattcaaccaggccaaagacaatgcttcagaggctggcaccaagaaggctgccgatgaatcttgcatgcagaaagacaagaaggagagcgagaagaaaggacggattgtcggctgggtgaaggtgaacatggatggagatatcattgggagga

SEQ ID NO: 43519 - protein, 187 aa, Panicum virgatum
  misc_feature: Ceres CLONE 2016915
  misc_feature: The sequence is a functional homolog of SEQ ID NO 1149 in the 10/412,699 US patent application
  misc_feature: The sequence is a functional homolog of SEQ ID NO 742 in the 10/374,780 US patent application
MRGGAGPTVAFVAGDSPPDAAAEEEVEENSGGEEEQQEDDELELGLCLGSKKQQQPPSPAPCRILTARDLQPGALSPDSSVSSSSPAAGAAAASKRAKADTAPNATTSPGTVASGHPQSSFGVVGWPPIRTFRMNSLFNQAKDNASEAGTKKAADESCMQKDKKESEKKGRIVGWVKVNMDGDIIGR

SEQ ID NO: 43520 - DNA, 737 bp, Panicum virgatum
  misc_feature: Ceres CLONE 2016918
  misc_feature: Encodes the peptide sequence at SEQ ID NO. 43521
gagaggagtggtacctcgaggaaaatacatagccaacttgctgaaggacttggatgaggctatggagaaatcaactgcgatgtggaagattgttgttgggcatcacaccatgaggagtgtcagtgaccatggggacaccaaggagcttctaaaactgctgcttcctgtcctcaaggaaaacggcgtcgacttctacatcaatgggcatgatcactgtctcgagcacattagcagcagagacagtccgatccagtacttcacgagcggcggcggttcgaaagcatggagaggagtcttccagccaaacaaggacaagctccggttcttctacgacgggcaagggttcatgtcgctccagctgaaccaagagcaggctcagttcaccttttacgatgtctccgggaacagcctgtaccagtggagctcgagcaaaacgggcagctcccagccctccacctatctagatgacgaagaatgaaactgttgcagaccagatcaatcggaggattaagctagtcaaggtgagcaggagggaaaggcgtccggtttcagtcattctagctcgatgtgatggtagtaggtgttgtcgatgttacccctctgtactgtccaactccaacacccgtgtaagcttgtgctggccttgcaagactttcttgctcctcatgagttggcaaagctatttgctttactagtctatcccgtagaattaatataaaaataagattgataattat

SEQ ID NO: 43521 - protein, 158 aa, Panicum virgatum
  misc_feature: Ceres CLONE 2016918
  misc_feature: SWISSPROT Homolog: EC 3.1.3.2 Acid phosphatase
RGVVPRGKYIANLLKDLDEAMEKSTAMWKIVVGHHTMRSVSDHGDTKELLKLLLPVLKENGVDFYINGHDHCLEHISSRDSPIQYFTSGGGSKAWRGVFQPNKDKLRFFYDGQGFMSLQLNQEQAQFTFYDVSGNSLYQWSSSKTGSSQPSTYLDDEE

SEQ ID NO: 43522 - DNA, 749 bp, Panicum virgatum
  misc_feature: Ceres CLONE 2016926
  misc_feature: Encodes the peptide sequence at SEQ ID NO. 43523
aggcagcactctgctcttcgcctcttcctgcatcttgttcatcattagcagcagcgtacatactcaccgttaattagaagatcaccatggctgctcgtccatcagcagcagctgcaagctgcatcgctctcctcttggtgctggccggcacctcgtcggcgcagctctccaccagcttctactccacctcctgccccggcttgtacggcgccgtcaagtcggtggtgcaggccgcgatcgccagggagaagcgcatgggcgcctccatcgttcgcctcttcttccacgactgcttcgtccaaggctgcgatgcgtcgttgctgctggacgacacggccagcttccagggcgagaagatggcaaaacccaacaacgcctccgtcaggggcttcgaggtgatcgacgccatcaagtccgccgtcgagaaggtctgccccggcgtcgtctcctgcgccgacatcctcgccatcgcagccagggacagcgtagtcagccttggggggccgagctgggacgtcaagctcgggagaagggactccacgacggcgagcttcagcggcgccaacaacaacatcccaccaccgacgtcgggcctcgccaacctgacctccctcttcgccgcgcaggggctctcccaaaaggacatggtcgctctctctggtgctcacaccattggtttagcacgttgcaccaacttcagagcccacatatacaatgaaaccagcatcgacggggcctttgcaaggacg

SEQ ID NO: 43523 - protein, 220 aa, Panicum virgatum
  misc_feature: Ceres CLONE 2016926
  misc_feature (43)..(220): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 50828
  misc_feature: Useful for making plants with altered carbohydrate content
MAARPSAAAASCIALLLVLAGTSSAQLSTSFYSTSCPGLYGAVKSVVQAAIAREKRMGASIVRLFFHDCFVQGCDASLLLDDTASFQGEKMAKPNNASVRGFEVIDAIKSAVEKVCPGVVSCADILAIAARDSVVSLGGPSWDVKLGRRDSTTASFSGANNNIPPPTSGLANLTSLFAAQGLSQKDMVALSGAHTIGLARCTNFRAHIYNETSIDGAFAR

SEQ ID NO: 43524 - DNA, 1425 bp, Panicum virgatum
  misc_feature: Ceres CLONE 2016948
  misc_feature: Encodes the peptide sequence at SEQ ID NO. 43525
aggcaccattggaggtctcgggacacacccgaatcatagcgcaaatgtgctggggattaaagacagtgtgaaggcggattctggatctccaccttccatcaacctaaaattacggccttcacgaccccgactacctacctaacacacgagattcgatccggttggccgatttacctcatcacgcgacatcccaccttcgacatggcggcacaaccgactgcctcgggcatcgtgactgatgaaacaagcggcgagcggcacattccagaatccagaagagccgacggcagcacgaggaaagccatcaagatccgccccggctatcgccctcccgaggatgtcgaagtctacaagaatcggaccgccgagaccttccgcaaccgcggcaagggtcccattcccggcgcagagggtttgaaagacgacaagcccgcgcagccatcctctgctgccgccaataagaacgctaagcggcgcgaggcacgtaagaaggtcaaggccagcgatgaggggcaaggggaggcagcaccggcagaagaggccaaggaggaggtggaccccgaagccgagaaggagaagaaagtacggaatctgaaaaagaagctccggcaggcaaaagagctcaaggagaagaaggagactggtggggcattgctaccggagcagatcgccaaggtcatcaagatgaatgagcttattcgggaattggatgcgctagggttcgatgccgaaggcgagcccaaggccgaagagactggcgccgagaaaaccgaggcgtcgagctgaagaagggaatcagggttaaggaacgacttttggccgctagctaccaacgccgccgcggattatatgctagtgttgcggcctactttctaccttcgcttggagagcaagaagtgtcagggacaggatgggtttcctgaagccatctctacctgggcttctcaaccaacagagtcccgcctctatctggctagatgtcaccgtccagatggattccgcccgccggagtcggcaaccagaacgcgcccgccactctccccacgctacgcacttctagctcgctaagaaactcgaggccggcacctcaatggtgattgggccaccactgttcatctacttcatcggggtccatgtcggaggacaggtttagactaagagcccaacccaccgcgctcactgcgtacagcacatacaagcatcccaacacatacagtacgacatgtgttggtgccgtcaagagtcctggccgaggtctaatatggtgtcatggtcgtggttttaccggggcttcaatagcccggggatcgtcatttctcgagaacatcacaaacctagagttgctgtacttgatgtcggggtatcaacggtctatatcaggtagtacacggtagtcctacatattatacagaaacgctccaatct

SEQ ID NO: 43525 - protein, 194 aa, Panicum virgatum
  misc_feature: Ceres CLONE 2016948
  misc_feature (17)..(43): Pfam Name: Mago-bind Pfam Description: Mago binding
MAAQPTASGIVTDETSGERHIPESRRADGSTRKAIKIRPGYRPPEDVEVYKNRTAETFRNRGKGPIPGAEGLKDDKPAQPSSAAANKNAKRREARKKVKASDEGQGEAAPAEEAKEEVDPEAEKEKKVRNLKKKLRQAKELKEKKETGGALLPEQIAKVIKMNELIRELDALGFDAEGEPKAEETGAEKTEASS

SEQ ID NO: 43526 - DNA, 649 bp, Panicum virgatum
  misc_feature: Ceres CLONE 2016952
  misc_feature: Encodes the peptide sequence at SEQ ID NO. 43527
atccatccacacattgcagcccttgtttgatcacttgctagttaaagcattcttgcttgatccgccataaacaatctgagcaatcagttggttatggcggcaatcaagccttgtgtgctgctggtgttccctgtcgccctcctgctgctcgccggaggctcgccggcggcggcgcagctggaggtcggctactacagcaagacatgccccaacgtcgaggccatcgtccgcgaggagatggagaagatcatcgccgccgcgcccagcctcgccggcccgctactcaggctccacttccacgactgcttcgtcaggggctgtgacgcgtctgtcatgctcaactccacggagggcaacctggccgagagagacgccaaacccaacaagagcctccggggattcagttccgtggacagagtaaaggccaagctcgaggctgcctgccccaacaccgtctcctgcgccgacgtcctcaccctcatggcgcgcgacgccgtcgtgcttgccaggggccccttctggcccgtcgcgctggggaggagagacggcagcgagtccagcgccacggaggcggccgaccagctaccgccggccaacggagacgtcccgctgctcgccaagatcttcgcctccaagggcctcgacctca

SEQ ID NO: 43527 - protein, 185 aa, Panicum virgatum
  misc_feature: Ceres CLONE 2016952
  misc_feature (45)..(185): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51272
  misc_feature: Useful for making plants with altered carbohydrate content
  misc_feature: Functional homolog of the protein sequence given in SEQ ID NO 51443
  misc_feature: Useful for making plants with altered cell wall content and/or composition
MAAIKPCVLLVFPVALLLLAGGSPAAAQLEVGYYSKTCPNVEAIVREEMEKIIAAAPSLAGPLLRLHFHDCFVRGCDASVMLNSTEGNLAERDAKPNKSLRGFSSVDRVKAKLEAACPNTVSCADVLTLMARDAVVLARGPFWPVALGRRDGSESSATEAADQLPPANGDVPLLAKIFASKGLDL

SEQ ID NO: 43528 - DNA, 696 bp, Panicum virgatum
  misc_feature: Ceres CLONE 2016967
  misc_feature: Encodes the peptide sequence at SEQ ID NO. 43529
aaaaagagccactcgttggtgtcctgggagtggtagcccgtagcgtgagagctagcgagcagggttcaatatgggttccaggtttgcactactgtgcctccttggagtgctgggagcatcacctgccattgctgactccggcatctactaccagctcgctcttatgattaccgacatccagggcctgtaccagtactggagcagcatcaagtgccccagcaacaacggcaagaaaaactggaagaacgcctggaagcagtccggcgcctgctccggcctcgaggagaaggactacttcgaggccgccctctacttccgcagccggatcaacccgctggtccgcctcaaggcccagcacatcgagccggacttcggcctgtacggcgtgaaggcgatcaagaacgtgttcaaggcgggcatcgccgcggagccggtggtccagtgcagcaagggccccttcgacaagttccagctgtaccagctctacttctgcgcggcggagagcggcaagttcatcgactgcccggcgccgaagcagtacacctgctccaaggagatcctcttccaccccttccagaagtggatgctcaagcagcagctcaacgagaccgccgccgccgaccccttggtgctgccaggcgtcgccgtggaaatataagcgatcgatctgctgcggcgctgcgcacgtcgcgtgcc

SEQ ID NO: 43529 - protein, 195 aa, Panicum virgatum
  misc_feature: Ceres CLONE 2016967
  misc_feature (5)..(156): Pfam Name: Ribonuclease_T2 Pfam Description: Ribonuclease T2 family
  misc_feature: SWISSPROT Homolog: EC 3.1.27.1 Ribonuclease T(2)
MGSRFALLCLLGVLGASPAIADSGIYYQLALMITDIQGLYQYWSSIKCPSNNGKKNWKNAWKQSGACSGLEEKDYFEAALYFRSRINPLVRLKAQHIEPDFGLYGVKAIKNVFKAGIAAEPVVQCSKGPFDKFQLYQLYFCAAESGKFIDCPAPKQYTCSKEILFHPFQKWMLKQQLNETAAADPLVLPGVAVEI

SEQ ID NO: 43530 - DNA, 656 bp, Panicum virgatum
  misc_feature: Ceres CLONE 2016979
  misc_feature: Encodes the peptide sequence at SEQ ID NO. 43531
ataccacacagaagcccacgcacaccttctttgtcggcagctgacgagtgatccatggcggcccaggctctcctctccggccggcaactgctcggccgccccgttcagtccgccgtctcccggtcgtccgccaggaaggctcccttcgttgtccgggccagctccagccctccggccaagcaaggtgccgacaggcagctctggttcgcgtccaagcagtccctctcctacctcgatggcacgcttcccggcgactacgggttcgacccactgggcctatcagacccagagggaaccggcggtttcatcgagcccaagtggctagcatacggcgaggtgatcaacggccgtttcgccatgctaggcgcggcaggcgccatcgcccctgagatcttcggcaagctaggcatcatcccgccggagaccgccctgccgtggttcaagacgggtgtgatcccacccgcggggacctacaactactgggccgactcgtacacgctcttcgtcttcaacatggcactcatgggcttcgccgagcaccgccgcctccaggactggtacaaccccggatccatgggcaagcagtacttcctcggcctcgagaagttcctcgccggctccggcgacccgtcttaccccggcggcccactcttcaa

SEQ ID NO: 43531 - protein, 200 aa, Panicum virgatum
  misc_feature: Ceres CLONE 2016979
  misc_feature (55)..(199): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRFAMLGAAGAIAPEIFGKLGIIPPETALPWFKTGVIPPAGTYNYWADSYTLFVFNMALMGFAEHRRLQDWYNPGSMGKQYFLGLEKFLAGSGDPSYPGGPLF

SEQ ID NO: 43532 - DNA, 546 bp, Panicum virgatum
  misc_feature: Ceres CLONE 2017003
  misc_feature: Encodes the peptide sequence at SEQ ID NO. 43533
gaagtactcgcttgcatctcgttcccactcgattgccccctacgcccccaattccccccccccccccaaagattcaagatgtataaccgaggacgtggaggttgtgttggtaacaagttcgggatgtgactgggtgtagaagtggatgacattgtgaactgtgatgataaaagtggaggaaagaatgtgtaggtaatttcggtgaagggaataaaagggcgacttaggatgcttccttcagcgtgtgttggtgacatggttatggcaactgtgaagaagggagagattgagttcaggaagaaggtgatgcaggctgtcattgtgagggagcgcaaggcatgggggcgaaaggatggtgtctacatgtactttgaagacaatgttggagtgattgtgaatgaatagggagagatgaaaggttctgctatctttggactcatcggaaaggagtgtgctgatctgtggccggggattgttagtgcggctaatgcgattgtttaatggaaacagctagttgaagttcaataagtagcatttccttgtgtt

SEQ ID NO: 43533 - protein, 58 aa, Panicum virgatum
  misc_feature: Ceres CLONE 2017003
  misc_feature: Functional homolog of the protein sequence given in SEQ ID NO 50297
  misc_feature: Useful for making plants with modulated biomass
  misc_feature: Useful for making plants with modulated heat sensitivity
MLPSACVGDMVMATVKKGEIEFRKKVMQAVIVRERKAWGRKDGVYMYFEDNVGVIVNE

SEQ ID NO: 43534 - DNA, 728 bp, Panicum virgatum
  misc_feature: Ceres CLONE 2017011
  misc_feature: Encodes the peptide sequence at SEQ ID NO. 43535
taccaagtcggatggcaagcttgcatctcttgacgagtacatttcaaggatgaagccaggacagaaagacatcttttacatcaccggaagcagcaaagaacagctggagaagtctccgttcttggagaggctaaccaagaagaactacgaggtcatcttcttcactgaccctgtggacgagtacctgatgcaatacctgatggactacgaggacaagaagttccagaacgtgtccaaggagggtctgaagctgggcaaggactcgaagctcaaggacctcaaggagtcgttcaaggagctgacagactggtggaagaaggccctggagagcgagaacgtggactcggtgaagatcagcaaccggctgcacgacaccccctgcgttgttgtcacctccaagtacgggtggagcgccaacatggagaagatcatgcaggcgcagaccctctcggactcgagcaagcaggcctacatgcgtggcaagcgggtgctcgagatcaaccccaggcaccccatcatcaaggagctccgtgacaaggtggcccaggacaacgagagcgaggggttgaagcagaccgctcggctggtgtaccagacggctctgatggagagcgggttcaacctgcccgaccccaaggagttcgcgtctagcatctacaggtcggtgcagaagagcctggacctgagccccgacgccaccgtcgaggaggaagacgaggcggaggagc

SEQ ID NO: 43535 - protein, 242 aa, Panicum virgatum
  misc_feature: Ceres CLONE 2017011
  misc_feature (1)..(242): Pfam Name: HSP90 Pfam Description: Hsp90 protein
TKSDGKLASLDEYISRMKPGQKDIFYITGSSKEQLEKSPFLERLTKKNYEVIFFTDPVDEYLMQYLMDYEDKKFQNVSKEGLKLGKDSKLKDLKESFKELTDWWKKALESENVDSVKISNRLHDTPCVVVTSKYGWSANMEKIMQAQTLSDSSKQAYMRGKRVLEINPRHPIIKELRDKVAQDNESEGLKQTARLVYQTALMESGFNLPDPKEFASSIYRSVQKSLDLSPDATVEEEDEAEE

SEQ ID NO: 43536 - DNA, 720 bp, Panicum virgatum
  misc_feature: Ceres CLONE 2017014
  misc_feature: Encodes the peptide sequence at SEQ ID NO. 43537
gaaaccacccaaaaaacattgtcgaatcccgtttccctcgcttccccccaaacccaaaaccgaattccctccaaatccacccaccccctccgaaatggacgccggcgccccgaaggtgaagaaggcggcggcgggccgcaagctcggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgctgccgtcctcgagtacctcgccgccgaggttctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcggagaaggcagccaagtcgcccaagaaggccgccgccaaatcccccaagaagtaggctgctcctggtcatgcgcgcgctgatctctcatcggatccgatcctagcagtcttgcttcctctgtgttgcttgcttttgtgtgtatgtagtgccgcatctctatgtaccgtgccctccgtgcttcggatcctaagtcgtaggtctagctgtagttgttgggtgatggg

SEQ ID NO: 43537 - protein, 151 aa, Panicum virgatum; identical to SEQ ID NO: 11988
  misc_feature: Ceres CLONE 2017014
  misc_feature (27)..(100): Pfam Name: Histone Pfam Description: Core histone H2A/H2B/H3/H4

SEQ ID NO: 43538 - DNA, 1014 bp, Panicum virgatum
  misc_feature: Ceres CLONE 2017030
  misc_feature: Encodes the peptide sequence at SEQ ID NO. 43539
accaacacacacacccagtcgtacggcgccgagcactggcagcagctcgctgacatggcgaagatgctcgcgctcctgatgcccctgtgcgccttcttcctcctcctcggagggccgccgtcggtggccgcggctcaatggacacccgccttcgccaccttctacggcggcagcgacgcctccggcaccatgggcggcgcgtgcgggtacggcaacctgtacagcgcggggtacgggacgcgcacggcggcgctgagcacggcgctcttcaacggcggcgccatgtgcggcgcctgcttcgccatcgcctgcgacgccacgcggacccggtactgccggccgggcgccgcccccatcacggtcacggccaccaacctctgcccgcccaactgggcgctgtccggcgaccgcggtggctggtgcaacccgccgcgccggcacttcgacatgtcgcagccggcgtgggagtccatcgccgtgtaccgcgccgggatcgtgcccgtgagctaccgccgcgtgccgtgccggcgagccggcggcgtccggttcaccgtcggcgggcacagctacttcgagctggtcaacgtggccaacgtgggcggcagcggcgtggtggcgcaggcctggatccggggcgcccggacgggctggatggccatggcccggaactggggcgccaactggcagagcagcgcctacctcaacgggcagagcctctcgttccggctccgctccgacgacggccgcgtcgtcacggccaacgacgtcgcccccgccgggtggtggttcggcggcacctacacgtccaatgcccagttctactgacggcctggcggcctgctgacgttgatgatagccggctctgatgttgtgctcttttctgctgtctcaccttttttttttcttttgttccgtgtcgtaaaaatgtgctgatcaggtatacgtcgagtcgaagaggcatagtatcaaaaaaaaggctgaccacgcaatgcataccgtacaatttttatgtag

SEQ ID NO: 43539 - protein, 256 aa, Panicum virgatum
  misc_feature: Ceres CLONE 2017030
  misc_feature (64)..(152): Pfam Name: DPBB_1 Pfam Description: Rare lipoprotein A (RlpA)-like double-psi beta-barrel
  misc_feature (163)..(240): Pfam Name: Pollen_allerg_1 Pfam Description: Pollen allergen
  misc_feature: Functional homolog of the protein sequence given in SEQ ID NO 51623
  misc_feature: Useful for making plants with altered carbohydrate content
  misc_feature: Functional homolog of the protein sequence given in SEQ ID NO 50487
  misc_feature: Useful for making plants with altered cell wall content and/or composition
  misc_feature: Functional homolog of the protein sequence given in SEQ ID NO 50489
  misc_feature: Useful for making plants with altered lignin content
MAKMLALLMPLCAFFLLLGGPPSVAAAQWTPAFATFYGGSDASGTMGGACGYGNLYSAGYGTRTAALSTALFNGGAMCGACFAIACDATRTRYCRPGAAPITVTATNLCPPNWALSGDRGGWCNPPRRHFDMSQPAWESIAVYRAGIVPVSYRRVPCRRAGGVRFTVGGHSYFELVNVANVGGSGVVAQAWIRGARTGWMAMARNWGANWQSSAYLNGQSLSFRLRSDDGRVVTANDVAPAGWWFGGTYTSNAQFY

SEQ ID NO: 43540 - DNA, 679 bp, Panicum virgatum
  misc_feature: Ceres CLONE 2017041
  misc_feature: Encodes the peptide sequence at SEQ ID NO. 43541
acaaagcggaaggcatcacacttgcacagttcctccacagtcacactctcccacagtcccaccagtccaccactccctgcttcaccgaagcgtgccggcaccggcagcaagcagtcgggagctatggctccgccgctactgctcgtcctcctcctcctcccggccctagccgccggccaccagcacccgtcctccttcggctcctccgccctctctgagtggcgctccgccaaggcctcctactacgccgccgaccccgaggacgccatcggtggagcgtgcgggttcggggatctgggcaagcacgggtacgggatggcgacggtggggctgagcacggcgctgttcgagcgcggcgcggcgtgcggcggctgctacgaggtcaagtgcgtcgaggatctcaagtattgtctccccggcacctccatcgtcgtcacggccaccaacttctgcgcccccaactacggcctccccgccgacgccggcggccactgcaacccgcccaaccaccacttcctcctccccatccaggcgttcgagaagattgccctctggaaggccggcgtcatgcccatccaataccgccgtgttaagtgcctccgtgaaggtggtgtcaggttctctgtcaatggtcgacacttcttcttcacagtgctaatcagcaacgttggggggtgcg

SEQ ID NO: 43541 - protein, 185 aa, Panicum virgatum
  misc_feature: Ceres CLONE 2017041
  misc_feature (67)..(153): Pfam Name: DPBB_1 Pfam Description: Rare lipoprotein A (RlpA)-like double-psi beta-barrel
  misc_feature: Functional homolog of the protein sequence given in SEQ ID NO 51673
  misc_feature: Useful for making plants with altered carbohydrate content
  misc_feature: Functional homolog of the protein sequence given in SEQ ID NO 51674
  misc_feature: Useful for making plants with altered cell wall content and/or composition
MAPPLLLVLLLLPALAAGHQHPSSFGSSALSEWRSAKASYYAADPEDAIGGACGFGDLGKHGYGMATVGLSTALFERGAACGGCYEVKCVEDLKYCLPGTSIVVTATNFCAPNYGLPADAGGHCNPPNHHFLLPIQAFEKIALWKAGVMPIQYRRVKCLREGGVRFSVNGRHFFFTVLISNVGGC

SEQ ID NO: 43542 - DNA, 701 bp, Panicum virgatum
  misc_feature: Ceres CLONE 2017052
  misc_feature: Encodes the peptide sequence at SEQ ID NO. 43543
actacaacgactgggcagtgggcaccgccgcccactgcagagtccggccatggagctccgcgagctgggcggcacgggcctccgcgtcagcgccgtcggcttcggcgcctccccgctcggcaacgtcttcggggacgtgccccgcgacgccgcccgcgccgccgtccgccgcgcgctcgacctcggcgtcaacttcttcgacacctccccgtactacggcggcacggtctcggagtccgtcctcggtgactgcctccgccacgcggccgtcccgcgggaccaggtcgtcgtcgccaccaagtgcggccgctacaaggacgaagggttcgacttctccgccgcccgcgtcggccgcagcgtcgacgagagcctcgcccgcctggggctcgactacgtcgacatcctccacgcccacgacatcgagttcaccagcctcgaccagattgtgaatgagaccattcccgcgctccggaagatcaaggagagcgggaaggcgcggttcattggaatcaccgggctgcccctcagcatctacccgtacgtgctcgaccgggcgccgccgggctcggtggatgtcatcctgtcctactgccactacgggatcaacgacacctccctggtcgatctgctctcctacttgaagagcaagggcgtcggggttatcaccgcttcgccccttgcgatgggtcttctcacggata

SEQ ID NO: 43543 - protein, 217 aa, Panicum virgatum
  misc_feature: Ceres CLONE 2017052
  misc_feature (7)..(217): Pfam Name: Aldo_ket_red Pfam Description: Aldo/keto reductase family
  misc_feature: SWISSPROT Homolog: EC 1.1.1.116 D-arabinose 1-dehydrogenase
MELRELGGTGLRVSAVGFGASPLGNVFGDVPRDAARAAVRRALDLGVNFFDTSPYYGGTVSESVLGDCLRHAAVPRDQVVVATKCGRYKDEGFDFSAARVGRSVDESLARLGLDYVDILHAHDIEFTSLDQIVNETIPALRKIKESGKARFIGITGLPLSIYPYVLDRAPPGSVDVILSYCHYGINDTSLVDLLSYLKSKGVGVITASPLAMGLLTD

SEQ ID NO: 43544 - DNA, 613 bp, Panicum virgatum
  misc_feature: Ceres CLONE 2017071
  misc_feature: Encodes the peptide sequence at SEQ ID NO. 43545
agatcgacatagactctctggagtctattgctgacaagaacaccgccgcaatggtcatcatcaaccccaacaacccttgtgggagtgtgtacacccgtgaacatttggccaaggttgccgaggcagcaaggaagcttgggatcttagtcattgctgatgaagtgtatggcaatttggttttcggggactcccagttcatcccaatgggcgtctttgggcacatcgccccagtgttgagcataggatcactctcaaagagatggatagtgcctggatggagacttggctgggttgctgcatgtgatcccaagaagatcctgcaagaaactaagattcttacgtcaatcacaaacttccttaatgtttcaactgatccagcaactttcattcagggagcacttccacaaattcttgagaacacaaaggaagatttcttcaagaggatcattggtttgctagaggaaacatcagatatatgttatagagaaataaaggacatcaaatacattacttgtccgcacaagccagaaggttccatgtttgtgatggtgaagctgaatttgtatcttctggaggggatccatgatgacattgatttttgctgcaagctggc

SEQ ID NO: 43545 - protein, 203 aa, Panicum virgatum
  misc_feature: Ceres CLONE 2017071
  misc_feature: SWISSPROT Homolog: EC 2.6.1.5 Tyrosine transaminase
IDIDSLESIADKNTAAMVIINPNNPCGSVYTREHLAKVAEAARKLGILVIADEVYGNLVFGDSQFIPMGVFGHIAPVLSIGSLSKRWIVPGWRLGWVAACDPKKILQETKILTSITNFLNVSTDPATFIQGALPQILENTKEDFFKRIIGLLEETSDICYREIKDIKYITCPHKPEGSMFVMVKLNLYLLEGIHDDIDFCCKL

SEQ ID NO: 43546 - DNA, 703 bp, Panicum virgatum
  misc_feature: Ceres CLONE 2017080
  misc_feature: Encodes the peptide sequence at SEQ ID NO. 43547
agcctcttctcccggtcaccccgaagtcttctaaaccctaatcccccaaatccccgacgccaagcgacacgccgcgcaccggagttctcgaggaggaagcatgagtcgccatccgaccactaagtgggcgcagaagtccgacagggtgttcttgacgattgagttgcccgatgccaaggatgtgaagctgaacttgaagcctgagggcaatttcaacttctcggcaaaaggctctgatgacttgccctatgagtttgacctcgagctgtttgatgctgttaatgtggaggagagcaaagcagctgttgccccaaggactatatgctacctgatcaagaaagctgagagcaagtggtggccaaggctgctgaaaaaggagggcaagccccctgttttcttgaaggttgactgggacaaatggcaggatgaggatgatgaggatatcggatttaatgactttgatggtatggacttctcgaaacttgacatgggtggtgctgatgatgaggatattgaggacgatgaagatgctgtggttgaaagtgctaacaaagatgaaggtgctaatgagagcaaggaggaggaggaagcagctccagcagcagccggtgcagaggaagctaaaccatgaagaagcaattgagtttgctcgacaacatcagtgaccacgcatgatatccagctagactagatgttcccttag

SEQ ID NO: 43547 - protein, 176 aa, Panicum virgatum
  misc_feature: Ceres CLONE 2017080
  misc_feature (5)..(80): Pfam Name: CS Pfam Description: CS domain
  misc_feature: SWISSPROT Homolog: EC 5.3.99.3 Prostaglandin-E synthase
MSRHPTTKWAQKSDRVFLTIELPDAKDVKLNLKPEGNFNFSAKGSDDLPYEFDLELFDAVNVEESKAAVAPRTICYLIKKAESKWWPRLLKKEGKPPVFLKVDWDKWQDEDDEDIGFNDFDGMDFSKLDMGGADDEDIEDDEDAVVESANKDEGANESKEEEEAAPAAAGAEEAKP

SEQ ID NO: 43548 - DNA, 513 bp, Panicum virgatum
  misc_feature: Ceres CLONE 2017084
  misc_feature: Encodes the peptide sequence at SEQ ID NO. 43549
gcacatcgatcgagcaccacatacttgccaccatcaccatacacttctagtagacaggacatgtaataattaagttcaaatcccctcggcgatcgagctcgagtgactcattccaatttccacaaacgctgccgatccatctctgcaattgacaccgatatttgtacgcgcagatcgacttcaaccatgagctccgtggacgccaccggcggtgagaacaaaacatctgggccggaggtggcgggcctgccggcggaggaggacaaaaacataatcctcaaagacatgcccgacgcctacttcctctgcctgcccgccggctcaccggcgacaatggactggacgtccaaccgcgtccacgactgacactacaccgtagcacaaaccccgagagggggctgaatgataaaactaccacctgcatgctggatcaaagctgctagatatcgcctacgcccttgatgttccttcctgattgcccttagaggattaggtgtaagatatgacactaga

SEQ ID NO: 43549 - protein, 59 aa, Panicum virgatum
  misc_feature: Ceres CLONE 2017084
  misc_feature (12)..(57): Pfam Name: potato_inhibit Pfam Description: Potato inhibitor I family
MSSVDATGGENKTSGPEVAGLPAEEDKNIILKDMPDAYFLCLPAGSPATMDWTSNRVHD

SEQ ID NO: 43550 - DNA, 712 bp, Panicum virgatum
  misc_feature: Ceres CLONE 2017102
  misc_feature: Encodes the peptide sequence at SEQ ID NO. 43551
gaaccctgctgtcgacgctcacatctttttttttgtcttcctttttctcttttgttttggttggtgggtggattcggattgagttcctaataactcgaaagaaatccaatccggcacgcatcgccaacccagccaagccgacgccgatacgagcagcaagcagcgggcagccgaatcgcctccggccccccgcccctttttaggcagaggcaggcagcttgacaaggaaaaggaaagccgtcaccatggggaacaaagcacctttcttcctcttgatcctcttgttgctcgtcgcccgggcacctgcacaagccagggatgctgaccacagccctgtctacaaggaacatgtccctgtccatctcaagagcagcagcccgctatgctctgcttgtgaaaacttagcgagtggagctgtcacttatctaagtgagaaacaaacacaagataagatcatggaattacttcatcatgcttgttctcagtcattctccttggaacagaagtgtgttgaattgatggactcctatgcaactctgctgtttgccaagatttcagagatcaagccagaagagttctgcaaacagtatggcctgtgcagggataccgcccttttctctggtgtgggaagtgacagcacttgtgtgttttgccaccacctgcttgatgaaattatgtccaaactgaaagatccagattcggagtttgagat

SEQ ID NO: 43551 - protein, 155 aa, Panicum virgatum
  misc_feature: Ceres CLONE 2017102
  misc_feature (44)..(83): Pfam Name: SapB_1 Pfam Description: Saposin-like type B, region 1
  misc_feature (85)..(118): Pfam Name: SapB_2 Pfam Description: Saposin-like type B, region 2
MGNKAPFFLLILLLLVARAPAQARDADHSPVYKEHVPVHLKSSSPLCSACENLASGAVTYLSEKQTQDKIMELLHHACSQSFSLEQKCVELMDSYATLLFAKISEIKPEEFCKQYGLCRDTALFSGVGSDSTCVFCHHLLDEIMSKLKDPDSEFE

SEQ ID NO: 43552 - DNA, 703 bp, Panicum virgatum
  misc_feature: Ceres CLONE 2017105
  misc_feature: Encodes the peptide sequence at SEQ ID NO. 43553
aaaacagaaaaattccccccgacccgaccaaacccaaaccgccgccgccatggccgacgagaccgacaccaggcccacctccgccggctcccggggccgccctacgcccgatgacgacagggaggagggcgagatcgccgacgactccgccgcgcccgccccgccgctccaccccgccactcacccgctcgagcactcctggaccttttggttcgacaacccgcagggcaagtccaagcaggccgcatgggggagctccatccgccccatccacaccttctccaccgtagaggacttctggggcctttacaataatatccaccaccctagcaagctgattgtgggagcagacttccattgcttcaagaacaagattgaaccaaaatgggaggaccctatttgtgctaatggtggtaaatggaccatcagctgtggcagaggaaaatctgacacaatgtggctgcacactctattggcaatgattggcgaacaattcgattatggtgatgaaatttgtggagcagtcgttagcgtgcgtgggaagcaggaaagaatagccatctggaccaaaaatgctgctaatgaaactgcccaggtcagcatcgggaaacaatggaaggaacttctggactacaaggactcaattggattcattgttcatgaagatgcaaagaagatggacaaaggtcccaagaaccgttac

SEQ ID NO: 43553 - protein, 217 aa, Panicum virgatum
  misc_feature: Ceres CLONE 2017105
  misc_feature (1)..(217): Pfam Name: IF4E Pfam Description: Eukaryotic initiation factor 4E
MADETDTRPTSAGSRGRPTPDDDREEGEIADDSAAPAPPLHPATHPLEHSWTFWFDNPQGKSKQAAWGSSIRPIHTFSTVEDFWGLYNNIHHPSKLIVGADFHCFKNKIEPKWEDPICANGGKWTISCGRGKSDTMWLHTLLAMIGEQFDYGDEICGAVVSVRGKQERIAIWTKNAANETAQVSIGKQWKELLDYKDSIGFIVHEDAKKMDKGPKNR

SEQ ID NO: 43554 - DNA, 857 bp, Panicum virgatum
  misc_feature: Ceres CLONE 2017113
  misc_feature: Encodes the peptide sequence at SEQ ID NO. 43555
aggaggagccagccccagcaacaacaccggcattgccacgcgcttccactaccgcattgccaagctctcgactagctgctcaacgtacgcgtagccagcagatccgcaagatcgatcagagatggtggtggccagagccttcctcgccgtggcggccgtggccgctgtcctgcagctcgccgcggcggcggaccatcctgtgggaggcagcggcagctgggacgccagcggcaccagctacaacgcctggtccgccaagcagaccttcaagcagggcgacaccctgtcgttccagttcgcgccgtcccacgacgtcaccgaggtcgacaagaaggactacgactcctgctccgccgccaaccccatcaagtcctacaccggcggaagcgccgccgtcaagctcaccgccccgggcaagcgctacttcatctgcagcgtgaccggccactgcgcctccggcatgaagctcgaggtcaccgtcgccgcggccgcggtcaccgcgcccgcgcccggcaagggcggcaagccccaccacaagaggagcgtcgccccgaccccggcccctgcagtggcggcaccggagcctgctgcttcttccaccgacgacgtatccacgcccacggcggcgccggcgcccaggtcgtcggacgcggccaccattggcgtgctcggaggcaaggctttcgtggggctcgccgtgggcgtcgccatggccttggccgccatgtgagcgtcgtcgtgacacgcacgattgtttttttagcagaaataataattcgttattcttatattctacggcgcaacgcaccgacggttgttgctgacaaagtttacagatatatatattgtttttttct

SEQ ID NO: 43555 - protein, 202 aa, Panicum virgatum
  misc_feature: Ceres CLONE 2017113
  misc_feature (33)..(114): Pfam Name: Cu_bind_like Pfam Description: Plastocyanin-like domain
MVVARAFLAVAAVAAVLQLAAAADHPVGGSGSWDASGTSYNAWSAKQTFKQGDTLSFQFAPSHDVTEVDKKDYDSCSAANPIKSYTGGSAAVKLTAPGKRYFICSVTGHCASGMKLEVTVAAAAVTAPAPGKGGKPHHKRSVAPTPAPAVAAPEPAASSTDDVSTPTAAPAPRSSDAATIGVLGGKAFVGLAVGVAMALAAM

SEQ ID NO: 43556 - DNA, 753 bp, Panicum virgatum
  misc_feature: Ceres CLONE 2017147
  misc_feature: Encodes the peptide sequence at SEQ ID NO. 43557
acacgcgctgacgcgcacgcagcgattccactcggctccgccgcgccccccatggctgtcgccacctcccaccacctcgtcggctcctccgctcccgggccgcctgccctgctccgctcgcggccgcgcggagaatatgttgccaatctgtcaactcagctaatgtgttgggagcttcttcgacgacacctgaggaggcaatcccagtcccagtcgtcatgatagatcaagattcagaccatgatgcgaccattgtacagttgagttttggagaccgtttggggccactacttgacacgatgaaggcactcaaggaccttggccttgatgtcacgaaaggaactgtggcaactgactcagctgtcacaaaaacaaagttccacatcatgcgatttgggcgcaaagttgaggaccctgacatgttagagaggatacggctaaccatcattaacaatcttctgcaatatcatcctgaatcaagcgagaagttagcaatgggtgaattttttgggataaaatctcctgagaagaaggttgatattgatattgcaactcacgtggttgttgaagatgatgggccaaaaagaagcatgctttacatagagacagctgatcggcctggcctgcttctggaaattatcaagatcattgctgacacaaatattgatgtggaatctgctgagatcgacactgaggggttggtgcccagggacaagttccatgtgagctacagaggcgcaaaactaaacagct

SEQ ID NO: 43557 - protein, 178 aa, Panicum virgatum
  misc_feature: Ceres CLONE 2017147
  misc_feature: SWISSPROT Homolog: EC 2.7.7.59 [Protein-PII] uridylyltransferase
  misc_feature: Functional homolog of the protein sequence given in SEQ ID NO 50834
  misc_feature: Useful for making plants with altered alkaloid content
  misc_feature: Useful for making plants with altered lignin content
MIDQDSDHDATIVQLSFGDRLGPLLDTMKALKDLGLDVTKGTVATDSAVTKTKFHIMRFGRKVEDPDMLERIRLTIINNLLQYHPESSEKLAMGEFFGIKSPEKKVDIDIATHVVVEDDGPKRSMLYIETADRPGLLLEIIKIIADTNIDVESAEIDTEGLVPRDKFHVSYRGAKLNS

SEQ ID NO: 43558 - DNA, 717 bp, Panicum virgatum
  misc_feature: Ceres CLONE 2017155
  misc_feature: Encodes the peptide sequence at SEQ ID NO. 43559
agaagaagggtggagagagagagagagaggagaacaggggagagagaggtgtgggaagggagagagcgcgcgcgtttggatcggcgatggatgccggagcgaaggtgccgaggaaggccgcggcggggcgtcgcggcggcggcgggcccaagaagaagccggtctcccgctccgtgaaggccggcctccagttccccgtcggccgtatcggccgctacctcaagcagggccgctactccaagcgcatcggcaccggcgcccccgtctacctcgccgccgtcctcgagtacctcgccgccgaggtcctcgagcttgcggggaacgcggcgcgggacaacaagaggaaccggatcatcccgcggcacgtgctgctggcgatccgcaacgacgaggagctcgggaagctgctggccggcgtcaccatcgcgcacggcggggtgctgcccaacatcaaccccgtgctcctccccaagaaggccgcctctgccgccaccaaggagggtaaggagacgaaatcacccaagaaggccgccaccaagtcgtccaagaaggcggccgccgcgtaggtccgggcaaatggtggtgccctgtctctcgctatctccctgtgcgctctgaattgaaacgctcctatctgtcgtcgtcatcgtgatctttactgcttgtcgtggttgtttgtgtgtaattgcgtgccctttgctcaatcatcatgcactg

SEQ ID NO: 43559 - protein, 159 aa, Panicum virgatum
  misc_feature: Ceres CLONE 2017155
  misc_feature (28)..(101): Pfam Name: Histone Pfam Description: Core histone H2A/H2B/H3/H4
MDAGAKVPRKAAAGRRGGGGPKKKPVSRSVKAGLQFPVGRIGRYLKQGRYSKRIGTGAPVYLAAVLEYLAAEVLELAGNAARDNKRNRIIPRHVLLAIRNDEELGKLLAGVTIAHGGVLPNINPVLLPKKAASAATKEGKETKSPKKAATKSSKKAAAA

SEQ ID NO: 43560 - DNA, 698 bp, Panicum virgatum
  misc_feature: Ceres CLONE 2017159
  misc_feature: Encodes the peptide sequence at SEQ ID NO. 43561
aatgtctgactctggtgaattgtgcaaagggcttactgatgctgttgaagtgcctacactctcagaactgcaccggcaactggttggtgaaggttctcaccgtcgtctagtctattctgtgaaatttggtgcctgtcaagatgccatggttaattttcttgatggctatgatgcccatctggtgataattgagaagctcccgaatggggtgtttgctgacccatttgagctacagcattttgttgaacgcaaagttttccttgacgttgctgtttttggagacaccaaccttgaactaccctcggctctatccaaccggtcaactgttgagattcattttgatctcaagccaagcactttaacaaactgtaccattgtaataaacctgcctctccatgctagatacccgcctcttgatgccagtgggcatgcaacggttgagtttggcagcccagatttgctcctgcgctacagaaaaaaggaaatccgttccggttcctgtttgtgggtgcttaaggatctcgaagccgcacccgtggacaaagctgcgtggcggataccctgtggagatgaagcccatataggatttgtatctagcgttacctttctctcggctcttgtttgttccatgtccgttgttctagctgctctagttttttgatgtattcggctccaggcaaaactggaatgaagtaaag

SEQ ID NO: 43561 - protein, 219 aa, Panicum virgatum
  misc_feature: Ceres CLONE 2017159
  misc_feature (28)..(218): Pfam Name: PIG-X Pfam Description: PIG-X / PBN1
MSDSGELCKGLTDAVEVPTLSELHRQLVGEGSHRRLVYSVKFGACQDAMVNFLDGYDAHLVIIEKLPNGVFADPFELQHFVERKVFLDVAVFGDTNLELPSALSNRSTVEIHFDLKPSTLTNCTIVINLPLHARYPPLDASGHATVEFGSPDLLLRYRKKEIRSGSCLWVLKDLEAAPVDKAAWRIPCGDEAHIGFVSSVTFLSALVCSMSVVLAALVF

SEQ ID NO: 43562 - DNA, 695 bp, Panicum virgatum
  misc_feature: Ceres CLONE 2017163
  misc_feature: Encodes the peptide sequence at SEQ ID NO. 43563
aggaggctcttcctggtgacaatgttggcttcaacgtgaagaatgtcgctgtgaaggatctgaagcgtgggtatgtggcctctaactccaaggatgaccctgccaaggaggctgccagcttcacctcccaggtcatcatcatgaaccaccctggacagattggcaatggctatgccccagtgctggactgccacacctcccacatcgccgtcaagtttgctgagctcattaccaagattgacaggcgatctggtaaggagcttgagaaggagcccaagttcctcaagaatggtgatgctggtatggtcaagatggttcccaccaagcccatggtggtggagaccttctctgagtaccctcctcttggtcggtttgctgtccgtgacatgaggcaaacggttgctgttggagtcatcaagagtgtggagaagaaggacccgaccggtgccaaggtgaccaaggctgctgccaagaagaaatgatgtgcctggtggtttatcctgcgtctggttttgtgataccttacctttgcattatcccataagttgctgctgtcgggtgaacttttaattgctgctggcggtgtgccatttgtatgtttaggtaccgtgttatttcagcttgggcgaaacttttgctagacctatggtgtgcccttttgggcgtcgttaaacgtattatcagagtcatctcgg

SEQ ID NO: 43563 - protein, 159 aa, Panicum virgatum
  misc_feature: Ceres CLONE 2017163
  misc_feature (34)..(142): Pfam Name: GTP_EFTU_D3 Pfam Description: Elongation factor Tu C-terminal domain
  misc_feature: The sequence is a functional homolog of SEQ ID NO 576 in the 10/666,642 US patent application
EALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 43564 - DNA, 719 bp, Panicum virgatum
  misc_feature: Ceres CLONE 2017168
  misc_feature: Encodes the peptide sequence at SEQ ID NO. 43565
tcccttctcttcccgatcattccattccggctttccccaacccttcgaccacccgaggaagaaaagaagttgaagcatggggaagagaaagtcagctgctaagccacctcctaagaagcggatggacaagcttgatactgtcttttcctgcccattttgcaatcatgggagcagtgttgagtgccgtattgacatgaagaatttgattggcgaggcttcttgcagaatctgtcaggaaaacttcagcaccactgttaatgcactcactgagcctattgacatatatagtgaatggattgatgagtgtgagcgtgtcaacactgttgaaggtgatgatgatgcatgagctccccccatgctgatggaacggttacttgcaactctattgtactggcatgcttgaatgccatagtcagccatggcttgtaatggcgctgtaagggcatattggctgcctgatacgctgttaggcggtatcagtttatctagtacttaataaactctaaaaaaaatacgtgtatgccaactagtgactgcgtgttctatgcaactagtgactgcctacaatgatataccaggttttctgtgagtatgttaacgtgttttaaaccattctagatttcagtgccagcaaaagagcgatgtaaattgcacgcgaccacagctttttcaacaattcagaatgtgacccctccggttcatgtaaggattgttatcac

SEQ ID NO: 43565 - protein, 89 aa, Panicum virgatum; identical to SEQ ID NO: 27831
  misc_feature: Ceres CLONE 2017168
  misc_feature (8)..(68): Pfam Name: Elf1 Pfam Description: Transcription elongation factor Elf1 like

SEQ ID NO: 43566 - DNA, 658 bp, Panicum virgatum
  misc_feature: Ceres CLONE 2017171
  misc_feature: Encodes the peptide sequence at SEQ ID NO. 43567
acacgccaagaaaagcttcccccgacactagccgaatcgccccccatttccctcgaccccgcgaagcggtgacccccgaccctccgaggctccgacccgatggcgccaaaggcgcgagaagaaggggaagaagaaggccaagaagagcgtggagacctacaaaatctacatcttcaaggtgctcaagcaggtgcacccggacatcggcatctcctccaaggccatgtccatcatgaactccttcatcaacgatatcttcgagaagctggcgcaggaggccgcccgcctcgcccgctacaacaagaagcccaccatcacctcccgcgagatccagacctccgtgcgcctcgtcctccctggcgagctcgccaagcacgccgtctccgagggcaccaaggccgtcaccaaattcaccagcaactgaacgaaccgcgacatccacggatttgttaggtctccgccacttctaggcttcttcgttgtgttcccccttccttcctctggtactcatgatgtagtatctgctgtgaaaatgtttagctagtactagctggcttgcctgctttgtaaatcatgccaggttgtgatgaacgtcttggatttaggtaatgggtgtggagccctcgccgcttgcactttctattcttctgcgctgggg

SEQ ID NO: 43567 - protein, 66 aa, Panicum virgatum
  misc_feature: Ceres CLONE 2017171
  misc_feature: Functional homolog of the protein sequence given in SEQ ID NO 50160
  misc_feature: Useful for biocontainment applications
  misc_feature: Useful for making plants with modulated flowering time
MSIMNSFINDIFEKLAQEAARLARYNKKPTITSREIQTSVRLVLPGELAKHAVSEGTKAVTKFTSN

SEQ ID NO: 43568 - DNA, 707 bp, Panicum virgatum
  misc_feature: Ceres CLONE 2017177
  misc_feature: Encodes the peptide sequence at SEQ ID NO. 43569
agccgtcgtggcggcggccgatccggctactgcagacacgagaaacttcaccatacctctccttcgacgagcagataacgtgcttcgagaccgtcaagaaggccatgatcgccatggtcggcaaggaggccgccgaggccgcggtcaatgcggcgctgttccagattgggctcgggagcaacgactacatcaacaacttcctgcagccgttcatggcggacggcaccacgtacacgcacgaccagttcatccgcctcctcatcaccaccctggaccggcagctcaagcggctgtacgggctcggcgcgcggaaggtcgtgttcaacgggttggccccgttgggctgcatcccgtcgcagcgcgtccactccacggacggcaagtgcctgggcaaggtcaacgcctacgccgtgaagttcaacgccgccgcccagaagctgctcgacggcatgaacgccaagctgcccggcgcgcagatggccctcgccgactgctactccgtcgtcatggagctcatcgaacaccccgagaagcacgggttcacgacggcgcacacgtcgtgctgcaacgtggacacggaggtcgggggcctgtgcttgcccaacacgaggccctgcagcgaccgaagcgccttcgtgttctgggacgcgtaccacacctccgacgccgccacaaagtgatcgccgaccgcctctgggccggcatga

SEQ ID NO: 43569 - protein, 225 aa, Panicum virgatum
  misc_feature: Ceres CLONE 2017177
  misc_feature (25)..(225): Pfam Name: Lipase_GDSL Pfam Description: GDSL-like Lipase/Acylhydrolase
  misc_feature: SWISSPROT Homolog: EC 3.2.1.51 Alpha-L-fucosidase
PSWRRPIRLLQTRETSPYLSFDEQITCFETVKKAMIAMVGKEAAEAAVNAALFQIGLGSNDYINNFLQPFMADGTTYTHDQFIRLLITTLDRQLKRLYGLGARKVVFNGLAPLGCIPSQRVHSTDGKCLGKVNAYAVKFNAAAQKLLDGMNAKLPGAQMALADCYSVVMELIEHPEKHGFTTAHTSCCNVDTEVGGLCLPNTRPCSDRSAFVFWDAYHTSDAATK

SEQ ID NO: 43570 - DNA, 705 bp, Panicum virgatum
  misc_feature: Ceres CLONE 2017183
  misc_feature: Encodes the peptide sequence at SEQ ID NO. 43571
aatccagccactagcccgtagccaccccagtgtgccggccagacgtgtgccactgggagtacgtacctggtcgaagccaagcgagagagcgtgagcgcgggagaggatcggatggcggcggcgcggtgggtgctggtggccgcggcggcggtggcggcgctggcggcgacgcgcgcgacggcggcggcgccgaggaagccggtggacgtgccgttccagcggaactacgtgccgacgtgggcggcggaccacatccactacgtcgacggcgggcgggaggtgcagctctacctcgacaagtccaccggcacggggttccagacgcggggctcctacctcttcggccacttcagcatgcacatgaagctcgtcggcggcgactccgccggcaccgtcaccgcattctacctgtcgtcgcagaactcggagcacgacgagatcgacttcgagttcctgggcaaccggacggggcagccctacatcctgcagaccaacgtgttcaccggcggcaagggcgaccgcgagcagaggatctacctctggttcgaccccaccaaggagtaccactcctactccgtcctctggaacctctacatgatcgcgttcttcgtggacgacgtgccgatccgggtgttcaagaacagcagcggcgagctggatgtgcggtacccgttcagccagccgatgaagctctactcgagcctg

SEQ ID NO: 43571 - protein, 197 aa, Panicum virgatum
  misc_feature: Ceres CLONE 2017183
  misc_feature (35)..(197): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 51374
  misc_feature: Useful for making plants with altered carbohydrate content
  misc_feature: Functional homolog of the protein sequence given in SEQ ID NO 51375
  misc_feature: Useful for making plants with altered cell wall content and/or composition
  misc_feature: Functional homolog of the protein sequence given in SEQ ID NO 50905
  misc_feature: Useful for making plants with altered lignin content
MAAARWVLVAAAAVAALAATRATAAAPRKPVDVPFQRNYVPTWAADHIHYVDGGREVQLYLDKSTGTGFQTRGSYLFGHFSMHMKLVGGDSAGTVTAFYLSSQNSEHDEIDFEFLGNRTGQPYILQTNVFTGGKGDREQRIYLWFDPTKEYHSYSVLWNLYMIAFFVDDVPIRVFKNSSGELDVRYPFSQPMKLYSS

SEQ ID NO: 43572 - DNA, 617 bp, Panicum virgatum
  misc_feature: Ceres CLONE 2017194
  misc_feature: Encodes the peptide sequence at SEQ ID NO. 43573
atgcgtcggagttcaggcaggcagagagcttagcaccggcatggcgagcaagcgagcgatgtcgcggtctctcctggccgcgatcgcgacggcggtgcttatccgccgcgtctgctgcgccgccgatgctccggcggcggcgccggcgaaccagacgcggcccccggcgctgttcgtgttcggggactccatcgtggacccgggcaacaacaacgccctcaccacgctgatccgctgcaacttcccgccctacggccaggacttccccggccacaacgccaccggcaggttcagcaacggcagggtccccagcgacatcctcgccagccggctgggcatcaaggagtacttgccggcgtacctcggcacggaactcagcgacttcgacctcctcaccggcgtcagcttcgcctccggcggctgcggcttcgaccccctcaccgccgagctcgtgtcggtgctcaccatggacaaccagctggacctgttcaaggagtacaaggggaagctggagcgcgtcgccggcgcgcggcgcgcggccgagatcgtggcgacgagcctctacatggtggtcaccggcaccgacgacctcgccaacacctacttcacgacgccgt

SEQ ID NO: 43573 - protein, 192 aa, Panicum virgatum
  misc_feature: Ceres CLONE 2017194
  misc_feature: SWISSPROT Homolog: EC 3.2.1.51 Alpha-L-fucosidase
MASKRAMSRSLLAAIATAVLIRRVCCAADAPAAAPANQTRPPALFVFGDSIVDPGNNNALTTLIRCNFPPYGQDFPGHNATGRFSNGRVPSDILASRLGIKEYLPAYLGTELSDFDLLTGVSFASGGCGFDPLTAELVSVLTMDNQLDLFKEYKGKLERVAGARRAAEIVATSLYMVVTGTDDLANTYFTTP

SEQ ID NO: 43574 - DNA, 707 bp, Panicum virgatum
  misc_feature: Ceres CLONE 2017196
  misc_feature: Encodes the peptide sequence at SEQ ID NO. 43575
gttgatctcctccctctgtttcttaaacatttcccttctctcggactctctctactcccttgctcttccttccctggcggcgaagactgagcgagcggcggcgccatttgtcacgtcttcgcccaaccctttgccggcgacgagcatccgccaggaaagaagcctagacaagggggaggatggataaggaggagaataaggaagcatcagtgagcattagcaacaatgacacgggtaccaatgatatggaggatgacgacaatgatgacgatgatgggaagcacacggtggtgcttggccctcaggttcccctcaaggaccaccttgagctcgataaggatgatgacagcctaaggaggtggaaagagcagctccttggagatgttgataccactaagcttggagagactgcagaaccagaggtgaccatattgaacctgaccatcctaactccggatcgaccagatctggttctgccaatcccacttgtacgggatgacaaggggtacgcattcgcgctcaaggatgggagcacctacagcttccgcttctccttcactgtctccaacaacattgtgtctggtctcagatatacacacactgtctggaaagctggagtaagagtggaaaaacagaaggtgatgctgggggaccttcagtcctcagcaggagccttacatgtacgaggctgaggaagatacgacacc

SEQ ID NO: 43575 - protein, 170 aa, Panicum virgatum
  misc_feature: Ceres CLONE 2017196
  misc_feature (8)..(170): Pfam Name: Rho_GDI Pfam Description: RHO protein GDP dissociation inhibitor
MDKEENKEASVSISNNDTGTNDMEDDDNDDDDGKHTVVLGPQVPLKDHLELDKDDDSLRRWKEQLLGDVDTTKLGETAEPEVTILNLTILTPDRPDLVLPIPLVRDDKGYAFALKDGSTYSFRFSFTVSNNIVSGLRYTHTVWKAGVRVEKQKVMLGDLQSSAGALHVRG

SEQ ID NO: 43576 - DNA, 369 bp, Panicum virgatum
  misc_feature: Ceres CLONE 2017197
  misc_feature: Encodes the peptide sequence at SEQ ID NO. 43577
aactcacatctcgaccagtcggagttcatccccgagcagacctcgcaagtcgcacaacttcttctcctcctgctccagatctcaggcgaaagcttgtccaccatccgccgccacagcatcccaatggctcgcttcgccatcgtcgccgccatcgtcgcgctcctcgccgtcaccgtggccgcgcaggacccggccgcgacgcccaccccggcgcccaggatggccccgctgccggctcctccggcgcggtacccggccaccgccccggccccggccccgggcgccaaggcgcccatcgcctccgccctctccccggtgtcctctcccccggcccctcccaccgagggctcctcctctatgaccccgaac

SEQ ID NO: 43577 - protein, 81 aa, Panicum virgatum
  misc_feature: Ceres CLONE 2017197
  misc_feature: Functional homolog of the protein sequence given in SEQ ID NO 51303
  misc_feature: Useful for making plants with altered carbohydrate content
MARFAIVAAIVALLAVTVAAQDPAATPTPAPRMAPLPAPPARYPATAPAPAPGAKAPIASALSPVSSPPAPPTEGSSSMTP

SEQ ID NO: 43578 - DNA, 732 bp, Panicum virgatum
  misc_feature: Ceres CLONE 2017202
  misc_feature: Encodes the peptide sequence at SEQ ID NO. 43579
aactgctggtcccattcctatctgcaaaacagaagtagtgactgacaacttaaaccctgtttggagggcaatcactttaacatcacagcagtatggaagcaaggataacccactgctagttgagtgttttgattttgattccagtggtgaccatgaactgataggggcattccagacaactattactcagcttgaaaatctatatacttccaagtctggagcaaatttttacagccacaagggacaaagaaagatgaaaggacaattgtttgtggataagttgcaggaaaaaatccagcatactttcttggactatatatccagcggatttgagctcaattttatggtggctgtagattttactgcttcaaatggtgacccccgtgtacctcagtccttgcactacattgacccctctggcagacctaattcataccaacaggcaatactgggggttggcgaagttctgcagttttatgacactgataggcgatttcctgcatggggttttggagtaaagacacagggtcatgtatcacactgttttaacttgaatacagctacaaatgactgtgaggttgttggagttgaaggcatcatgtcagcatacacctcttctctttacagtgtttcccttgctggaccaactatgtttgggcctgttatcaacaaagctgtagaaattgctactcagtccctttcatactcaaacaacaaatatttcgtcctact

SEQ ID NO: 43579 - protein, 243 aa, Panicum virgatum
  misc_feature: Ceres CLONE 2017202
  misc_feature (132)..(243): Pfam Name: Copine Pfam Description: Copine
TAGPIPICKTEVVTDNLNPVWRAITLTSQQYGSKDNPLLVECFDFDSSGDHELIGAFQTTITQLENLYTSKSGANFYSHKGQRKMKGQLFVDKLQEKIQHTFLDYISSGFELNFMVAVDFTASNGDPRVPQSLHYIDPSGRPNSYQQAILGVGEVLQFYDTDRRFPAWGFGVKTQGHVSHCFNLNTATNDCEVVGVEGIMSAYTSSLYSVSLAGPTMFGPVINKAVEIATQSLSYSNNKYFVL

SEQ ID NO: 43580 - DNA, 720 bp, Panicum virgatum
  misc_feature: Ceres CLONE 2017203
  misc_feature: Encodes the peptide sequence at SEQ ID NO. 43581
aagtgcgcagcctgaacaaaacgccgccgccgccccttcctccggcgcgccagcagccatggtgaaacggtggctccccctcgaggccaacccggacgtcatgaaccagttcatgtggggactgggggtccccgaggacgtggggttctgcgacgtgtacggcctcgatgacgagatgctcgccatggtcccccagcccgtgctcgccgtcatctcgctctacccccaggaccggatcaaggaatcccagtcttcgactgccacaccagtggagaccaaggagcccagcaaaaatgtatatttcacaaggcagacgattggaaacgcctgtggaacagttggtattattcatgcactggggaatgctgcttccaaaatcaagctaggtgaggggtcgtattttgatagattttataaacgaaccgctgatatggatccagtccagcgtgctgcatttcttgaggaggaccaagaaatggagaatgctcattctgttgccgtttctgctggtgacacagaggccaaggatggagtaattgaacattatatttgtttctcttgtgtcgatggagaactttatgagcttgatggaggtacctcgcggccaatatcccatggccattcgtcccctgataccttgttgcaggatgctgcaaaagttataaaagaaagacttgcactgtatcccgagtcatacaacttcaatgtcatggctctttc

SEQ ID NO: 43581 - protein, 220 aa, Panicum virgatum
  misc_feature: Ceres CLONE 2017203
  misc_feature (4)..(209): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
MVKRWLPLEANPDVMNQFMWGLGVPEDVGFCDVYGLDDEMLAMVPQPVLAVISLYPQDRIKESQSSTATPVETKEPSKNVYFTRQTIGNACGTVGIIHALGNAASKIKLGEGSYFDRFYKRTADMDPVQRAAFLEEDQEMENAHSVAVSAGDTEAKDGVIEHYICFSCVDGELYELDGGTSRPISHGHSSPDTLLQDAAKVIKERLALYPESYNFNVMAL

SEQ ID NO: 43582 - DNA, 729 bp, Panicum virgatum
  misc_feature: Ceres CLONE 2017204
  misc_feature: Encodes the peptide sequence at SEQ ID NO. 43583
ggctcccaagggctggaggtatcggcgcagggcctcggctgcctgggaatgtcagccttctacggcctgcccaagcctgagcccgacatgatcaagctcatccaccacgccgtcgccgcgggggtcaccttcctcgacaccgccgacatgtacggcccgcacaccaacgagatcctcctcggaaaggcgctgcagggcggtgtgagggagaaggtggagctggccaccaagttcggcgtcaataattttggccgcgccaacgtcgagattcgaggggacccggcatatgtgcgcgcgtcgtgcgagggcagcctcaagcgcctcggcgtggactgcatcgacctctactaccagcaccgcatcgacaccagggtgcccatcgaggtcacgatgggtgaactcaagaagctagttgaagaaggaaagataaagtacattggattatctgaagcttctgcgtcgacaattagaagagctcatgcagtccatcctattactgcagttcaactggaatggtcattatggtgtagagatgtagaagaagatatagttcccacttgcagggaacttggaattggaattgtggcttacagtccactaggaagggggttcttgtccagtggggcaaaactggttgaatccatgtccgagcaagatatgcgcaagcgtctgccctcgtttcaaccagagacattgttaagaatgctcagatattcgaacgtgtgagcg

SEQ ID NO: 43583 - protein, 241 aa, Panicum virgatum
  misc_feature: Ceres CLONE 2017204
  misc_feature (1)..(240): Pfam Name: Aldo_ket_red Pfam Description: Aldo/keto reductase family
  misc_feature: SWISSPROT Homolog: EC 1.1.1.65 Pyridoxine 4-dehydrogenase
GSQGLEVSAQGLGCLGMSAFYGLPKPEPDMIKLIHHAVAAGVTFLDTADMYGPHTNEILLGKALQGGVREKVELATKFGVNNFGRANVEIRGDPAYVRASCEGSLKRLGVDCIDLYYQHRIDTRVPIEVTMGELKKLVEEGKIKYIGLSEASASTIRRAHAVHPITAVQLEWSLWCRDVEEDIVPTCRELGIGIVAYSPLGRGFLSSGAKLVESMSEQDMRKRLPSFQPETLLRMLRYSNV

SEQ ID NO: 43584 - DNA, 679 bp, Panicum virgatum
  misc_feature: Ceres CLONE 2017211
  misc_feature: Encodes the peptide sequence at SEQ ID NO. 43585
aaaagatggcatccctcgaaacgtcattcattcatctgcagtcaccctctacgttcgctgtgaacgtcaatcccgtcgtttttttgtctattgtggatcactttttaaggagaaatgagcaacaagaaagagtaattggaactctcttgggggtgcggtcagaggatgggcaggaaataaccattcgaaactgctttcctgttccgcattccgagagtgccgatgggtgtgccattgatatggaataccatcacaccatgactgagcttcacgctcgcgtcagcaacgaagaggtcgtcgttggttggtatgctacgggacccgaaatcaacagctactcctccttgatacacgatttttactcgaaagaaatatccccgttcagtgcagttcacttacttgttgacacaagtctacggggcgataaactggagctgaaagcgttcaccagtgctcctgtaggagcgcctgtagcgggcacggctgacacaccaggcaagatgtttttgcctattccgtgtgaagtcaaatactatgaagccgaaagggctggattggatcttctatcgatggccaaggaagcccctgagcgaaatattgatttgctcacggacatggacaaccttgaaaaatcaatacttcaggttcaagatatgctggaaacggtggcaaactatgt

SEQ ID NO: 43585 - protein, 224 aa, Panicum virgatum
  misc_feature: Ceres CLONE 2017211
  misc_feature (14)..(125): Pfam Name: Mov34 Pfam Description: Mov34/MPN/PAD-1 family
MASLETSFIHLQSPSTFAVNVNPVVFLSIVDHFLRRNEQQERVIGTLLGVRSEDGQEITIRNCFPVPHSESADGCAIDMEYHHTMTELHARVSNEEVVVGWYATGPEINSYSSLIHDFYSKEISPFSAVHLLVDTSLRGDKLELKAFTSAPVGAPVAGTADTPGKMFLPIPCEVKYYEAERAGLDLLSMAKEAPERNIDLLTDMDNLEKSILQVQDMLETVANY

SEQ ID NO: 43586 - DNA, 973 bp, Panicum virgatum
  misc_feature: Ceres CLONE 2017215
  misc_feature: Encodes the peptide sequence at SEQ ID NO. 43587
aaaccaaaccagtgcgccgagatcaaaaacagaaagaaaaaaaaagaaaagaaatcgagtccctccggcacggcggcaccaccagtgcgcccgccgccgtcatccgccggtcctccagcctcctcctcctccctgtctccgcatagccacgccgcatccccgccctcctcctgcctttcccagcggatttcctcgcccttcctccgccatctccccttgccgctgcggtgctctccgccgcctccttctgcccccgccttcgtcgtctctctcccgccagctgctgccgccgcttctcgagcagggatacaatctgaagagagaaaatgtcgtcgaagaagaactactacaaggagaagatgatgcggcggaaagaggagaaaaaagaagaaccagagacacccaggtatcgtgatcgtgctaaagagcgtcgtgaagatcaaaacccagactatgaacctacagagcttggttcatttcatgctgtggcacctcctgggacagatttgaggctggctgatgcacacaagatttcaattgagaaaagcaaatacctaggaggtgatttggagcatacacatctggtcaaaggcttggactatgctctacttcacaaagtacggagtgaaattgaaaagaaacctgatgcagaggatgagaaggaggcaaagtcaagggcaacaaaagatcaggctgtctccttccgaactgcaactgcaaagtctgtctaccaatggatcataaagccacaaagcataataaaagagaacgaattgtttctccctggtcggatgtcatttctttacaatatggaggagggactcaccaatgacattccaacaactcttcataggagcaaagctgattgccctgttccagaggagatggtaactgtcagtgtggatggttctgtacttgacaggattgctaaaattatgacataccttcgacttggatcttcagggaaggtctt

SEQ ID NO: 43587 - protein, 215 aa, Panicum virgatum
  misc_feature: Ceres CLONE 2017215
  misc_feature (5)..(215): Pfam Name: RED_N Pfam Description: RED-like protein N-terminal region
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIEKKPDAEDEKEAKSRATKDQAVSFRTATAKSVYQWIIKPQSIIKENELFLPGRMSFLYNMEEGLTNDIPTTLHRSKADCPVPEEMVTVSVDGSVLDRIAKIMTYLRLGSSGKV

SEQ ID NO: 43588 - DNA, 672 bp, Panicum virgatum
  misc_feature: Ceres CLONE 2017226
  misc_feature: Encodes the peptide sequence at SEQ ID NO. 43589
aaagccagctccatttctcaccaccaccaccagctcgctctcgccgcgcctcacccaaagctcgccattgattgattgatttccacccgcgtaggagcgagcagcagcagcaacaaccgcacagctagccgagctcggcccggctggcgtcgatggcgaaatgcagcagcaagatccgctacatcgtgtggctccggcagacgctgcggcggtggcggtcccgcgccgcggcgcgcgcggcggtggcggcggtcgggagcgaggcggtggtcccggcggggcacgtggcggtgtgcgtgggcggcgcggcgcggcggttcgtggtgcgggcggcgcacctgaaccacccggtgttccgggagctgctccggcaggcggaggaggagtacggcttcccgtccggcgcctgcgcgggacccatcgcgctcccctgcgacgagggcctcttcgagcacgtcctccgccacctctcctccccgtccaaggcttcccggttcgtcaccctcgaggacatcaagagcggcgcgctatcctgctgctgcgtcgccgccgcaggcgactcgctcccgctcctccacggcatcgccgccgacaaggccgtgtggtgaacgcgctcacggagggtagccgccgctcgcgccattgcgcgtacgtgtgcgaccatttcgtctt

SEQ ID NO: 43589 - protein, 151 aa, Panicum virgatum
  misc_feature: Ceres CLONE 2017226
  misc_feature (4)..(107): Pfam Name: Auxin_inducible Pfam Description: Auxin responsive protein
MAKCSSKIRYIVWLRQTLRRWRSRAAARAAVAAVGSEAVVPAGHVAVCVGGAARRFVVRAAHLNHPVFRELLRQAEEEYGFPSGACAGPIALPCDEGLFEHVLRHLSSPSKASRFVTLEDIKSGALSCCCVAAAGDSLPLLHGIAADKAVW

SEQ ID NO: 43590 - DNA, 639 bp, Panicum virgatum
  misc_feature: Ceres CLONE 2017235
  misc_feature: Encodes the peptide sequence at SEQ ID NO. 43591
acgctcgatctctcgagcacagagcactacaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagggggatcacatcgctgagcagaagtacggtggcggtgggtacggtggcggcggcggcggatacggtggtggcggtgggtacggcggcggtggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccg

SEQ ID NO: 43591 - protein, 167 aa, Panicum virgatum
  misc_feature: Ceres CLONE 2017235
  misc_feature (1)..(69): Pfam Name: GRP Pfam Description: Glycine rich protein family
MSGKALLVAVLLVGVASRCSGSRGLQGDHIAEQKYGGGGYGGGGGGYGGGGGYGGGGGGGYTPGYSGTGTCDYWKSHPDAIISCIGSLGSILGSFGDVCSAFFGSKLQTLQDALCNTRTDCYGDLLREGAAAYLNSVASQKYAYTTQQVKDCIAVALTSEAAAAAQA

SEQ ID NO: 43592 - DNA, 732 bp, Panicum virgatum
  misc_feature: Ceres CLONE 2017240
  misc_feature: Encodes the peptide sequence at SEQ ID NO. 43593
gtgggcgccgggcccatcgccgtccacctcctcctcctcgccttcccccttcagggtgggggttgcgtcgacggccgtgccggcttcttccgcgcccaggatggtcgccgtgtccgcgcccctgggtcgtcggcggcggcggcaagtggttcaagctgttgccaacccagaccctgcgattgagctgccgctgactgctgaaaatgttgagatggtgttggatgaagtaaggccatatcttatggcagatggaggaaatgttgcactgcatgagattgacgggaatgttgtgaggttaaagctgcaaggagcatgtggctcatgcccggcttcagtaacaacgatgaagatgggtatcgagcgacgcttgatggagaaaataccagagattgtagcagttgaacccatcgctgatgaggagactgggcttgagttgacccaagagaacatcgaaaaggtacttgatgagattaggccgtaccttgctggcacaggaggtggtgagctcgagtttgttgcaatcgaggaacctattgtcaaggttaggcttacaggaccagctgctggtgtgatgactgttcgagttgcccttactcagaagctccgagaaaagatccctaagattgcagcagtccagctattgtcataagcctataaagtttagatccagccagctccatctatctacagtgtaaatgtgtttgcaataatccttcaaaagaatttgtaacg

SEQ ID NO: 43593 - protein, 215 aa, Panicum virgatum
  misc_feature: Ceres CLONE 2017240
  misc_feature (69)..(136): Pfam Name: NifU Pfam Description: NifU-like domain
  misc_feature (150)..(214): Pfam Name: NifU Pfam Description: NifU-like domain
WAPGPSPSTSSSSPSPFRVGVASTAVPASSAPRMVAVSAPLGRRRRRQVVQAVANPDPAIELPLTAENVEMVLDEVRPYLMADGGNVALHEIDGNVVRLKLQGACGSCPASVTTMKMGIERRLMEKIPEIVAVEPIADEETGLELTQENIEKVLDEIRPYLAGTGGGELEFVAIEEPIVKVRLTGPAAGVMTVRVALTQKLREKIPKIAAVQLLS

SEQ ID NO: 43594 - DNA, 712 bp, Panicum virgatum
  misc_feature: Ceres CLONE 2017243
  misc_feature: Encodes the peptide sequence at SEQ ID NO. 43595
aacaagggactcgccaataatggcatctcggactacctgtctcgggggccgttcctcgttgcgccggccggtactgctgcaccgcctcgtggtggtggcgatggcagcagcggcgtttcggccgcaggtagtccatggagcagcatcggctgggcaacagaaaatctcggcgatcttcatgttcggcgactccatcgtagatcccggcaacaacaacaaccggttcacggaggcaaaggctaacttcccgccatatgggcaggacttccttggcggcgttgccaccgggagattctccaatgggttggtacccggggacctcttagcttcgaagttgggtgttaagcagctattgcctcctttccttagtgatgatcttgaactaaaagacctactcactggtgtggcattcgcatgtggaggcagtggttatgatccactcacatcaaaactcgcgactctcaatgatatgggtgctaagaggattgggattgttggtgtcccaccactgggatgttgtccttcacaaataacacttggaggaagcccctcacgtcaatgcgaaccactaaggaatcaagcatcaagattatttaattctagaatttcacaggaaatagagatactaaatgcagagcgaagtgcttctggatcaacaattgcttattttgacatatactacaacctacttgatcttattcagaatccagct

SEQ ID NO: 43595 - protein, 230 aa, Panicum virgatum
  misc_feature: Ceres CLONE 2017243
  misc_feature: SWISSPROT Homolog: EC 3.2.1.51 Alpha-L-fucosidase
MASRTTCLGGRSSLRRPVLLHRLVVVAMAAAAFRPQVVHGAASAGQQKISAIFMFGDSIVDPGNNNNRFTEAKANFPPYGQDFLGGVATGRFSNGLVPGDLLASKLGVKQLLPPFLSDDLELKDLLTGVAFACGGSGYDPLTSKLATLNDMGAKRIGIVGVPPLGCCPSQITLGGSPSRQCEPLRNQASRLFNSRISQEIEILNAERSASGSTIAYFDIYYNLLDLIQNP

SEQ ID NO: 43596 - DNA, 508 bp, Panicum virgatum
  misc_feature: Ceres CLONE 2017257
  misc_feature: Encodes the peptide sequence at SEQ ID NO. 43597
accagcagtacaggaagcacaagaaagccacttctagccatcaacaacgacttcttcttcaccatcatcgtcacctaactcagacagtattagcgactgaagaagaagaagatgagctcctccgcggaaccagctgtgtgcggcggcggcggcaagatcacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtttgaataataatggatgtgtgttctttccctataaatcaaataaataagcaagggatgtgtaaaaggatcgtggcccaagaacgatgttgaattgagactttttcg

SEQ ID NO: 43597 - protein, 75 aa, Panicum virgatum; identical to SEQ ID NO: 19162
  misc_feature: Ceres CLONE 2017257
  misc_feature (17)..(75): Pfam Name: potato_inhibit Pfam Description: Potato inhibitor I family

SEQ ID NO: 43598 - DNA, 1375 bp, Panicum virgatum
  misc_feature: Ceres CLONE 2017269
  misc_feature: Encodes the peptide sequence at SEQ ID NO. 43599
actagttcttggcctcgtcttcctgctcctgccatcacgcccgcccccccaaattcacctcgcccgccgtcaccctcctccgcctcgtcggcgcggaccggcagccaaagtcgcgggccactgcatcgcgctcctggcgcgtgccgtgcgtccatctctccgcctcatctcccgagcgcattccacgccactcctgtgccgccacccagaggccctcctcgccgcgtgtctccccctccccctctccctctccggctcccacatcctcctctcccattcagttcatgttgcatcataagggatgaacagcagtcgacaaatggaactccactacataaacactggatttccgtacactgttaccgagagcttcatggatttctttgaaggtctcacctatgctcatgctgactttgctcttgcggatggctttcaggatcagggtaatccatactgggcaatgatgcatgcaaactcgtacaagtatggatattctgctccagggaactattacagttacgcccatgcctacgacatagatgattacatgcatagagcagatggtgggcgcagaatatgggataacactacacctgtaaacaatgtggactctggcaatgttgtactgcagggtggtgaagcttctcgtacaactgcaaattctaccactgaggaatgcatccaacaggcacatcaaagtccgggtagtcctcaggttgtttggcaagataacattgatcctgacaatatgacatatgaggaattgttggacttgggggaggcagttggaacccagagccgtggtctctcccaagaacacatttcattgcttcctgtcacaaagtacaagtgtggtttcttttcaaggaagagaacacgccgtgaaaggtgtgtgatttgccaaatggagtacaggagaggaaatttgcagatgacgcttccctgcaagcatgtataccatgccagctgtgtgacaagatggcttagcataaacaaggtatgccctgtttgcttcgccgaagttcctggtgaggaacccaagaggcaatgagttatcggttatgtggcctccatgaaggtgtcgcgctccaaagttgagcccactgccccctatggacacatgatttctgcttgaagccagcatgttgtcccctccttagaattgtgtattagcatcatattaccaaatataggtttataatcagatgtagttgctaccgagaggtttgctgtaggctgctgtagagttccgactacgaactaagaccacctgctagacaaaagcatgctcgatgacttcgatatgtttttgttcattgcaatgagcatgttctagtttgtgttacttgcaatatgattaagattttgcggacag

SEQ ID NO: 43599 - protein, 243 aa, Panicum virgatum
  misc_feature: Ceres CLONE 2017269
  misc_feature (191)..(231): Pfam Name: zf-C3HC4 Pfam Description: Zinc finger, C3HC4 type (RING finger)
  misc_feature: Functional homolog of the protein sequence given in SEQ ID NO 50438
  misc_feature: Useful for making plants with altered terpenoid content
MELHYINTGFPYTVTESFMDFFEGLTYAHADFALADGFQDQGNPYWAMMHANSYKYGYSAPGNYYSYAHAYDIDDYMHRADGGRRIWDNTTPVNNVDSGNVVLQGGEASRTTANSTTEECIQQAHQSPGSPQVVWQDNIDPDNMTYEELLDLGEAVGTQSRGLSQEHISLLPVTKYKCGFFSRKRTRRERCVICQMEYRRGNLQMTLPCKHVYHASCVTRWLSINKVCPVCFAEVPGEEPKRQ

SEQ ID NO: 43600 - DNA, 955 bp, Panicum virgatum
  misc_feature: Ceres CLONE 2017271
  misc_feature: Encodes the peptide sequence at SEQ ID NO. 43601
atccagcggtgccggtggcggcgcctcactctcgaggacagacaggttgcaaggaaggccaatggcagcgctgcggctgatgctcctgctcctcctcctccatctcgccgccgccgccgccaaccggacgacgccgctggtgtcgttcctccttgcggggcagtccaacatgggcggccgcggtggcgccaccagcggcggcaagtgggacggcgtggtcccgcccgagtgcgccccctcgccgcgcatcctccgcctctccccggagctccgctgggacgaggcccgcgagccgctgcaccgaggcatcgacctccacaacgtgctcggcgtcggccccgggatgcccttcgcgcacgccctcctgcgctcgcgccgcctcccgccgcacgccctcgtcggcctcgtcccctgcgcgcagggcgccacgcccatcgccgactgggaacggggcacccacctctaccagcggatgctccaccgcgccagggccgccaccgccggcaatggcaagctcgccgcgctgctctggtaccagggggaggccgacaccatcagccgccgcgacgccgagctctacgcggggcgcatggaggccttcgtccgcgacgtccgccgggacctgggcatgccggacctgctcgtcatccaggtcgagcttgccacaggccagggcaagttcctggacctcgtcagggcagctcagaagcgagtggtgctcagcaacgtcaggtacgtggacgccaggggcctgcccgtggccaacgacttcacgcacctcaccaccgcggctcaggtgaagctcggcaccatgctagccaactcctacctagccacgctctgaatttttttttctgtttgatggtagccaacgctctgaattgattccatctgggattgttaattccattgtaacgtactccgtaccgtaactcagaatatctgcatcaaactt

SEQ ID NO: 43601 - protein, 260 aa, Panicum virgatum
  misc_feature: Ceres CLONE 2017271
  misc_feature: Functional homolog of the protein sequence given in SEQ ID NO 50200
  misc_feature: Useful for making plants with altered cell wall content and/or composition
MAALRLMLLLLLLHLAAAAANRTTPLVSFLLAGQSNMGGRGGATSGGKWDGVVPPECAPSPRILRLSPELRWDEAREPLHRGIDLHNVLGVGPGMPFAHALLRSRRLPPHALVGLVPCAQGATPIADWERGTHLYQRMLHRARAATAGNGKLAALLWYQGEADTISRRDAELYAGRMEAFVRDVRRDLGMPDLLVIQVELATGQGKFLDLVRAAQKRVVLSNVRYVDARGLPVANDFTHLTTAAQVKLGTMLANSYLATL

SEQ ID NO: 43602 - DNA, 852 bp, Panicum virgatum
  misc_feature: Ceres CLONE 2017284
  misc_feature: Encodes the peptide sequence at SEQ ID NO. 43603
aaacacgactcgccccgcggccgtcctgtcagtgtcactctctttcccagcggccggctctagtgagctcttcagatcaggctcgccttcccctcccgctctcccgccgccgccgccctcgtcgaccccgtgaactgcgccggagcggcgatccgtcgaaccacctggatcgacctcttctgccgctgttctgtaattccgaaggatcaagatggacgttattatcattatctctcttgtcattcttttggcactgggagctctctttgtgatcccgaagtcccaaaacaaaggtaaatcaaagggaactgattcagtagatggaatgacatctaagaggtatacaaaggaagagatctctgaacataacacaaggaaggattgttggatcatcatcaaagacaaggtctatgatgtcactccttatgtggaagaacatcctggcggagatgccattctaactaatgctggtggtgattccacagaaggcttttttggaccacagcacggcactagagtcttcgatattatcgaggatttctgtatcggacagttgaaggattcatgaaattgagggtagattgtattgatttcatggaattttcctggcatcagtttatgagaagctatatatatggtagccatgttttcagccttgtcaaggtccaggtgtgatatgtcagagtcaaactgttctgcactcgtgatcagggctgccctcagctttgcggtgtaacttcatttcttgtgctggaacaatgtcagcgtcatccgacaattgcttgttgtgtttgtacatttaagatcttaaacaggaattctgaaaaaattgcaattgtttagattaatcag

SEQ ID NO: 43603 - protein, 118 aa, Panicum virgatum
  misc_feature: Ceres CLONE 2017284
  misc_feature: SWISSPROT Homolog: EC 1.7.1.1 Nitrate reductase (NADH)
MDVIIIISLVILLALGALFVIPKSQNKGKSKGTDSVDGMTSKRYTKEEISEHNTRKDCWIIIKDKVYDVTPYVEEHPGGDAILTNAGGDSTEGFFGPQHGTRVFDIIEDFCIGQLKDS

SEQ ID NO: 43604 - DNA, 712 bp, Panicum virgatum
  misc_feature: Ceres CLONE 2017300
  misc_feature: Encodes the peptide sequence at SEQ ID NO. 43605
tgaacttgctagagcgagcaccgagcagcaaacacagcagcatcggcgaggggagaggaagtgagctccagcccactcgctctctccggccggcgcctcgtttccttgccgctgcgtgcgcgcctcggctacggctagtgccatgggtggtggcgcggcgaggagggtggccgtggcggcgctggcggtggcggtgctggccggcgtggcgtcggcggccgtgtacgaggtgggcgacaaggccgggtggaccgtcatgggcaaccccaactacgccgcctgggccagctccaagaagttccgtggcaatgacgtcgtcgtgttcacgtacaacaagcagttccacaacgtgctggcggtgagcaaggcggactacaagaactgcgacgccagcaagccgatcgccacctggtccacgggcaacgactccgtcgtcctcaagaccgcgggccaccactacttcctctgcggcttcccgggccactgcgccgccggccagaaggtggacatccgcatcgccacctcctctgatgccccttccgcggcgcccacccccgagccctccgccggcggcgccacgaccgcgccggcgccgcaccccaacgccgcgcccaaggcgctccccgcaggcagctccgtcgccgccaccgtcgccgcgtcactgctctccctgggcgcggccgtgctcgcgtgaccaggggctccgtagtgt

SEQ ID NO: 43605 - protein, 183 aa, Panicum virgatum
  misc_feature: Ceres CLONE 2017300
  misc_feature (36)..(119): Pfam Name: Cu_bind_like Pfam Description: Plastocyanin-like domain
MGGGAARRVAVAALAVAVLAGVASAAVYEVGDKAGWTVMGNPNYAAWASSKKFRGNDVVVFTYNKQFHNVLAVSKADYKNCDASKPIATWSTGNDSVVLKTAGHHYFLCGFPGHCAAGQKVDIRIATSSDAPSAAPTPEPSAGGATTAPAPHPNAAPKALPAGSSVAATVAASLLSLGAAVLA

SEQ ID NO: 43606 - DNA, 626 bp, Panicum virgatum
  misc_feature: Ceres CLONE 2017311
  misc_feature: Encodes the peptide sequence at SEQ ID NO. 43607
gagcctccaacgaggcaacccctctgcagctcctccacaaggcaacacacgcgcttcgccgagatgtctagttcccctctgctgctcctgctcctctgcgccgtcggcgccgcggccgccgccgtgccgaggtaccgcgaggcgccgaacatcaccgactcggcggcggcgcagtgcccgccgccactcccgccgtcagaggcggacgcggcgtgctcgccgcttgcggcggtgcacgtggccatgaccctggacgcgtcgtacctgcggggcaccatggcggccgtgctctccgtgctgcgccacgcgtcctgcccggagtccatcttcttccacttcgtcgcctccgcgacggcctcctcgaggtcgagggccacggcgggggagctgcgggccacggagcgcgcgtcgttcccgtcgctggcgttccgggtgtacccgttcgccgaggagggccgcgtggcggggctcatctccacctccatccgcagcgcgctcgaccgcccgctcaactgcgcgcgctcctacctcgcgtccacgctcccgccctgcgtgcgccgcgtcgtgtacctcgactccgacgtgctgctcaccgacgacatcgcggccctcgcctccacgtcgct

SEQ ID NO: 43607 - protein, 187 aa, Panicum virgatum
  misc_feature: Ceres CLONE 2017311
  misc_feature: Functional homolog of the protein sequence given in SEQ ID NO 51675
  misc_feature: Useful for making plants with altered cell wall content and/or composition
  misc_feature: Functional homolog of the protein sequence given in SEQ ID NO 51651
  misc_feature: Useful for making plants with altered carbohydrate content
MSSSPLLLLLLCAVGAAAAAVPRYREAPNITDSAAAQCPPPLPPSEADAACSPLAAVHVAMTLDASYLRGTMAAVLSVLRHASCPESIFFHFVASATASSRSRATAGELRATERASFPSLAFRVYPFAEEGRVAGLISTSIRSALDRPLNCARSYLASTLPPCVRRVVYLDSDVLLTDDIAALASTS

SEQ ID NO: 43608 - DNA, 705 bp, Panicum virgatum
  misc_feature: Ceres CLONE 2017312
  misc_feature: Encodes the peptide sequence at SEQ ID NO. 43609
gcgcccccgctcctctccttcctcgtcacgccgcgacgcctcctcctctccctatctctccctctctccccccacccagagctcgaaaccctaggcgcgcgcggcgggggcggcgacgcatggccatggacccggacgcggtggccaaggccttcgtggagcactactaccggacgttcgacaccaaccgcgccgcgctggtgtcgctgtaccaggacacctccatgctcaccttcgagggccagaagctccagggccccgccgccatcgccggcaagctcggctcgctccccttccagcactgcgagcaccagatcgtcaccgtcgactgccagccgtcggggccccagggaggcatgctcgtcttcgtctccggctccatccgcactgcccccgacgagcaccccatgaagttctcccaggcgttccatttgatgccggctggaaattccttctacgtgcagaatgacatgttccgcctgaactatggttaaagacagtcaagagttgctggaagcgaagtgattaagggtttcatgttgaactgatgaatatgaatgatgctgctactcttgcccctttgttggctgctgttgtttattgctagaaaattgctagacttgatatgcttgttggataatttcttattttggatcatgtactctggttgcgtgggcaccgattctctgtggattgtgaatgaaa

SEQ ID NO: 43609 - protein, 124 aa, Panicum virgatum; identical to SEQ ID NO: 12280
  misc_feature: Ceres CLONE 2017312
  misc_feature (8)..(121): Pfam Name: NTF2 Pfam Description: Nuclear transport factor 2 (NTF2) domain

SEQ ID NO: 43610 - DNA, 684 bp, Panicum virgatum
  misc_feature: Ceres CLONE 2017314
  misc_feature: Encodes the peptide sequence at SEQ ID NO. 43611
aaaaaggccaaaaggcaacgaagactcgaagaagagaggaacactcgaggggagactgctctctcagcgatcgctcgaggcggcctctcaagatggtggtgctgcaaccagatcggttcctgagcgagctgacgagcatgtacgagcggagcacggagaagggctccgtgtgggtcaccatgaagcgatcgtctctcaagggcaaggcacagttgcagaagatggagaagaaagggaaggaggtggagtaccggtgccttgtccgcgcctccgatggcaagaagagcatctccacctcggtctcactaaaggagtacgcaaagttccaagcttcatatgcaacagtgcttaaagcccatatgcatgctctgaagaaaagggagaggaaagacaggaagaagcctgcagatgctgagaaggtacccgagactgcacccaagaagcagaagaaagcgtcctcgaaaaaatcctcgaaaaaatcctcagggtccaagtcgtaaggcgcttgcaggactcactactgtgctttctgttgtctacagccagactaatctgagtgtcgtcaagatttcctcatccgtttttattcttgttgtgtctgggaggtgaagcctgtgaatacacctctatagagctgtgctgtcgatactagcatttttgaagatgcgttttgaggtgaatctt

SEQ ID NO: 43611 - protein, 135 aa, Panicum virgatum
  misc_feature: Ceres CLONE 2017314
  misc_feature (4)..(93): Pfam Name: SRP14 Pfam Description: Signal recognition particle 14kD protein
MVVLQPDRFLSELTSMYERSTEKGSVWVTMKRSSLKGKAQLQKMEKKGKEVEYRCLVRASDGKKSISTSVSLKEYAKFQASYATVLKAHMHALKKRERKDRKKPADAEKVPETAPKKQKKASSKKSSKKSSGSKS

SEQ ID NO: 43612 - DNA, 861 bp, Panicum virgatum
  misc_feature: Ceres CLONE 2017340
  misc_feature: Encodes the peptide sequence at SEQ ID NO. 43613
gttgccgaagtggacgatgtggtgcggaagatgagggagtggtcgccgccgccgccggcgtcgccgtcgctggtggttcacagccccaggcagacggtcagccgcctcctcagacgccgaccccaccgcgactgggatccctcctcggggcccccctccttcgccgcccgcgaccacggccccaagccgtcggaggtgtacggcttcgtcggatccatcaccaccgtcatcgccaccgccgtctacctcgcttgggcctacacgcccgaaccctgcctccgttccctcggcatcacctactaccctagcaagtactgggcattggcggtgccatcgttcgtgattgttgcggtggcactgtccatggtcatctatatgggtctcaacttcctcgacactcctcccccgacttccttcagcactatcttcgatgaaaatagtcgggagcgcatcgtgttttctcctgcaatggaagaggagaagcccatcgatcccatttcagacattagtgttgttcagaccaacaatcttatgtttggtaaaacctgattgctcagaagattgctcagaagattggagtaccaagatggagaaatacatcaagtgaactttcagtttgccttcataagaaatcagggaaactgaaccttcaggatttttttttgtgtgttaaagaacccccaggcttccccagttcccctgtgtacaacttcacctgtatcttgtgcagtaatgcaatgtactgtaatagaattttttttttgtctgcatgatagttctttcctaagcacagttcacctatttgtaaaccattttcaatcggcttgttaaattgatggcttgatgggtcgttataggtgg

SEQ ID NO: 43613 - protein, 172 aa, Panicum virgatum
  misc_feature: Ceres CLONE 2017340
  misc_feature (52)..(170): Pfam Name: PIG-P Pfam Description: PIG-P
  misc_feature: SWISSPROT Homolog: EC 2.4.1.198 Phosphatidylinositol N-acetylglucosaminyltransferase
MREWSPPPPASPSLVVHSPRQTVSRLLRRRPHRDWDPSSGPPSFAARDHGPKPSEVYGFVGSITTVIATAVYLAWAYTPEPCLRSLGITYYPSKYWALAVPSFVIVAVALSMVIYMGLNFLDTPPPTSFSTIFDENSRERIVFSPAMEEEKPIDPISDISVVQTNNLMFGKT

SEQ ID NO: 43614 - DNA, 1076 bp, Panicum virgatum
  misc_feature: Ceres CLONE 2017344
  misc_feature: Encodes the peptide sequence at SEQ ID NO. 43615
agtacagatacccgccacagcacagcgaacacagccctagccgctgccgcctgccggcgctgccaaccctagctcatgttcctgcggcggcggcggcactccccggaggtgcaagaacctgcgccaccagccggcgcccttccctttttcaagtatttcttcccccaacgcccctagccttttctgtctctgtcgccggcgtcctttcgccgccgccgccatcgccgtcgttcttctcttctatctctctctgttattcagtctccagctatcgagcgacttcaggctcagtccggcaaacaccttcaagctcaatccgacgcccttcaagatctggcttgcaggaatccaaagggctcctttgatcagctctggtttgatgttggtggtttctgcttatcggatcactccaagggtccgccactggtttcgggggaaccctaccgggggccatggctgcggcggagacacgggcgcgacaggagaaagtgaggaagttcgaggagttcgtggaccagcgtctgaagcccgacctcgccaacgctattaagcagcgcaacaaggtgtttgagcagcagaagaccttcttggatttgaagaggaacattgaaaatttggagaggaatggcgtcactagcattcggtccatggtcaatcttggctcggaggtgtacatgcaagcagaagtacaggacacaaggcacatttttgtggatattggtctaggttttcatgtggaatttacttggcaagaagcattacagtttatatctgtaagagaggcaaggttggctaggcaaatagatgaatacacgcatctcattgcaagcataaaatcacagatcaagctggtatgtgaaggtatccgtgaactgctgcagctaccaccggagacagagttatcacctaggaatacatggtagaatttggttctcacggcaaagggttggtgacatcgagcttgtaaaatgtggtgcagttgtgcaagatggttccatttatgacagcaacatggcttaaaaatctgatgaccacctgcagttgaaattatccaaaccttggagtaatctgaaacc

SEQ ID NO: 43615 - protein, 156 aa, Panicum virgatum
  misc_feature: Ceres CLONE 2017344
  misc_feature (24)..(144): Pfam Name: Prefoldin Pfam Description: Prefoldin subunit
MAAAETRARQEKVRKFEEFVDQRLKPDLANAIKQRNKVFEQQKTFLDLKRNIENLERNGVTSIRSMVNLGSEVYMQAEVQDTRHIFVDIGLGFHVEFTWQEALQFISVREARLARQIDEYTHLIASIKSQIKLVCEGIRELLQLPPETELSPRNTW

SEQ ID NO: 43616 - DNA, 1544 bp, Panicum virgatum
  misc_feature: Ceres CLONE 2017360
  misc_feature: Encodes the peptide sequence at SEQ ID NO. 43617
gagtggtgacgcggcgagcacagagccacagagcgatgccaccaacccacatacgagaagatggtttgatcgattaatcgagcgagggagaggcagagagggttgtcgagatcaccaaccggcggcgaggtgggggagagatgaccggggaaggaaacggagacgaagggtggaggcggagcggcatcgaggtcagcgccctgcagttcggctacgaagggcagccgccgctattcgcgcgattcaacctccgagtcgcccctggctcccgctgcctcctcgtcggcgccaatggatcaggcaagactacactcttgaagattcttgcgggaaagcatatggttgggggaagggatgtggtccgtgttctcaatggttcagcttttcatgacacacagttggtgtgcaatggtgacctttcgtacttggggggctcttggagccggactattggttcagctggcgatgttccgctgcaaggcgacttctctgctgagcacatgatttttggaggtattctatcacactgtaatgctcatgctcatcatttgaacatataccatacttgggttccttattgacagaagagatcatgtgtctcacagtcacatacacctttgccctttaactggaacccctgattgcttcaatcatctcttcttgatagcttcctgctggcatggttttttgttacatgctgcttccgcatttgttgtttagatttacctagtttaataatgccttaagttagaagataggcactaaaatcagattattgctagcagaaaagcttttatcctttcgtgctactgagagtacatgtaaacatttctttcattctctaccctgaaatatgagcagttgacggggttgatcctgttaggcgagagaagctgattgatctgctagacattgatctgcaatggcgcatgcataaagtttcagatggacagcgccgcagggtgcaaatctgcatgggtcttcttcatccatacaaggtgcttttacttgatgaaatcaccgttgatctggatgttgtgaccagaatggatcttcttgacttctttaaggaagagtgcgaacagagagaagccaccattgtgtacgccacccatatattcgatggcctagagacatgggctacggacattgcatatatccaggaaggcgaactgagaaaatcagcaaaatacatggacatcgaagagctgaagaatgccaaaaatttgttgaccgtcgttgagtcatggctccgatcagagaccaaactccccaagaaggatcctccacgttcagaggcccagcccaggcgctcctcgccgtttgatagttcccctttacgctcatcttgccacatggcatactaccgttgatgatttggcaaccctgcacttacttttgtacaactactagtagtcatatattgctatagtatctgtcacctctgcttttttttcttttttgaaaaacatatttggcatcgtatctgcttcgcttgcttgtatgcagcaatatatgtgtagaataaagttagcttgctccgg

SEQ ID NO: 43617 - protein, 146 aa, Panicum virgatum
  misc_feature: Ceres CLONE 2017360
  misc_feature (34)..(84): SWISSPROT Homolog: EC 3.6.3.30 Fe(3+)-transporting ATPase
  misc_feature (14)..(64): SWISSPROT Homolog: EC 3.6.3.36 Taurine-transporting ATPase
  misc_feature: Functional homolog of the protein sequence given in SEQ ID NO 50584
  misc_feature: Useful for biocontainment applications
MTGEGNGDEGWRRSGIEVSALQFGYEGQPPLFARFNLRVAPGSRCLLVGANGSGKTTLLKILAGKHMVGGRDVVRVLNGSAFHDTQLVCNGDLSYLGGSWSRTIGSAGDVPLQGDFSAEHMIFGGILSHCNAHAHHLNIYHTWVPY

SEQ ID NO: 43618 - DNA, 622 bp, Panicum virgatum
  misc_feature: Ceres CLONE 2017363
  misc_feature: Encodes the peptide sequence at SEQ ID NO. 43619
atcgagcacgagtcctctctctctccagggggaggagaggagaggagaggtgggcaggcaggcaggcaggcaagcggggcagggagaccgagagctcgcgactcccgaggcgatcgacggagcgccgccactcctgctccccttccgtaattcgccctcgcatcgacaaaatcctgaggagcatgaacccttgtcttcagcctttgatggagcatctcctacttctgctatagtcgcagttgacacaaatcttgacacatccactcttgacacttacagagcaccacctgcacctttgccttatgatgttggcttgactgttgcagaaaatcctgatctacagaaatcagacattaaaaccaaaactgaagggcagcagtccccaaaggtgggtgaatttgagtcatgcgaaaaaggtacccctgaggataatcctgatgaggaggatgtttgcccaatctgtcttgaagaatatgatgaagaaaatcctcgttctatgaccaaatgtgaacaccattttcatctctgttgcatacttgaatggatggagagaagcgatacgtgcccagtatgcgaccagataactctgatagatgagatgtatgaatagcattgttgactg

SEQ ID NO: 43619 - protein, 202 aa, Panicum virgatum
  misc_feature: Ceres CLONE 2017363
  misc_feature (151)..(191): Pfam Name: zf-C3HC4 Pfam Description: Zinc finger, C3HC4 type (RING finger)
SSTSPLSLQGEERRGEVGRQAGRQAGQGDRELATPEAIDGAPPLLLPFRNSPSHRQNPEEHEPLSSAFDGASPTSAIVAVDTNLDTSTLDTYRAPPAPLPYDVGLTVAENPDLQKSDIKTKTEGQQSPKVGEFESCEKGTPEDNPDEEDVCPICLEEYDEENPRSMTKCEHHFHLCCILEWMERSDTCPVCDQITLIDEMYE

SEQ ID NO: 43620 - DNA, 699 bp, Panicum virgatum
  misc_feature: Ceres CLONE 2017364
  misc_feature: Encodes the peptide sequence at SEQ ID NO. 43621
agccgccaccactcgcctcttcctcacgccgccgctccgctcgcacgctcgcagccgccgccggcaaaatggccccgaagagaggaggcaaggcgccggttcccgccaagaagaagacggtggtgacgaatccgctgttcgagaagaggccgaagcagttcgggatcggcggcgcgctgccgcccaagaaggacctccaccgcttcgtcaagtggcccaaggtcgtgcgcatccagcgccagcgccgcatcctcaagcagcgccttaaggtgcccccggcgctcaaccagttcacccgtaccctcgacaagaaccttgcaacaaacttgttcaagatgcttctgaagtaccgccctgaggacaaagccgccaagaaggagaggcttttgaagagagcccaggctgaaaatgaagggaaaactgttgaggcaaagaaaccaattgttgtgaagtatggcctcaaccatgtgacatacctcatcgagcagagcaaggcccagctggttgtcatagctcatgatgttgatccgattgagctggttgtgtggctcccagccctttgcaggaaaatggaggttccatactgcattgttaagggaaaagcacgccttggatcgatcgttcacaagaagaccgcatctgttctttgcctgaccactgtcaagaatgaggacaaacttgagttcagcaagatcctgg

SEQ ID NO: 43621 - protein, 210 aa, Panicum virgatum
  misc_feature: Ceres CLONE 2017364
  misc_feature (112)..(207): Pfam Name: Ribosomal_L7Ae Pfam Description: Ribosomal protein L7Ae/L30e/S12e/Gadd45 family
MAPKRGGKAPVPAKKKTVVTNPLFEKRPKQFGIGGALPPKKDLHRFVKWPKVVRIQRQRRILKQRLKVPPALNQFTRTLDKNLATNLFKMLLKYRPEDKAAKKERLLKRAQAENEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKIL

SEQ ID NO: 43622 - DNA, 713 bp, Panicum virgatum
  misc_feature: Ceres CLONE 2017366
  misc_feature: Encodes the peptide sequence at SEQ ID NO. 43623
cactttttcatggttggcttcgccccactgacatcccgtggctctcagcagtaccgtgccctcactgtccccgagctcacacagcagatgtgggattccaagaacatgatgtgtgctgctgaccctcgccacgggcgttacctcactgcctcagccatgttccgtgggaagatgagcaccaaggaggttgatgagcagatgatcaatgtccagaacaagaactcgtcctacttcgtggagtggatccccaacaacgtgaagtccagtgtgtgtgacatcccacctatgggcctgtccatggcgtccaccttcatcggcaactccacctccatccaggagatgttccggagggtgagcgagcagttcacggccatgttcaggaggaaggctttcttgcactggtacacaggcgagggcatggacgagatggagttcactgaggctgagagcaacatgaacgacctcgtgtcagagtaccagcagtaccaggatgcgaccgctgaagaggagggcgagtacgaggacgaggaggagatgcagcccgatgacttgtgagacctgagacccatgaggcttggtggttgcgttcattccgtgttgttgccatgttattactgctagcgtaccatcatcctccgtcgcagttgatgcttgtattttccttgtgctatggaatcttgcttttggtactgtatcacttatgctgctagtat

SEQ ID NO: 43623 - protein, 184 aa, Panicum virgatum
  misc_feature: Ceres CLONE 2017366
  misc_feature (1)..(120): Pfam Name: Tubulin_C Pfam Description: Tubulin/FtsZ family, C-terminal domain
  misc_feature: Functional homolog of the protein sequence given in SEQ ID NO 50258
  misc_feature: Useful for making plants with modulated flowering time
HFFMVGFAPLTSRGSQQYRALTVPELTQQMWDSKNMMCAADPRHGRYLTASAMFRGKMSTKEVDEQMINVQNKNSSYFVEWIPNNVKSSVCDIPPMGLSMASTFIGNSTSIQEMFRRVSEQFTAMFRRKAFLHWYTGEGMDEMEFTEAESNMNDLVSEYQQYQDATAEEEGEYEDEEEMQPDDL

SEQ ID NO: 43624 - DNA, 708 bp, Panicum virgatum
  misc_feature: Ceres CLONE 2017385
  misc_feature: Encodes the peptide sequence at SEQ ID NO. 43625
ggtttgggatgctgataatactgactattcactccgaactttcacgggacattcagcatctgttgtgtcacttgactttcatccaaataaagaagatatgatatgctcctgtgatagtgatggggaagtgcgcagctggagcataaataatggtagctgtctgacctgtgttaaggtgtttaagggaggtgctactcagatgagatttcaaccttgcaagggaaaatatctagcagctgcctcagagaagactatctacatacttgatggggagacacaacttgcttgtagaaatcccttgcaggggcacaacaagaatattcaatcgctttgttgggattctgctggtgactatctggcttctgtcagtgaagactctgtcagaatatggtcattcacttctggacatgatggtgaatttgtgcatgagttgaattgcagcgggaacaaattccactcatgtgttttccacccaacttatccatctttgcttgtaattggttgttacgagtctttggaactttgggacataagggagaagaacaccatgaccttcaacaatgcacatgagggtatgattgcagccctagcagcatccagcgcgacagggaaggttgcctcagttagccatgatagatttgttaagctctggaaatgatttgtgtaatagcgaccggtgttgcctgggtcgacttctacatttctggt

SEQ ID NO: 43625 - protein, 218 aa, Panicum virgatum
  misc_feature: Ceres CLONE 2017385
  misc_feature (8)..(47): Pfam Name: WD40 Pfam Description: WD domain, G-beta repeat
  misc_feature (94)..(131): Pfam Name: WD40 Pfam Description: WD domain, G-beta repeat
  misc_feature: SWISSPROT Homolog: EC 2.7.11.7 [Myosin heavy-chain] kinase
VWDADNTDYSLRTFTGHSASVVSLDFHPNKEDMICSCDSDGEVRSWSINNGSCLTCVKVFKGGATQMRFQPCKGKYLAAASEKTIYILDGETQLACRNPLQGHNKNIQSLCWDSAGDYLASVSEDSVRIWSFTSGHDGEFVHELNCSGNKFHSCVFHPTYPSLLVIGCYESLELWDIREKNTMTFNNAHEGMIAALAASSATGKVASVSHDRFVKLWK

SEQ ID NO: 43626 - DNA, 660 bp, Panicum virgatum
  misc_feature: Ceres CLONE 2017388
  misc_feature: Encodes the peptide sequence at SEQ ID NO. 43627
agttgtgaggcgcatcatcacagaggaagaccgagtgaaaaccgaagcggcagcagcagcaatggcggcctccatgatctcgtcgtcagctctggcggcaccggccagggcccagggcctgccgtccctcggccgccgcgcgtcctcctttgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctggtccgtcaccctcatcgggctccttgccggcggcgccctccttgtttacaacaccagcgccctcgccagctagcaacattattcatgcatagtccatgaaagcgcttgcggccggtccatgtataagatttatcatcagcccgggtgtctgtgtgtaatctagcctgcagcttcgatgcccaatataatgcttggttcatgcaacaaaaaaaaaatctcaccgccaccagcgccaccgccgcaccggttccggcgatcttgggcccccctcggaag

SEQ ID NO: 43627 - protein, 131 aa, Panicum virgatum; identical to SEQ ID NO: 27679
  misc_feature: Ceres CLONE 2017388
  misc_feature (35)..(131): Pfam Name: PsbR Pfam Description: Photosystem II 10 kDa polypeptide PsbR

SEQ ID NO: 43628 - DNA, 664 bp, Panicum virgatum
  misc_feature: Ceres CLONE 2017418
  misc_feature: Encodes the peptide sequence at SEQ ID NO. 43629
acaagtgtatccccgcggttgctgcgtctcgcacacggaggagagggagagggcggcggggcaggggtgggagcgaggaggtacgaggtagagatggaggtcggcttcctggggctgggcatcatgggcaaggcaatggcgaccaacctcctccgccacggctaccgcgtcaccgtctggaaccggaccaccgccaagtgccaagacctcgtcgcgctcggcgccaccgtcggggagacgcccgccgccatcgtcgccaggtgcagatacaccatcgccatgctctccgaccccagcgccgccctatccgttgtcttcgacaaggatggcgtgctcgagcagatcggggatggcaaaggctatatcgacatgtccactgtcgatgccgcaacttcttcaaagattagtgaggcagttaaactaaaaggcggcgctttcgttgaagctcctgtttcagggagcaagaaaccagctgaagatggtcaattggtcattcttgctgccggagacaagaaattgtatgatgaaaacgccgtatccatgccagtctcagcagctgcgaatgaggcattcaagaaggccagaagcctggggctgggggacctggatttctcggcggtctatgaggtagtgaagggcgcaggtggttctgggcaggcgtgat

SEQ ID NO: 43629 - protein, 189 aa, Panicum virgatum
  misc_feature: Ceres CLONE 2017418
  misc_feature (1)..(156): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MEVGFLGLGIMGKAMATNLLRHGYRVTVWNRTTAKCQDLVALGATVGETPAAIVARCRYTIAMLSDPSAALSVVFDKDGVLEQIGDGKGYIDMSTVDAATSSKISEAVKLKGGAFVEAPVSGSKKPAEDGQLVILAAGDKKLYDENAVSMPVSAAANEAFKKARSLGLGDLDFSAVYEVVKGAGGSGQA

SEQ ID NO: 43630 - DNA, 628 bp, Panicum virgatum
  misc_feature: Ceres CLONE 2017430
  misc_feature: Encodes the peptide sequence at SEQ ID NO. 43631
atccgaaatccgccggccacgatctcgcgaatcggccgccagagccgagagaagccgtggagctgtccctctccctcgcgcgcgccgcgcccctcgtcgtctccgggggcgccggggccccgaggatccccgccgccggcctcgccttctcgcccaggtccttcttcggcacgccgctggccgccaccgtcgcctccgtgacgccgccgctcccgcgcatgccggctacctcctcctccttcgaggacctcgcggcggggaacagggggtacaacaggaccaccctcttcgcgtcggtcaaccggttcatggtgaccgggaggggcaagatcgtgcgccggtgcgccgggaagcagcacctgctcggccagaataacacccctcgtcggaagaggctctccccgatggtccaggttaacaagagtgactactgatctgtgacaggcgcactgccctacctcaaagtgaatacgaaagtatactgagttcttcttggtcttcaagagccgttctgtttcattccacctacctgtaattttgtgtattttccgctgtattacctttcgaatatagatgctgtcattcctttcaagagagcttaaaacactcttcgtacctatcgagtgcg

SEQ ID NO: 43631 - protein, 143 aa, Panicum virgatum
  misc_feature: Ceres CLONE 2017430
  misc_feature (94)..(143): Pfam Name: Ribosomal_L35p Pfam Description: Ribosomal protein L35
PKSAGHDLANRPPEPREAVELSLSLARAAPLVVSGGAGAPRIPAAGLAFSPRSFFGTPLAATVASVTPPLPRMPATSSSFEDLAAGNRGYNRTTLFASVNRFMVTGRGKIVRRCAGKQHLLGQNNTPRRKRLSPMVQVNKSDY

SEQ ID NO: 43632 - DNA, 1284 bp, Panicum virgatum
  misc_feature: Ceres CLONE 2017431
  misc_feature: Encodes the peptide sequence at SEQ ID NO. 43633
gcgagttgcgagttcaacctcacgacacccaacactctcaacaccggctctttctaccgacatctcgaaaagatgcagctcgtcccctcacgctttgcgctgcacgcgctacgaagcctcacccgcccatactcagcaccagcaacaataacatcaagcagcacaacctcttccctgaaattcaaggccgccggctccttctaccgcaaacccagcatcctcttcccgaacctctcatccaaacgcacattcacaacatcacccaccctgtccacaactctgaaccaagtgcgatgccacggacggcgacccaagaaagcacgccggcaggattcccctgcgctgcgcaaccgccccgagatgaaaggcgtgtgtctgaaagtaggcatcacgaagcccaagaaacccaattccggccagcgcaagaccgcaaaggtcaggttgacttccggcaagatcgtcagcgcctacatccccggcgagggccataatgtccagcagcacagtgtcgtgctggtccgtggtgggagagctcaggattgtcctggtgtcggttatcatgttgttaggggacttttggatttggctggcgtccacaaccgtgccacgagccgttcgaagtatggcacaaagaaaccaaagaccacataaggtggtgggtgacttgttctttacacattcgcccaggtcggcttcggcgtggcaggagtcgatctcccgcgggaagaggatagagatataccaagcacgagatcaagaacaacatacacgcctccttttccaccaacaagaccagaatccaaaaagtatagatatcccagaacacgacaagccccttcatgccacggacagattgaggatccaagcaatcctatattcagcaaggacatcttcccatccttcgcatcgaagcctcttctagacttgatcacagtctaattgaagaggtacatacaggcagctggcggcacattgacaagaacacagcggtagcaaagcatcgccgctatatttgcacaacgtaacttggcatgaagacaaactcaatgagcccgccatcctcacatccacgactggccgtcactctatttcggacgtgttgcagaggctggcggcgttagcaatccatcgagggaagcgaggaagacggcctgtttgttaaaattactcgtaggggggcattgtgggtgatggtagatggtgagggttctccgtgtaaaacagttatctcactgcttgtccgtatgtgtatataatatatatgccccgaactgaacttcacgg

SEQ ID NO: 43633 - protein, 96 aa, Panicum virgatum
  misc_feature: Ceres CLONE 2017431
  misc_feature (2)..(94): Pfam Name: Ribosomal_S12 Pfam Description: Ribosomal protein S12
MKGVCLKVGITKPKKPNSGQRKTAKVRLTSGKIVSAYIPGEGHNVQQHSVVLVRGGRAQDCPGVGYHVVRGLLDLAGVHNRATSRSKYGTKKPKTT

SEQ ID NO: 43634 - DNA, 584 bp, Panicum virgatum
  misc_feature: Ceres CLONE 2017436
  misc_feature: Encodes the peptide sequence at SEQ ID NO. 43635
agtcgagcgagctcgaacctagcactcgggcgccccccccccccccccccatggcgtccctcttcaaggacccgagcaagctgtcggcgtacagggaccggcggttcccggggacgcaggaggagtacgaggcggcgctgcaggcgtcgacgacggtgtacatcgggaacatgtccttctacaccacggaggagcaggcctacgagctcttctcccgcgccggcgagatcaagaagatcatcatggggctcgacaagaactccaagaccccctgcggcttctgcttcgtactgtactactccagggaggatgctgaagatgctgtcaaatatattagcggaacaatgcttgatgatcgtccaatccgtgttgattttgattggggctttgaagaaggcaggcagtggggccgtggacggagtggcggtcaagtcagagatgagtaccggacagattatgatccaggaagaggtggttatggtaagatggttcagaaggagctagaagcacaaagagaattagttgactatggtggatcttttcaaccaaatgctccacctccatacgagagaggcgaacgcaag

SEQ ID NO: 43635 - protein, 177 aa, Panicum virgatum
  misc_feature: Ceres CLONE 2017436
  misc_feature (36)..(107): Pfam Name: RRM_1 Pfam Description: RNA recognition motif. (a.k.a. RRM, RBD, or RNP domain)
  misc_feature: Functional homolog of the protein sequence given in SEQ ID NO 51411
  misc_feature: Useful for making plants with modulated water use efficiency
MASLFKDPSKLSAYRDRRFPGTQEEYEAALQASTTVYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQKELEAQRELVDYGGSFQPNAPPPYERGER

SEQ ID NO: 43636 - DNA, 674 bp, Panicum virgatum
  misc_feature: Ceres CLONE 2017448
  misc_feature: Encodes the peptide sequence at SEQ ID NO. 43637
ggctgcgacgtgttcgagtccgtctccacgtacgcgcgccggcggcagcgcggcgtctgcgtgctgagcggcagtggcgtggtcaccaacgtgacgctgcggcagccgtcggcgccgacgggcgccgtcgtgacgctgcacgggaggttcgagatcctgtcgctctcgggctccttcctccctccgccggcaccccccggcgccaccagcctcaccatcttcctcgcggggggccaggggcaggtcgtcggcgggaacgtcgtcggcgcgctctacgccgcgggccccgtcatcgtcatcgccgcgtccttcgccaacgtcgcctacgagcgcctcccactggaggaggaggaggcccaggcagctccacccggcctccagatgcagccgcccggcggtgccgatggcgcaggaggcatgggcggtggcccgttccctcccgacccgtcggctgccggcctgcccttcttcaacctgccgctcaacaacatggccggtggcggatcacagctcccgcctggtgccgatggccatgggtgggctggtgcacggccaccaccgttctgatgacaagtactccatggggggtataattcaggtacggtgtgtgacaacaggagatggcaagaagaaagcagtgaacggcacaagggttgatgaaggcaagcttgcag

SEQ ID NO: 43637 - protein, 188 aa, Panicum virgatum
  misc_feature: Ceres CLONE 2017448
  misc_feature: The sequence is a functional homolog of SEQ ID NO 1406 in the 10/374,780 US patent application
  misc_feature: The sequence is a functional homolog of SEQ ID NO 26 in the 10/669,824 US patent application
  misc_feature: The sequence is a functional homolog of SEQ ID NO 26 in the 10/870,198 US patent application
  misc_feature: The sequence is a functional homolog of SEQ ID NO 352 in the 11/435,388 US patent application
  misc_feature: The sequence is a functional homolog of SEQ ID NO 354 in the 10/714,887 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1417 in the 10/374,780 US patent application
  misc_feature: The sequence is a functional homolog of SEQ ID NO 18 in the 10/669,824 US patent application
  misc_feature: The sequence is a functional homolog of SEQ ID NO 18 in the 10/870,198 US patent application
  misc_feature: The sequence is a functional homolog of SEQ ID NO 390 in the 11/435,388 US patent application
  misc_feature: The sequence is a functional homolog of SEQ ID NO 392 in the 10/714,887 US patent application
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 322 in the 11/435,388 US patent application
  misc_feature: The sequence is a functional homolog of SEQ ID NO 324 in the 10/714,887 US patent application
  misc_feature: The sequence is a functional homolog of SEQ ID NO 50 in the 10/669,824 US patent application
  misc_feature: The sequence is a functional homolog of SEQ ID NO 50 in the 10/870,198 US patent application
  misc_feature: The sequence is a functional homolog of SEQ ID NO 1408 in the 10/374,780 US patent application
  misc_feature: The sequence is a functional homolog of SEQ ID NO 28 in the 10/669,824 US patent application
  misc_feature: The sequence is a functional homolog of SEQ ID NO 28 in the 10/870,198 US patent application
  misc_feature: The sequence is a functional homolog of SEQ ID NO 350 in the 11/435,388 US patent application
  misc_feature: The sequence is a functional homolog of SEQ ID NO 352 in the 10/714,887 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 1412 in the 10/374,780 US patent application
  misc_feature: Functional homolog of the protein sequence given in SEQ ID NO 51109
  misc_feature: Useful for making plants with modulated biomass
  misc_feature: Useful for making plants with modulated flowering time
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 1414 in the 10/374,780 US patent application
  misc_feature: The sequence is a functional homolog of SEQ ID NO 2528 in the 10/374,780 US patent application
  misc_feature: The sequence is a functional homolog of SEQ ID NO 256 in the 10/225,066 US patent application
  misc_feature: The sequence is a functional homolog of SEQ ID NO 298 in the 11/435,388 US patent application
  misc_feature: The sequence is a functional homolog of SEQ ID NO 300 in the 10/714,887 US patent application
  misc_feature: The sequence is a functional homolog of SEQ ID NO 48 in the 10/669,824 US patent application
  misc_feature: The sequence is a functional homolog of SEQ ID NO 48 in the 10/870,198 US patent application
  misc_feature: The sequence is a functional homolog of SEQ ID NO 2038 in the 10/374,780 US patent application
  misc_feature: The sequence is a functional homolog of SEQ ID NO 2370 in the 10/374,780 US patent application
  misc_feature: The sequence is a functional homolog of SEQ ID NO 264 in the 10/714,887 US patent application
  misc_feature: The sequence is a functional homolog of SEQ ID NO 264 in the 11/435,388 US patent application
  misc_feature: The sequence is a functional homolog of SEQ ID NO 536 in the 10/225,066 US patent application
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 1403 in the 10/374,780 US patent application
  misc_feature: The sequence is a functional homolog of SEQ ID NO 1404 in the 10/374,780 US patent application
  misc_feature: The sequence is a functional homolog of SEQ ID NO 32 in the 10/669,824 US patent application
  misc_feature: The sequence is a functional homolog of SEQ ID NO 32 in the 10/870,198 US patent application
  misc_feature: The sequence is a functional homolog of SEQ ID NO 348 in the 11/435,388 US patent application
  misc_feature: The sequence is a functional homolog of SEQ ID NO 350 in the 10/714,887 US patent application
  misc_feature: The sequence is a functional homolog of SEQ ID NO 222 in the 10/374,780 US patent application
  misc_feature: The sequence is a functional homolog of SEQ ID NO 240 in the 10/714,887 US patent application
  misc_feature: The sequence is a functional homolog of SEQ ID NO 240 in the 11/435,388 US patent application
  misc_feature: The sequence is a functional homolog of SEQ ID NO 254 in the 10/225,066 US patent application
  misc_feature: The sequence is a functional homolog of SEQ ID NO 42 in the 10/669,824 US patent application
  misc_feature: The sequence is a functional homolog of SEQ ID NO 42 in the 10/870,198 US patent application
  misc_feature: The sequence is a functional homolog of SEQ ID NO 64 in the 10/225,068 US patent application
  misc_feature: The sequence is a functional homolog of SEQ ID NO 722 in the 10/412,699 US patent application
  misc_feature: The sequence is a functional homolog of SEQ ID NO 94 in the 11/375,241 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 1495 in the 11/479,226 US patent application
  misc_feature: The sequence is a functional homolog of SEQ ID NO 1838 in the 10/412,699 US patent application
  misc_feature: The sequence is a functional homolog of SEQ ID NO 2078 in the 10/374,780 US patent application
  misc_feature: The sequence is a functional homolog of SEQ ID NO 296 in the 11/435,388 US patent application
  misc_feature: The sequence is a functional homolog of SEQ ID NO 298 in the 10/714,887 US patent application
  misc_feature: The sequence is a functional homolog of SEQ ID NO 4 in the 10/669,824 US patent application
  misc_feature: The sequence is a functional homolog of SEQ ID NO 4 in the 10/870,198 US patent application
  misc_feature: The sequence is a functional homolog of SEQ ID NO 54 in the 10/225,066 US patent application
  misc_feature: The sequence is a functional homolog of SEQ ID NO 718 in the 10/412,699 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 1413 in the 10/374,780 US patent application
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 1401 in the 10/374,780 US patent application
  misc_feature: The sequence is a functional homolog of SEQ ID NO 30 in the 10/669,824 US patent application
  misc_feature: The sequence is a functional homolog of SEQ ID NO 30 in the 10/870,198 US patent application
  misc_feature: The sequence is a functional homolog of SEQ ID NO 342 in the 11/435,388 US patent application
  misc_feature: The sequence is a functional homolog of SEQ ID NO 344 in the 10/714,887 US patent application
  misc_feature: The sequence is a functional homolog of SEQ ID NO 1908 in the 10/412,699 US patent application
  misc_feature: The sequence is a functional homolog of SEQ ID NO 2166 in the 10/374,780 US patent application
  misc_feature: The sequence is a functional homolog of SEQ ID NO 318 in the 11/435,388 US patent application
  misc_feature: The sequence is a functional homolog of SEQ ID NO 320 in the 10/714,887 US patent application
  misc_feature: The sequence is a functional homolog of SEQ ID NO 8 in the 10/669,824 US patent application
  misc_feature: The sequence is a functional homolog of SEQ ID NO 8 in the 10/870,198 US patent application
  misc_feature: The sequence is a functional homolog of SEQ ID NO 94 in the 10/225,066 US patent application
  misc_feature: Functional homolog of the protein sequence given in SEQ ID NO 51110
  misc_feature: Useful for making plants with modulated light quality response
  misc_feature: The sequence is a functional homolog of SEQ ID NO 86 in the 10/669,824 US patent application
  misc_feature: The sequence is a functional homolog of SEQ ID NO 92 in the 10/669,824 US patent application
  misc_feature: The sequence is a functional homolog of SEQ ID NO 2154 in the 10/374,780 US patent application
  misc_feature: The sequence is a functional homolog of SEQ ID NO 314 in the 11/435,388 US patent application
  misc_feature: The sequence is a functional homolog of SEQ ID NO 316 in the 10/714,887 US patent application
  misc_feature: The sequence is a functional homolog of SEQ ID NO 318 in the 10/666,642 US patent application
  misc_feature: The sequence is a functional homolog of SEQ ID NO 44 in the 10/669,824 US patent application
  misc_feature: The sequence is a functional homolog of SEQ ID NO 44 in the 10/870,198 US patent application
  misc_feature: The sequence is a functional homolog of SEQ ID NO 88 in the 10/669,824 US patent application
  misc_feature: The sequence is a functional homolog of SEQ ID NO 90 in the 10/669,824 US patent application
  misc_feature: The sequence is a functional homolog of SEQ ID NO 87 in the 10/669,824 US patent application
  misc_feature: Functional homolog of the protein sequence given in SEQ ID NO 51111
  misc_feature: Useful for making plants with modulated low light sensitivity
  misc_feature: The sequence is a functional homolog of SEQ ID NO 89 in the 10/669,824 US patent application
GCDVFESVSTYARRRQRGVCVLSGSGVVTNVTLRQPSAPTGAVVTLHGRFEILSLSGSFLPPPAPPGATSLTIFLAGGQGQVVGGNVVGALYAAGPVIVIAASFANVAYERLPLEEEEAQAAPPGLQMQPPGGADGAGGMGGGPFPPDPSAAGLPFFNLPLNNMAGGGSQLPPGADGHGWAGARPPPF

SEQ ID NO: 43638 - DNA, 744 bp, Panicum virgatum
  misc_feature: Ceres CLONE 2017453
  misc_feature: Encodes the peptide sequence at SEQ ID NO. 43639
cctacaggtgggcatgcattttcaatatgtctagctctaatcagatgggttctgatggcaagtttgggagaggtcctcgggagcttagtggcgctgttgacttaattagccgctacaagttgctgaaccatcatagtttcttttgcaagaaacctttgccattggcaatttcagatacaaattatcttaacaatgttgtgggcgacacagaaatccgtaaaggggaagggatggagttggaccaactcttccaaaactcgtacccaaatgagaagactgcttacattcagccctttgacatggaaacactgggacaagcatttcagctgcgagaaactgcaccagtagatttgccttctgctgaaaaaggtacaccaaccatatctgggaaaccaaagatcaagtccaaggacaaagtaaagaagcataagaaacacaaggagaaagacagggataaggagaaggagcagaagaaacagaaacatcggcataaggatcggagtaaagataaagataaggacaaagacaaagaaaagaaaaaggacaagagtgggaatcatgagtcaggaggtgaccattccaagaaacatgagaagaagaggaagcaagaagcaactggaagttcggcaagtgtccaaaatcacaagaaaacacaaaagcacaaaaatcagtgaaatatgcgatggacttcattaattgccagccatgcatgtttcttttgtagttcaactccatttatgctgt

SEQ ID NO: 43639 - protein, 215 aa, Panicum virgatum
  misc_feature: Ceres CLONE 2017453
  misc_feature: Functional homolog of the protein sequence given in SEQ ID NO 51676
  misc_feature: Useful for making plants with altered oil content
MSSSNQMGSDGKFGRGPRELSGAVDLISRYKLLNHHSFFCKKPLPLAISDTNYLNNVVGDTEIRKGEGMELDQLFQNSYPNEKTAYIQPFDMETLGQAFQLRETAPVDLPSAEKGTPTISGKPKIKSKDKVKKHKKHKEKDRDKEKEQKKQKHRHKDRSKDKDKDKDKEKKKDKSGNHESGGDHSKKHEKKRKQEATGSSASVQNHKKTQKHKNQ

SEQ ID NO: 43640 - DNA, 695 bp, Panicum virgatum
  misc_feature: Ceres CLONE 2017459
  misc_feature: Encodes the peptide sequence at SEQ ID NO. 43641
aactgctctgcagaaaatatttgaattcaatgtcataaaggttaaaggagggcggatgggagctgttaatggtatgactccaaagggaaaggtggatgagacatgcatgcaatctcgtgaaatctggactggtgttacatatgctgttgctgcaaatatgctgctccatggcatggagcatcaaggttttaccaccgcggaaggaatttttattgctggatggtctgaagaaggatatggttattggttccagacaccagaaggatggaccacagatgggcattatcggtcgctcgtatacatgcgacctcttgccatttgggcgatccaatatgcactgtctcctccaaaggcaatccttgaggccccaaaagttaatttaatggaccggatacacatatccccccacatggctcgagcaattagcgagataagcattagaaaaatagcacccgacaatagatgtttccctagctctgcctttcagtgtgaatgctgatacaaaggtaacatgcaattgctgagcaacttgcaaccttttcgtcttttcggtttctccttgcccccgtttccaaggtccagtggaggttcgggagttctttccttgaatctgagggcatatccaaaccaccacaaaaactcagcggcgcgaaagagttgtataaatgtacagaaacctgttaatcttataatct

SEQ ID NO: 43641 - protein, 165 aa, Panicum virgatum
  misc_feature: Ceres CLONE 2017459
  misc_feature: SWISSPROT Homolog: EC 3.2.1.45 Glucosylceramidase
TALQKIFEFNVIKVKGGRMGAVNGMTPKGKVDETCMQSREIWTGVTYAVAANMLLHGMEHQGFTTAEGIFIAGWSEEGYGYWFQTPEGWTTDGHYRSLVYMRPLAIWAIQYALSPPKAILEAPKVNLMDRIHISPHMARAISEISIRKIAPDNRCFPSSAFQCEC

SEQ ID NO: 43642 - DNA, 652 bp, Panicum virgatum
  misc_feature: Ceres CLONE 2017473
  misc_feature: Encodes the peptide sequence at SEQ ID NO. 43643
gaggctgctgctggccgctcttgctcttgatctctacgttctcttcatcctcggcggcgttgggctgagacctctgacttcactcgagcctctcagaggggagagagagcacaagtcagacgcacacttctggtctgaagaaggagagatggggaggcagccgtgctgcgagaaggtcggtctgaagaaggggccatggacagcggaggaggaccagaagctggtcgccttcctcctctcccacggccattgctgctggaggctcgtccccaagctcgcagggctgctgaggtgcgggaagagctgccggctgaggtggactaactacctgcggccggacctcaagagaggcctcctctcggaggaggaggaagcgctggtcatcgacctccacgcgcagctcggcaatcgctggtccaagatcgcggcgcggctccccgggaggacggacaacgagatcaagaaccactggaacacccacatcaagaagaagctcaagaagatgggcatcgaccccgtcacccaccgcccgctctctccagtgcgaccaaaggaggtttttcccctggcgcagaagcggcacgatacaccgcacgtgcgacaaggacgctgcgacgacgagccccagcaggcgttgtcaccgggtgggccg

SEQ ID NO: 43643 - protein, 167 aa, Panicum virgatum
  misc_feature: Ceres CLONE 2017473
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: Functional homolog of the protein sequence given in SEQ ID NO 50234
  misc_feature: Useful for making plants with altered cell wall content and/or composition
  misc_feature: Functional homolog of the protein sequence given in SEQ ID NO 50233
  misc_feature: Useful for making plants with altered carbohydrate content
  misc_feature: The sequence is a functional homolog of SEQ ID NO 442 in the 10/412,699 US patent application
  misc_feature: Functional homolog of the protein sequence given in SEQ ID NO 50477
  misc_feature: Useful for making plants with altered alkaloid content
  misc_feature: Useful for making plants with modulated nitrogen use efficiency
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 836 in the 10/412,699 US patent application
  misc_feature: The sequence is a functional homolog of SEQ ID NO 824 in the 10/412,699 US patent application
  misc_feature: The sequence is a functional homolog of SEQ ID NO 296 in the 11/479,226 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Functional homolog of the protein sequence given in SEQ ID NO 50784
  misc_feature: Useful for making plants with altered lignin content
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1004 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1002 in the 11/435,388 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1073 in the 10/374,780 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1010 in the 11/435,388 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 58 in the 10/666,642 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: Functional homolog of the protein sequence given in SEQ ID NO 50235
  misc_feature: Useful for biocontainment applications
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 271 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 822 in the 10/412,699 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 794 in the 11/435,388 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 788 in the 11/435,388 US patent application
  misc_feature: The sequence is a functional homolog of SEQ ID NO 796 in the 11/435,388 US patent application
  misc_feature: The sequence is a functional homolog of SEQ ID NO 792 in the 11/435,388 US patent application
  misc_feature: The sequence is a functional homolog of SEQ ID NO 1917 in the 10/374,780 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 743 in the 10/666,642 US patent application
  misc_feature: The sequence is a functional homolog of SEQ ID NO 790 in the 11/435,388 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: Functional homolog of the protein sequence given in SEQ ID NO 51294
  misc_feature: Useful for making plants with modulated biomass
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 126 in the 10/412,699 US patent application
  misc_feature: The sequence is a functional homolog of SEQ ID NO 1572 in the 10/374,780 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
MGRQPCCEKVGLKKGPWTAEEDQKLVAFLLSHGHCCWRLVPKLAGLLRCGKSCRLRWTNYLRPDLKRGLLSEEEEALVIDLHAQLGNRWSKIAARLPGRTDNEIKNHWNTHIKKKLKKMGIDPVTHRPLSPVRPKEVFPLAQKRHDTPHVRQGRCDDEPQQALSPGG

SEQ ID NO: 43644 - DNA, 707 bp, Panicum virgatum
  misc_feature: Ceres CLONE 2017483
  misc_feature: Encodes the peptide sequence at SEQ ID NO. 43645
acccatcttttcttcgctcaccttccccgctcctgcccgtcttcccttcccgatctccagtcttctcccctcaaaatcagcgccagccccagccgcagctgcagtcgggatcagttcgccgcccctagctagataacctcgctcgcctgcctcgccgaggacgacggcgcgcggccgcggcgtcacgagactcggaaagccgcgcggcgcgaacatcttttttttctaggagaggtggttttgcgagaggaagaggatggcgcgcggcagctcctggcggctcgcggtggccggcgtcctcgtcgccgtctgcgcggcggccgccctcgcgccgcccgccgccgcgctcgacatcggcatccagtccgccggcgacggcgcgagcaagcagcaggcgtgcagccgcacgtgcgagtcggaccactgcacgacgccgccgttcctgcgctacggcaagtactgcggcatcctctacagcggctgccccggcgaggcaccgtgcgacgcgctggacgcctgctgcatgcaccacgacaactgcgtccaggcgaggaaggactacctgagcacggggtgcaacgaggcgctgctggactgcctggcgaggctgcgggagggcacgtccacgttcgagggcaacaagtgcatgatcgacgaggtcatcgacgtgatctcgctcgtcatcgaggccgccgtcgtcgccggca

SEQ ID NO: 43645 - protein, 150 aa, Panicum virgatum
  misc_feature: Ceres CLONE 2017483
  misc_feature: SWISSPROT Homolog: EC 3.1.1.4 Phospholipase A(2)
MARGSSWRLAVAGVLVAVCAAAALAPPAAALDIGIQSAGDGASKQQACSRTCESDHCTTPPFLRYGKYCGILYSGCPGEAPCDALDACCMHHDNCVQARKDYLSTGCNEALLDCLARLREGTSTFEGNKCMIDEVIDVISLVIEAAVVAG

SEQ ID NO: 43646 - DNA, 758 bp, Panicum virgatum
  misc_feature: Ceres CLONE 2017487
  misc_feature: Encodes the peptide sequence at SEQ ID NO. 43647
gggctttgcttgacacgatgaaggcactcaaggaccttggccttgatgtcaagaaaggaactgtgacaactgactctgatgtcacacaaacaaagttccacattatgcgattcgggcgcaaagttgaggaccctgacatgttagagaggatacggctaactgtcattaacaaccttctgaaataccatcctgaatcaagtgagaagttagcaatgggtgaattttttgggataaaacctcctgagaagaaggttgatattgatattgcaactcatgtggttgttgaagatgacggaccaaaaagaagcacgctttacatagagaccgctgatcggcctgggctacttctggaaataatcaagattatcgctgacacaaacattgatgtggaatcagctgagattgacactgaaggtttggttgccaaggacaagttccatgtgagttataggggcgcaaaactaaacagttccttatctcaggttctgatcaattgtctgcgctattacctccgaaggcctgagacagacgaagacagctattgatagctgtgctgtccagcatttcaagggcttcaaatcagaaactacgaactctcccttgagttccttttctgtgaggccttgcacatggaattttcctttgtagtgaacaaagtattgcttatctgtttctgaaatgcatccatgtatacttagaagattgcattgacacttggttgtcgaatgagcctgatatcttgtagtcggactgcttgg

SEQ ID NO: 43647 - protein, 180 aa, Panicum virgatum
  misc_feature: Ceres CLONE 2017487
  misc_feature: SWISSPROT Homolog: EC 2.7.7.59 [Protein-PII] uridylyltransferase
  misc_feature: Functional homolog of the protein sequence given in SEQ ID NO 50834
  misc_feature: Useful for making plants with altered alkaloid content
  misc_feature: Useful for making plants with altered lignin content
ALLDTMKALKDLGLDVKKGTVTTDSDVTQTKFHIMRFGRKVEDPDMLERIRLTVINNLLKYHPESSEKLAMGEFFGIKPPEKKVDIDIATHVVVEDDGPKRSTLYIETADRPGLLLEIIKIIADTNIDVESAEIDTEGLVAKDKFHVSYRGAKLNSSLSQVLINCLRYYLRRPETDEDSY

SEQ ID NO: 43648 - DNA, 720 bp, Panicum virgatum
  misc_feature: Ceres CLONE 2017495
  misc_feature: Encodes the peptide sequence at SEQ ID NO. 43649
atcttttcttcgctcaccttccccgctcctgcccgtcttcccttcccgatctccagtcttctcccctctaaatcagcgccagccccagccgcaactgcagccgggatcagttcgccgccccctagataatataaacctcgctcgcctcgccgaggacggcggcggccgcggcgtcacgagacccggcagctgcgcggcgggagatttcctttttctagaggtcgcgagaggatggcgcgcggcagctcctggcggcgcgcggtggccggcgtcctcgtcgccgtctgtgcggccgccctcgcgccgccagccgccgcgctcgacatcggcatccagtccgccggcgacggcgcgagcaagcagcaggcgtgcagccgcacgtgcgagtcggaccactgcacgacgccgccgttcctgcgctacggcaagtactgcggcatcctctacagcggctgccccggcgaggcgccgtgcgacgcgctcgacgcctgctgcatgcaccacgacaactgcgtccaggcgaggaaggactacctgagcacggggtgcaacgaggcgctgctggactgcctggcgaggctgcgggagggcgcgtccacgttcgagggcaacaagtgcatgattgaccaggtcatcgacgtgatctcgctcgtcatcgaggccgccgtcgtcgccggcagggtgctgcacaagccgtagcacgcggtgggcgccgaacac

SEQ ID NO: 43649 - protein, 155 aa, Panicum virgatum
  misc_feature: Ceres CLONE 2017495
  misc_feature: SWISSPROT Homolog: EC 3.1.1.4 Phospholipase A(2)
MARGSSWRRAVAGVLVAVCAAALAPPAAALDIGIQSAGDGASKQQACSRTCESDHCTTPPFLRYGKYCGILYSGCPGEAPCDALDACCMHHDNCVQARKDYLSTGCNEALLDCLARLREGASTFEGNKCMIDQVIDVISLVIEAAVVAGRVLHKP

SEQ ID NO: 43650 - DNA, 675 bp, Panicum virgatum
  misc_feature: Ceres CLONE 2017524
  misc_feature: Encodes the peptide sequence at SEQ ID NO. 43651
aggatcacaattcaacggcccggacaccttcttctcaccacctcaagagcggcagcggcagcggcagccacccggcggacccgaacgaagaagctcagcgccgccgctgttgccaaagactcctctttttctttgttccgtccatcaccaccacaccggcgccgccatggaaaagagcagtggcgccgccgctggaggcagcgccccgccttcgccgttccacatggaggatttccagctggaggggaagaagcccgtcaagaaccctttcgtccccatcggtttgtacgccgtgcattggttactgctggagttctgactgctggtctgatcagcttccgatatgggaactctcaactgggtcaaaaactgatgagggcgcgtgttgtagcccaaggggcaacagtcgctctaatgatcggcagcgcttactactatggtgatcaaatcaagctgttcaagaaaggatctagcccatgaacttcgctggagcggacgtttctccttttagtatatggaatgccatatgtacgctgaacttgcacctggatcctgctgtttgtccctcctaacattgggcttaaccctatcatttggcctgacatgtaatagctaaccagaaatgggtattggttcaatcggcaggcttgataataaataatttatttgttgatt

SEQ ID NO: 43651 - protein, 159 aa, Panicum virgatum
  misc_feature: Ceres CLONE 2017524
  misc_feature (84)..(144): Pfam Name: HIG_1_N Pfam Description: Hypoxia induced protein conserved region
RITIQRPGHLLLTTSRAAAAAAATRRTRTKKLSAAAVAKDSSFSLFRPSPPHRRRHGKEQWRRRWRQRPAFAVPHGGFPAGGEEARQEPFRPHRFVRRALVTAGVLTAGLISFRYGNSQLGQKLMRARVVAQGATVALMIGSAYYYGDQIKLFKKGSSP

SEQ ID NO: 43652 - DNA, 581 bp, Panicum virgatum
  misc_feature: Ceres CLONE 2017527
  misc_feature: Encodes the peptide sequence at SEQ ID NO. 43653
ctcctcccttgttcgcacggcaacccccaccagcaccaccaccacggcaccacctccctccggctccgaacccccccccccccaagccgcaactgcaggggggatcagttcgccgccacctagataatataaacctcggtcgcctcggcgaggacggcggcggccgcggtgtcacgtagacccggcagctgcgcggcgggagatttcctttttctagaggtcgcgagaggatggcgcggggcagctcctggcggagcgcggtggcgggagtcctcttcgccgtctgtgcggcagccctcgcgccgccagccgccgcgctcgacatcggcatccagtccgcgggcgacggcgcgagcaagcagcaggcgtgcagccggacgtgcgagtcggaccactgcacgacgccgccgttcctgcgctacggcaagtactgcggcatcctctacagcggctgccccggcgaggcgccgtgcgacgcgctcgacgcctgctgcatgcaccacgactactgcataaaggcgaggaaggactacctgagcacggggtgcaacgaggcgctgctggactggctggcgaggctg

SEQ ID NO: 43653 - protein, 116 aa, Panicum virgatum
  misc_feature: Ceres CLONE 2017527
  misc_feature: SWISSPROT Homolog: EC 3.1.1.4 Phospholipase A(2)
MARGSSWRSAVAGVLFAVCAAALAPPAAALDIGIQSAGDGASKQQACSRTCESDHCTTPPFLRYGKYCGILYSGCPGEAPCDALDACCMHHDYCIKARKDYLSTGCNEALLDWLAR

SEQ ID NO: 43654 - DNA, 640 bp, Panicum virgatum
  misc_feature: Ceres CLONE 2017528
  misc_feature: Encodes the peptide sequence at SEQ ID NO. 43655
agacaaaaaggaaaaacccctcgtcccgcccagcctagggttcttccttcccgccgccgcaccgctccgactcgcctccacgccacccagactgccagttctatttcaaatccatggcggaggaaaccaatggaaagaaggaggaggaggagttcagcacagggcctttgtcagtgctcatgatgagcgtcaagaacaatacccaggttcttatcaactgccggaacaacaagaagttacttggtcgtgtgagggcatttgataggcattgcaacatggttcttgagaatgttagggagatgtggactgaggtaccaaagactggtaaaggcaagaagaaggctcttccagtgaacaaagacaggtttataagcaagatgttcctccgtggtgattcagtcatcattgttctcaggaacccgaaatgagtgcacagtagaaggtctttgcaagtagtaaagtgctatgaattagtctgtatgccaacttgtagcatgggattgcaatagacgacgattcctgagccagaattagctgtgtatgtcaatggtggaggggggttgttggatgctatgaattggttttaccacttgtaactgaattaaatttgtagtttatgtttggaatacgggcaaactcc

SEQ ID NO: 43655 - protein, 104 aa, Panicum virgatum
  misc_feature: Ceres CLONE 2017528
  misc_feature (22)..(101): Pfam Name: LSM Pfam Description: LSM domain
MAEETNGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 43656 - DNA, 722 bp, Panicum virgatum
  misc_feature: Ceres CLONE 2017529
  misc_feature: Encodes the peptide sequence at SEQ ID NO. 43657
ccctccgcctttacagccgccggctcgcccccccccccctggcgccgccgtgacaagcctagctagcaaggcgcgagccatggcgacctcgggacggatcgaactggacaagctgagcgtggagcagctcaaggagcagacggatctggaggtcaacctcctccacgacagcctcaacaagatccgcacggccatcactcgcctcgagagcgcctccgcggcgctgcaggacctatccctccgcccccacgggaagaagatgcttgtgccgctcacggcgtccctctacgtgcccggctcgcttgacgacgccgagaaggtcctcgtcgacgtcggcactggttacttcatcgagaaaaccatggctcaagggaaagaatactgtgaaagaaaaattaatttgttgaagtcaaatttagatgaactggctgaggtggctacgaaaaagaaagccatagcagatcagatgggtctgctgctacatgccaagctgaggcaaggatcgcctggcccaagttcatgaaagctctggatgcatgtcttgtctccaccttgttggatgaatggatggtttagtttgtagcattagggaagcacagggaaacgatagttgcctttgtcatgtgtgcaaagctacgggtcacggataatttgctgaaccaacctgccacatcaaacatcatcgagttatttttgaagttggttctgaacaaacgttgagt

SEQ ID NO: 43657 - protein, 147 aa, Panicum virgatum
  misc_feature: Ceres CLONE 2017529
  misc_feature (21)..(140): Pfam Name: Prefoldin Pfam Description: Prefoldin subunit
  misc_feature: Functional homolog of the protein sequence given in SEQ ID NO 51580
  misc_feature: Useful for making plants with modulated heat sensitivity
MATSGRIELDKLSVEQLKEQTDLEVNLLHDSLNKIRTAITRLESASAALQDLSLRPHGKKMLVPLTASLYVPGSLDDAEKVLVDVGTGYFIEKTMAQGKEYCERKINLLKSNLDELAEVATKKKAIADQMGLLLHAKLRQGSPGPSS

SEQ ID NO: 43658 - DNA, 660 bp, Panicum virgatum
  misc_feature: Ceres CLONE 2017534
  misc_feature: Encodes the peptide sequence at SEQ ID NO. 43659
acccacccttcgcctgccaacccatttctcccgagccccgacgcgcgctgcctgcaccctcgccgccgccgccgccgccgccgcctctccagctcggaccccatggcttccctcgccggatccgccctctccctcgcgatgcccgtcaaggcaatcaacattaagtccgtctctttctctggtttaaggaaagataatgtaacattctgtcttcagccagtgccacaaagatttgcagtctgctgtcccgctaaaaaggagacagtggaccaggtttgtgatattgtcaagaagcagcttgcacttgctgatggcactgaagtttgtggctcctccaagttccaagatcttggtgctgattcattggacactgttgagattgttatgggcctcgaggaggcttttgggatcagtgtggaggagtcgagcgcacagtcaattgcaaccgtggaagatgctgctaatctcatcgatgaccttgttgctgcaaaatcgtcctaaacttgcagctgtagtacttatcctggccctgaactaaggcatctcttgtcccatgctccttccctgctagattttaccctggagagccatttctttgtcattactatcattgtggatcttgcaatattattacattaaagcgtttgtgttcaaggaaag

SEQ ID NO: 43659 - protein, 132 aa, Panicum virgatum; identical to SEQ ID NO: 35130
  misc_feature: Ceres CLONE 2017534
  misc_feature (56)..(123): Pfam Name: PP-binding Pfam Description: Phosphopantetheine attachment site

SEQ ID NO: 43660 - DNA, 1005 bp, Panicum virgatum
  misc_feature: Ceres CLONE 2017549
  misc_feature: Encodes the peptide sequence at SEQ ID NO. 43661
ctctcctcctctgtccgcgcctccgcggccacctcctctcactctctctcctctcttctcccttctctcccctcctcgcctccccgcgcgcgcgtttttataagggtttcggcggaggcgcacggtccccggcgatggcggacgacggcgggagccacgagggcggcggcggcgtccgggagcaggaccggttcctgcccatcgccaacatcagccgcatcatgaagaaggccgtcccggctaacggcaagatcgccaaggatgccaaggagaccctgcaggagtgcgtctccgagttcatctccttcgtcaccagcgaggccagcgacaagtgccagaaggagaagcgcaagaccatcaacggcgatgatctgctctgggcgatggctacgctcggattcgaggagtacgtcgagcccctcaagatgtacctacacaagtacagagagatggagggtgatagtaagttgtctacaaaggctggtgagggctctgtaaagaaggatgcaattagtccccatggtggcaccagtagctcaagtaaccagttggttcaacatggagtttacaaccaagggatgggctatatgcaaccacagtaccataatggggatacctaaagggcaaaaactgaagacagcagcaatttatgtggttatccatcagctagggaagttgccgcattgcttctatgtttattggcagaaaattgaaggcacgtaaaaagggtgttcaacttttgctatggctgcctctcagatgtaaattggcttccttgagaatagttcgcctataatggtttagcgcttgcttttgtctgtatattcagaatgatttgaccgttgctattttggcagccttttacattcacagatctgtattgtggagcataaatataatgtagtagtcctaggagcaaataatggtgattaaatacaggtctgctgtcacctatcagcctatgctcattttctggaaccttattcctgctaggttgtccctccg

SEQ ID NO: 43661 - protein, 161 aa, Panicum virgatum
  misc_feature: Ceres CLONE 2017549
  misc_feature (19)..(84): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 36 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 791 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 42 in the 10/675,852 US patent application
  misc_feature: The sequence is a functional homolog of SEQ ID NO 60 in the 10/675,852 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 64 in the 10/675,852 US patent application
  misc_feature: Functional homolog of the protein sequence given in SEQ ID NO 50465
  misc_feature: Useful for making plants with modulated biomass
  misc_feature: The sequence is a functional homolog of SEQ ID NO 12 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 14 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: Functional homolog of the protein sequence given in SEQ ID NO 50466
  misc_feature: Useful for making plants with modulated drought sensitivity
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 38 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 44 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 803 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 66 in the 10/675,852 US patent application
  misc_feature: The sequence is a functional homolog of SEQ ID NO 62 in the 10/675,852 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 793 in the 10/374,780 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 795 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 22 in US patent 7166765
MADDGGSHEGGGGVREQDRFLPIANISRIMKKAVPANGKIAKDAKETLQECVSEFISFVTSEASDKCQKEKRKTINGDDLLWAMATLGFEEYVEPLKMYLHKYREMEGDSKLSTKAGEGSVKKDAISPHGGTSSSSNQLVQHGVYNQGMGYMQPQYHNGDT

SEQ ID NO: 43662 - DNA, 703 bp, Panicum virgatum
  misc_feature: Ceres CLONE 2017568
  misc_feature: Encodes the peptide sequence at SEQ ID NO. 43663
acgtacgcttgtggtatctcaattcgcattagtgtaaccaaaggcgacagagctagacgacatggcggccggcggcgctttccccgtggtggatctggcgcctttcttcgccgaaggcgacagcagcggccgcgcccgcgccaccgaggccgtgctcgaggcgtgccggacgcacggctgcttccgcgtcgtcaaccacggcgtgccggccgagctcatggcgcgcgcgctcaagttatcagctgcgtttttcgcgctgccggacgacgagaaggccagggcccggcaggccgaggggaccgtggcgcccgtcccggcaggctacactcggcagccggcgcactcggccgacaaacgcgagtacgtgctggtgtttgatccgaagctcgggttcaacgagtaccccactgagccagccggattcagagaagcagtggaggagtgttacgccaagttcaccgagctggggctgctcctccaggaggtcctgaacgagtgcatgggcctgccgccgggcttcctcagggactacaacggcgaccgcgacttcgacttcatggtggcgcatcactacttcccgtcgacggaggaggagaactacggcctcagagctcacgaggacggcaactgcatcaccttcatcatccaggacggagtcgggggactcgaggtcctccaggacggcgactggatcccggcggag

SEQ ID NO: 43663 - protein, 213 aa, Panicum virgatum
  misc_feature: Ceres CLONE 2017568
  misc_feature: SWISSPROT Homolog: EC 1.14.11.9 Flavanone 3-dioxygenase
MAAGGAFPVVDLAPFFAEGDSSGRARATEAVLEACRTHGCFRVVNHGVPAELMARALKLSAAFFALPDDEKARARQAEGTVAPVPAGYTRQPAHSADKREYVLVFDPKLGFNEYPTEPAGFREAVEECYAKFTELGLLLQEVLNECMGLPPGFLRDYNGDRDFDFMVAHHYFPSTEEENYGLRAHEDGNCITFIIQDGVGGLEVLQDGDWIPA

SEQ ID NO: 43664 - DNA, 493 bp, Panicum virgatum
  misc_feature: Ceres CLONE 2017570
  misc_feature: Encodes the peptide sequence at SEQ ID NO. 43665
gatcatcacatcctttatgtggcccagcacagcgagaccccatctcccatttttgcaggaaggaagagctgctagctccttgggtgtgggagataagaagagggtcgagatggctgcggcttacgctcccatggcgagccatgtgatgaagagcgacttgattcactccaagccgagaggcctctctggcgctgcgctgacgacgcggccccgcttcaccgcgaaggccatccacccacacaagccaacgtaccacgtggagctccccatccaccgcgaccccttcatcggcagccaggagacgcccgtcacctccagcccgctggtcatctggtacatctccaacctcccggactaccgcaccgacgtgagcgctctgctccttggcgacgacgtcggtctctctcagggctaccacctctacggtcccttccccctcaccggccctctccgcaacacgccggtgcacggccaggtcggcgccctgggcgcc

SEQ ID NO: 43665 - protein, 127 aa, Panicum virgatum
  misc_feature: Ceres CLONE 2017570
  misc_feature (48)..(127): Pfam Name: PsaL Pfam Description: Photosystem I reaction centre subunit XI
MAAAYAPMASHVMKSDLIHSKPRGLSGAALTTRPRFTAKAIHPHKPTYHVELPIHRDPFIGSQETPVTSSPLVIWYISNLPDYRTDVSALLLGDDVGLSQGYHLYGPFPLTGPLRNTPVHGQVGALG

SEQ ID NO: 43666 - DNA, 718 bp, Panicum virgatum
  misc_feature: Ceres CLONE 2017571
  misc_feature: Encodes the peptide sequence at SEQ ID NO. 43667
aacatggctgaggaggaggccaagaaggtggaggtggaggtcgccaaggagcccgaggcggcgccggcgccggccgcggaaccggccaaggaggacgtcgccgaggagaaggccgtcatccccgccaccgagccgccggccgccgactccaaggccctggctatcgtcgagaaggttgcagatgaacctgctacagagaagcctgccgctgagaagcaagggagctccaatgacagagatctcgctcttgcaagggtagaaactgagaagaggaactctttgatcaaagcatgggaagagaatgagaagacaaaagctgagaacaaagctgctaaaaaaatatctgctactctttcatgggagaactcaaagaaagcgatcatagaagctgaactgaagaagattgaggagcaactggaaaagaagaaggctgaatacgccgagaagatgaagaacaagatcgcaatcatccacaaggaagccgaagagaagcgggcaatggtcgaagcaaaacgcggcgaggaggtcctgaaggctgaggagatggctgccaagtaccgcgccaccggccacgctcccaagaagctcattggatgctttggagactaagaaacgtcccgagtaagaccaagcagaaagtgaataacgtcaatccgtgattgcttggttctctcgctctatcaagtgtgtagtttgtcttcaaaagtgtgtaaagcct

SEQ ID NO: 43667 - protein, 201 aa, Panicum virgatum
  misc_feature: Ceres CLONE 2017571
  misc_feature (87)..(196): Pfam Name: Remorin_C Pfam Description: Remorin, C-terminal region
  misc_feature (30)..(85): Pfam Name: Remorin_N Pfam Description: Remorin, N-terminal region
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature: The sequence is a functional homolog of SEQ ID NO 496 in the 11/435,388 US patent application
  misc_feature: The sequence is a functional homolog of SEQ ID NO 438 in the 10/666,642 US patent application
MAEEEAKKVEVEVAKEPEAAPAPAAEPAKEDVAEEKAVIPATEPPAADSKALAIVEKVADEPATEKPAAEKQGSSNDRDLALARVETEKRNSLIKAWEENEKTKAENKAAKKISATLSWENSKKAIIEAELKKIEEQLEKKKAEYAEKMKNKIAIIHKEAEEKRAMVEAKRGEEVLKAEEMAAKYRATGHAPKKLIGCFGD

SEQ ID NO: 43668 - DNA, 1355 bp, Panicum virgatum
  misc_feature: Ceres CLONE 2017578
  misc_feature: Encodes the peptide sequence at SEQ ID NO. 43669
aactaggcaccaaaccatcacgtcagtcccaccctccccccacgcctctcgaagtctcgatcctcctccccgtccaccacgtaccagggccacacctagctaccgcccgcgcgcgtcgtctccggccatggccgagaagccgcctctgccgcccaagcccaagccgcccctgccgcccaggccgaggccgccgcccaaggcgccagccgcggcagcgcggtccgcgccggcccccgccaatggcgccgccaggcccgggccgcctttcaagaagccagctctcgccccgccgccgccgacgcaggtgcccccgctcaagcccccgccggcgcgccagtacctccaccaccagcacccgccgccccccggcggcgcgcggaaggcgccggcgcggtaccgccagcagcagcggcgccgcggcggcggcgggtgctcgtgccgccgcgcgtgctgcctcgccgcggggttcgccctcctcgcgctctgcctggycctcgccgcggcgtgcctcgcgtacctctactaccgcccgcggccgccgtcgttccacctgcagccgctggcccccgtgcggctccgcctcggcggcaacgcctcggcggcgcccgcgctggacgccaccgtgggcgcccgcgccgtgtcgtggaaccccaacgagcgcgtgtccttccggtacggcgccggcgagggccgcgtcgcgctggccgacgccgacggggatgtcgcgctcgggtgggcgcccgtcgccgggttcgagcacgcgccgcggagcgtcgccgccgtggcgttcgtggcggccgccaggggcgtggtcgtcgacgaggccgtcgcggcgcgcgtgcgcgaccggtaccggaggcggcggcaggcgttcagggtggaggtggacacccacgtcggcgtccgcgtcggggcgctccgcaccggcatggtgccgatcaggctggtctgcggcggcggcgtgatggcgccgcgcggcgccgggaccgcggcggggcccctgagcagatgccaggtgtatctgttcagagtaagatggtttagcttgaactgaaggcgcatccggggcatcagggctgctattacctgcttagagaccacatcgaggcatcaagcagctaccaaaggcgccgaagctgcagacgccgtaaattatccgcgtgtttcgccgacaagattggtttgctcccaacttgattggtcctgaatacatatttggatggcctgaaacatttagtaagagctaaagaaaccgagtttgtaactgtatattacactcccagctcccgattcttttgattgtgtggtgcatacatagcaggaatgaaaatggacgatgggtgtgtgttcttctc

SEQ ID NO: 43669 - protein, 308 aa, Panicum virgatum
  misc_feature: Ceres CLONE 2017578
  misc_feature (130)..(275): Pfam Name: Hin1 Pfam Description: Harpin-induced protein 1 (Hin1)
  misc_feature (122)..(122): Xaa is any aa, unknown, or other
MAEKPPLPPKPKPPLPPRPRPPPKAPAAAARSAPAPANGAARPGPPFKKPALAPPPPTQVPPLKPPPARQYLHHQHPPPPGGARKAPARYRQQQRRRGGGGCSCRRACCLAAGFALLALCLXLAAACLAYLYYRPRPPSFHLQPLAPVRLRLGGNASAAPALDATVGARAVSWNPNERVSFRYGAGEGRVALADADGDVALGWAPVAGFEHAPRSVAAVAFVAAARGVVVDEAVAARVRDRYRRRRQAFRVEVDTHVGVRVGALRTGMVPIRLVCGGGVMAPRGAGTAAGPLSRCQVYLFRVRWFSLN

SEQ ID NO: 43670 - DNA, 636 bp, Panicum virgatum
  misc_feature: Ceres CLONE 2017620
  misc_feature: Encodes the peptide sequence at SEQ ID NO. 43671
attcccatcccttgctacctgcatccatcgaccttagcgagctcacagttcaatcaggtccggttcggcttcaggccgggctcgtcaccgaggagatggctctctctcgccgcatggccgtgccggtcctcgtcttcctgctcctcctcacagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcctctcgtctcttgttctctttacctggaataaattaaactcggtgctggtgtctggtgatgcctgtgcgtgtggaacatctcactgttgttctgcacccgtatgcactccattattagtgtagtaggcaagatgatgtaaggtcctcctttcaacattgatgtaataatgtgatgcagtttcgtgctagttcagctc

SEQ ID NO: 43671 - protein, 78 aa, Panicum virgatum
  misc_feature: Ceres CLONE 2017620
  misc_feature (30)..(78): Pfam Name: Gamma-thionin Pfam Description: Gamma-thionin family
MALSRRMAVPVLVFLLLLTEMGPATVAEARHCLSQSHHFKGLCVSSSNCANVCRTENFPGGECKTEGATRKCFCKRIC

SEQ ID NO: 43672 - DNA, 671 bp, Panicum virgatum
  misc_feature: Ceres CLONE 2017634
  misc_feature: Encodes the peptide sequence at SEQ ID NO. 43673
gttgctgaaatgactggtgctgttgattttgagaaaacacttgagtactggcagcaggacaagtggaatggttccttctctgtcaagtggcacattgtcaaggatgtgcccaacaatattctcaagcacatcatcctagagaacaatgaaaacaagcctgtcacgaatagccgtgacacacaagagatacatcttgaacaaggccttcagatgctcaagatattcaaggagcatgtcagcaagacttccattctggatgactttgccttctatgagagccgccagaagttgatgcaggataagagggtgaaacaacagcagatccaaaagcaggtctgggacagcagggctcccatttctgtcacaaccggtgagcaacagcaggaagttgctaatgggaaaccaaaaccatctgtaccaaatggcgtcaatggagaggtgaaggctcccatggagaatggtgctgctccggctgtttcctatgccgcaaaggtggcccaaacagcaacggagaagcccgctctcgctaatggagttaccaagactggctagcttgatttcataaccggtgttccatagctagccgtaaagatggtagaagaactcaaccgaagtgtgaggtcccagggaactggtgatctagaagggctacctgtggaactggacgcatg

SEQ ID NO: 43673 - protein, 183 aa, Panicum virgatum
  misc_feature: Ceres CLONE 2017634
  misc_feature (1)..(78): Pfam Name: YTH Pfam Description: YT521-B-like family
VAEMTGAVDFEKTLEYWQQDKWNGSFSVKWHIVKDVPNNILKHIILENNENKPVTNSRDTQEIHLEQGLQMLKIFKEHVSKTSILDDFAFYESRQKLMQDKRVKQQQIQKQVWDSRAPISVTTGEQQQEVANGKPKPSVPNGVNGEVKAPMENGAAPAVSYAAKVAQTATEKPALANGVTKTG

SEQ ID NO: 43674 - DNA, 908 bp, Panicum virgatum
  misc_feature: Ceres CLONE 2017645
  misc_feature: Encodes the peptide sequence at SEQ ID NO. 43675
aaccactttgccatccacaacatcactttctgagcagccgaagcctaaaaggacccggtttccctctttaaactttctcaaatcaccacaactcaacaatcaacacatccgattagcgagacactactacagtcgtcggtcgctcacttccaccttccattacaacaaaccttctcccaagttcaccccaaaaactccgagtttatgtcaggcgaaaccgagatccagaatctcaagagccgcgaccccttcgcggaagccgacgaagactcgggacagacgacccaaacccaagaatatatccatattcgcattcagcagcgtaatggacgtaagaccttgaccaccgttcaaggtatcccttccaagttcgaccacaagaagattctcaaggtcatcaagaaggagttcgcctgcaatggaaccatcatcagcagcaccgagtccaagggcatgggagaggtgatccaactccagggcgaccatcgcctcaagatcaaagacttcctcgttaacaacgaggagggtctgggtctcgacgagaagaccatcaagatccacggcttctaagacgggcatgtctgtgttgccgctgctcagcggcccgagccccaaagtgggacgtccggggcggggcttcactcatagaagtgaaacttatatcgatatctgagcgatgagagggccaattatcagggtcgcgcggcacacaacatgatacccggaagctggaagatgggcttcctcttccctaaccggagagcacgtcgagtgggagggttttttggtgcttcgggccatttgcttatgatcgatccttcggctctagttgacgggacggccgtggcctgcatgtccatcgttgaacctctgcgggcctcgtattttaggcaatggaattcgttgac

SEQ ID NO: 43675 - protein, 121 aa, Panicum virgatum
  misc_feature: Ceres CLONE 2017645
  misc_feature (27)..(113): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time
MSGETEIQNLKSRDPFAEADEDSGQTTQTQEYIHIRIQQRNGRKTLTTVQGIPSKFDHKKILKVIKKEFACNGTIISSTESKGMGEVIQLQGDHRLKIKDFLVNNEEGLGLDEKTIKIHGF

SEQ ID NO: 43676 - DNA, 676 bp, Panicum virgatum
  misc_feature: Ceres CLONE 2017647
  misc_feature: Encodes the peptide sequence at SEQ ID NO. 43677
gtactatcttcaacacagccatagaaaggtgggatgaacaaaccacagaggagttcccagcacatctgaagccactcctcatcggcatacttgacactacaaataagattgaggaggagttaaaacttcagaaaaacaggcatgctgaagttgtcaaaaaactagtgatctgcactgccaaattctaccatgctgaggtgaattggcgcgatgaacactatgtaccagctactgttgatgagcacctcgaaaaatccttgcgtagtagtgtctgtatgcaaataataattggtgtgctcatttcactaagagattgtcgggaggatgatgttaattgggcattcacctttcccaaacttatcagaggtgtttctgttgtggggcgcgttggaaatgacatcgtgtcagatgagcgggaacaagcttcggagcatgtggtatccacggtgcaaacttgcatgaagcaatatgggataacagcagagcaagccaacgaaaagcttagagtcataatcgaagaagcatggatggacatcgtccaggaatacctcgaccaaaagcgacctagggagtttcttgagaagtcggtcgatgttgcacgaacaatggatttcttttacaagcgtgatgatgcgtacaccttgccgctcagcatcaaggacactataactttgat

SEQ ID NO: 43677 - protein, 224 aa, Panicum virgatum
  misc_feature: Ceres CLONE 2017647
  misc_feature: SWISSPROT Homolog: EC 4.2.3.13 (+)-delta-cadinene synthase
TIFNTAIERWDEQTTEEFPAHLKPLLIGILDTTNKIEEELKLQKNRHAEVVKKLVICTAKFYHAEVNWRDEHYVPATVDEHLEKSLRSSVCMQIIIGVLISLRDCREDDVNWAFTFPKLIRGVSVVGRVGNDIVSDEREQASEHVVSTVQTCMKQYGITAEQANEKLRVIIEEAWMDIVQEYLDQKRPREFLEKSVDVARTMDFFYKRDDAYTLPLSIKDTITL

SEQ ID NO: 43678 - DNA, 1016 bp, Panicum virgatum
  misc_feature: Ceres CLONE 2017656
  misc_feature: Encodes the peptide sequence at SEQ ID NO. 43679
tcggtttaggtgcagttgtattttaaactctttttctttctaataaaaattcggcaaaactcttgccatcctttcgagagaaaaaaaaaatttgagaaccgaagagacgcacgcctctgtcctccgcagccgccgaagagaagaacccaagaaaccaaaaggcacggcgctccggccggcggcggcgagccggagccagcaatggcagcgaccttggcccgcgccgccctccgagcccttaccaggccgcgacacgccggcgctgcaggggttcctcttcagttggacgccacggcgatcgccaagcagaagacgcccggctccctaattggcctcaggtgcaccggcaccggcgctggcggggcgttgcaagcggatgaggaggcggtggtgccgcggtcagcgccggtgcacatcgcatacgagcttcacaaggccggccaccgctacctcgacgtcagaaccgagtccgagttccgtgcggggcatcctgaaagagctgtaaatatcccctacatgttcaggaccgactcaggaacgacaaagaacacacactttcttgagcaagtgtcaaggatatttgggaaggatgatgagatcatcgttggctgtcaaagtggcaggagatctctcatggcagcaactgagctccactctgctggtttcactgatgtaacagatatcgccggtggattctcttcatggaaagagaaaggactgcctatcaaccagtgatgttagctcgcaaacattgcctaggatctgttaaggctgctctgctcgaggattgctcagcagtcttctcgtctttttgaattaacagtgcagaataaaatggagcctgtaaaacagaacagtagcattggcgtggtgctgctggcgtggcgttcttactggtagtatgtagttttttctgttggcatgtggtcgtggtgcggagtcggtttaggtgcagttgtattttaaactctttttctttctaataaaaattcggcaaaactcttgccatcctttcg

SEQ ID NO: 43679 - protein, 177 aa, Panicum virgatum
  misc_feature: Ceres CLONE 2017656
  misc_feature (68)..(171): Pfam Name: Rhodanese Pfam Description: Rhodanese-like domain
  misc_feature: SWISSPROT Homolog: EC 2.8.1.1 Thiosulfate sulfurtransferase
MAATLARAALRALTRPRHAGAAGVPLQLDATAIAKQKTPGSLIGLRCTGTGAGGALQADEEAVVPRSAPVHIAYELHKAGHRYLDVRTESEFRAGHPERAVNIPYMFRTDSGTTKNTHFLEQVSRIFGKDDEIIVGCQSGRRSLMAATELHSAGFTDVTDIAGGFSSWKEKGLPINQ

SEQ ID NO: 43680 - DNA, 1037 bp, Panicum virgatum
  misc_feature: Ceres CLONE 2017657
  misc_feature: Encodes the peptide sequence at SEQ ID NO. 43681
accgcaaagcaaggcacagattggtttcaatccaaggtgcaaaaaaagcacttcaaatatggctaggtcccacgcagctcttctgctcctcttggtcggcgccatagcggcgtcaggttatcagtatcaacgggactcggtgggctcgacgttcttcctccagcacgatctgtaccccgggtccaagatgacgctccatttcagccccaccgcgccgggggtgcccgcgctcacgcgcgcccgcgccgacgccatccccttcgcctccgccaagatccgggagatcctcgccctcttctccatcccggcgggctcccccgcagccgacgcggtgcgcttcaccctggccgagtgcgaggccccaccagtgccgggcgtggcggcgcagcggtgcgccacctccccggaggccatggtcgacttcgcggcctcctggctcggcacccgggccatccacgcgggcaccaccaggctcggcagcagcagggacggaggggcggcggcgccgccgaggcaggcgtacgtgctggagtccgtccggccgctgccggtggtcggccgggacatggtggcctgccactccctgccctacccgtacgcggtgttcgggtgccacaccaccaccgccgccgtgttcagggtggcgcttgccggggccgacgggagcagggctgaggctctggcggcgtgccacaaggacgcgacgccgggcatcccctggccgacgtacaagaagctcggcgtgacgccggggagcgtggcggtgtgccacttcctgccccaggacggcaagctctggatgcgcaactaactagctagagcttcaaacacgcgcgtgcgtgcatgcgcgaacaactagatacgactgcgtgcggaggaaaataaagtgcgtgggcgtggctggccacgtacttgatggactggacgtatgttttattataggctatcctccatcagtgatatatgtatactgcagtctgtcttgtgtgcttaattaatacaagtgtgtacgggtgtaatgcgtatacgtttgtagt

SEQ ID NO: 43681 - protein, 250 aa, Panicum virgatum
  misc_feature: Ceres CLONE 2017657
  misc_feature (30)..(250): Pfam Name: BURP Pfam Description: BURP domain
MARSHAALLLLLVGAIAASGYQYQRDSVGSTFFLQHDLYPGSKMTLHFSPTAPGVPALTRARADAIPFASAKIREILALFSIPAGSPAADAVRFTLAECEAPPVPGVAAQRCATSPEAMVDFAASWLGTRAIHAGTTRLGSSRDGGAAAPPRQAYVLESVRPLPVVGRDMVACHSLPYPYAVFGCHTTTAAVFRVALAGADGSRAEALAACHKDATPGIPWPTYKKLGVTPGSVAVCHFLPQDGKLWMRN

SEQ ID NO: 43682 - DNA, 1299 bp, Panicum virgatum
  misc_feature: Ceres CLONE 2017660
  misc_feature: Encodes the peptide sequence at SEQ ID NO. 43683
aactaacgctaaaaaagtaacagtttctgtactttattgccgtgtcgatgtctgtgtcgcccgtgccggaggaggcggagtacgtcgaggagacggtgccgatggatccgctgatcgagctactccacctgcgcttcgcgtacaactccgactatagctcgcccgccgagcgaaacgacgccaaggggcggatcgtcgccatcgtgcgcaagcacagcatggccccgtactacgagctcatcaaggagctcgtcggcagcccgctgcccgcatcggaggtcaacgagatgatcaaggccaacgagtcgaaactcgagtcgctcaaccgcaacctcgaagacgcggaggccaatgctggcgacagcgaaatccgcgaggcactcgtggcgaaggtcgacttcttcgcgagcatcggcgaccgtgacaagtgcctcgagctcagccgggcgtgcacagagaagacgatcgcgacagggccgaagctcgacctgatcttccagcgtatccgcctcggcctcgccttcagcgatcacgagctcgctgcgaagtcgctgcaggaggcgcgcgacatgatgaagcacggcgactgggagcgccgcaaccgcctcaaggtctacgagggcctctactgcgtgttcgtccgcgacttcgtgaagggctcgaagctcctgctcgacgccctcacgacgttcgcggcgaccgagctgctgacgttcgaccagttcatcttcgtcacggtcgtcgcggccctcatcacgctgacccgcgccgagctgaagaagagtgtcgtcgactcgcccgaggtgctcagctcgcacctcccgaaggtgatcgcgctcgtcagcaatatttacaactgccactacggcagcctcttcgacgatctcgccgaggtgtgccacgacatgcgccgcaacgtgttcctcgttgcgcacgtgaacttcttcttccgtgaggtgcgcgtgctggccttccaccagttcctcgactcgtacagctccgtgacgctcgcgagcatggcgcagacgttccacatccccgtcaacgtcctcgaccagatgctctacacgctgatcagcaacgggcgcctctcgtgccgcatcgaccgcgtcagcggggatgtcgtcacgtaccgcggcaaccgcgtcaacttccagtaccaccaaatcatcaaggacggcgacgtgctgctgaacaaaatccagaagttgtcacgagtggtggagatgtgagctcgctcggccaggcggagcgcctaggcatgcccaagtcgttgttccgttgcgtcacgccagagcg

SEQ ID NO: 43683 - protein, 394 aa, Panicum virgatum
  misc_feature: Ceres CLONE 2017660
  misc_feature (259)..(363): Pfam Name: PCI Pfam Description: PCI domain
MSVSPVPEEAEYVEETVPMDPLIELLHLRFAYNSDYSSPAERNDAKGRIVAIVRKHSMAPYYELIKELVGSPLPASEVNEMIKANESKLESLNRNLEDAEANAGDSEIREALVAKVDFFASIGDRDKCLELSRACTEKTIATGPKLDLIFQRIRLGLAFSDHELAAKSLQEARDMMKHGDWERRNRLKVYEGLYCVFVRDFVKGSKLLLDALTTFAATELLTFDQFIFVTVVAALITLTRAELKKSVVDSPEVLSSHLPKVIALVSNIYNCHYGSLFDDLAEVCHDMRRNVFLVAHVNFFFREVRVLAFHQFLDSYSSVTLASMAQTFHIPVNVLDQMLYTLISNGRLSCRIDRVSGDVVTYRGNRVNFQYHQIIKDGDVLLNKIQKLSRVVEM

SEQ ID NO: 43684 - DNA, 623 bp, Panicum virgatum
  misc_feature: Ceres CLONE 2017663
  misc_feature: Encodes the peptide sequence at SEQ ID NO. 43685
tcaaagctacatgtactacagctgcatataggggcactcttgtccacaagctccttcaaggacagtttttttctgctggccgacaaggctctcggcatgacaagggtgaagtccagcctccctcaggcctcattaggaattctgagactgtcaatcctaaagcattcaaactaaggcatgcaagacctgggccaggaccctgtccagagcttgatggccagaacattgtctttggaactgtattggaaggaatggatgttatcaccagcatcgcaaccatacctacctacaaaccagctgaaaggatccgcttcttcaatgactttgcacagttgattggtgacgaaagagctcaaactgctcgggcattgtgggatcgcccacttaagactgtatatatcagcgactgcggagagctaaaagtgaccaaacaatctctttcccctccaagcttaccatgacgttatgcattaacctttttgtgtcactttattactaggatcctttccctgtactccttaatctgtatatattccttcttttatcaacttatacgttccgacaaacggttgtatattatacgtcccgacaaacggttgtataaacatactctgagttctcag

SEQ ID NO: 43685 - protein, 152 aa, Panicum virgatum
  misc_feature: Ceres CLONE 2017663
  misc_feature: SWISSPROT Homolog: EC 5.2.1.8 Peptidylprolyl isomerase
KATCTTAAYRGTLVHKLLQGQFFSAGRQGSRHDKGEVQPPSGLIRNSETVNPKAFKLRHARPGPGPCPELDGQNIVFGTVLEGMDVITSIATIPTYKPAERIRFFNDFAQLIGDERAQTARALWDRPLKTVYISDCGELKVTKQSLSPPSLP

SEQ ID NO: 43686 - DNA, 591 bp, Panicum virgatum
  misc_feature: Ceres CLONE 2017666
  misc_feature: Encodes the peptide sequence at SEQ ID NO. 43687
tggggagaaccagttatttagtggccagaagacagtgcagcttgttttacttctgcttgctttggtgtccgtgccttggatgttgattccaaagcctattctattgaagaagcaacatgagcaaaggcatcaaggccaccaatacacaatgcttcaggacaccgatgaatcagtgggagcagagttgggggaacatcatgatgaatcacatgaccacgaggagtttgagttcagtgaagtttttgttcaccaactgatccacaccatcgaatttgttcttggtgcagtctcaaacacagcttcgtaccttcgtctttgggctctgagtcttgcgcactcggagttgtccactgtattctacgataaggttctcctactagcatgggggatgaacaatgttatcttccttattatcggcatcatcgtcttcgtctgtgctacgattggtgtcttgcttgttatggagactctgagcgctttccttcatgcgctgaggcttcactgggtggagttccagaacaagttctacgaaggtgatggttacaagttcgctccattctctttcacgctgattcgtgaggaggaagactg

SEQ ID NO: 43687 - protein, 196 aa, Panicum virgatum
  misc_feature: Ceres CLONE 2017666
  misc_feature: SWISSPROT Homolog: EC 3.6.3.14 H(+)-transporting two-sector ATPase
GENQLFSGQKTVQLVLLLLALVSVPWMLIPKPILLKKQHEQRHQGHQYTMLQDTDESVGAELGEHHDESHDHEEFEFSEVFVHQLIHTIEFVLGAVSNTASYLRLWALSLAHSELSTVFYDKVLLLAWGMNNVIFLIIGIIVFVCATIGVLLVMETLSAFLHALRLHWVEFQNKFYEGDGYKFAPFSFTLIREEED

SEQ ID NO: 43688 - DNA, 666 bp, Panicum virgatum
  misc_feature: Ceres CLONE 2017671
  misc_feature: Encodes the peptide sequence at SEQ ID NO. 43689
accacgccgcaaccgatcccgcagttgccgcctcgctccgccgccgcttccgccccagccccccctcccgatccggctcgcggcgcgcggccccgcccgcccgcccggatctgacgaggtcgctcgctgccgcgggcggtcgctccggccgcttgggtagggctcgcggccgcacgcggggaggtgcggagccttcgtcaggggtccgggatggcggcgccgccggcgagggcccgggccgactacgactacctcatcaagctgctactcatcggcgacagcggtgttgggaaaagttgtctccttttacggttctcagatggctccttcaccactagctttatcaccaccattgggatcgacttcaaaataagaacaattgaacttgatggtaagcgcataaagttgcagatctgggatactgctggccaagaacgtttccgaactattacaactgcctactacaggggagcaatgggcattttgctcgtctatgatgttactgacgagtcgtcgttcaacaatataagaaattggattaggaatattgagcaacatgcttccgacaatgtgaataaaattttgataggcaacaaagccgacatggatgaaagcaaacgggctgtaccaacatctgaagggcaggctcttgctgacgagtacggc

SEQ ID NO: 43689 - protein, 151 aa, Panicum virgatum
  misc_feature: Ceres CLONE 2017671
  misc_feature (17)..(151): Pfam Name: Ras Pfam Description: Ras family
  misc_feature (17)..(131): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 51218
  misc_feature: Useful for making plants with altered lignin content
  misc_feature: Functional homolog of the protein sequence given in SEQ ID NO 50522
  misc_feature: Useful for making plants with modulated oxidative stress sensitivity
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50163
  misc_feature: Useful for making plants with altered alkaloid content
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILIGNKADMDESKRAVPTSEGQALADEY

SEQ ID NO: 43690 - DNA, 671 bp, Panicum virgatum
  misc_feature: Ceres CLONE 2017673
  misc_feature: Encodes the peptide sequence at SEQ ID NO. 43691
cgctcactagatcataacctcaccggtcaccaccaccagcagcaaccacagcccaacgctcgacagcgtcatcatcactcgcggtaccccaagccgcgcgcgccgatgcctgctggagcagtgtcataagccgccacgcgagagtgcgaggcgctgggcaggggcgagggcgatcgagcgttgcgtgcggagccggtgggaggcggcgggaagcagaggacagggtagagagggccagcggcagctagcgcggcatgggcgccgagatcaggatcctggcggcgttcctggcggcgctcgcggcggccgccggcgtggcggcgcagctgcggcaggactactacgcggcggtgtgcccggacctggagagcatcgtgcgcgacgccgtgtcccagaaggtccaggaccagcccgtcgccgtcggcgccaccgtccgcctcttcttccacgactgcttcgtcgagggatgcgacgcgtccgtgatcctggtgtcgacggggaacaacacggcggagaaggaccaccccaacaacctctccctcgccggcgacggcttcgacacggtcatcaaggacaacgccaccatcgacgccgtgccggcgtgcgcgaaccaggtgtcctgcgccgacatcctcgccctcgccacccgggacgtcattgccctggctggc

SEQ ID NO: 43691 - protein, 138 aa, Panicum virgatum
  misc_feature: Ceres CLONE 2017673
  misc_feature: SWISSPROT Homolog: EC 1.11.1.7 Peroxidase
  misc_feature: Functional homolog of the protein sequence given in SEQ ID NO 51677
  misc_feature: Useful for making plants with altered carbohydrate content
  misc_feature: Functional homolog of the protein sequence given in SEQ ID NO 51678
  misc_feature: Useful for making plants with altered cell wall content and/or composition
MGAEIRILAAFLAALAAAAGVAAQLRQDYYAAVCPDLESIVRDAVSQKVQDQPVAVGATVRLFFHDCFVEGCDASVILVSTGNNTAEKDHPNNLSLAGDGFDTVIKDNATIDAVPACANQVSCADILALATRDVIALA

SEQ ID NO: 43692 - DNA, 638 bp, Panicum virgatum
  misc_feature: Ceres CLONE 2017695
  misc_feature: Encodes the peptide sequence at SEQ ID NO. 43693
agatcgcatcaggcaccaccacagtcaccacaatggcggcgttccggcggcttccgtgcaggctcctcctcgctctcctcttctccgtgctggcggtggggtcgtcgctcgccgccacgggccccggcgacatcgccgtgttctggggccggaacaaggacgagggcacgctgcgcgaggcctgcgacacgggcgcctacaccgccgtcctcatctccttcctcaccggcttcggcggcggcggcgccaacacctcctactcgctcgacctctcgggccacccgctcgccggcgtcggcgccgacatcaagcactgccagtccaagggcatcctcatgctgctctccatcggcgggccggccgcagccggcaacaacgccagctactccctccccacgcagcggtccgccgcggagctcgccgcccacctctgggacgcctacctcggcggcgcccgccccggcgtgccccgcccgttcggcgacgcggcgctcgacggcgtcgacttctacatcgacgaccagcagggcgccggccactacgacgagctcgccaggcgcctgagcgcccgcggccggcccggcggcgtgacgctgacggcgacggtgcggtgcgcgtacccggaccccggcctcgcg

SEQ ID NO: 43693 - protein, 201 aa, Panicum virgatum
  misc_feature: Ceres CLONE 2017695
  misc_feature (32)..(199): Pfam Name: Glyco_hydro_18 Pfam Description: Glycosyl hydrolases family 18
  misc_feature: SWISSPROT Homolog: EC 3.2.1.14 Chitinase
MAAFRRLPCRLLLALLFSVLAVGSSLAATGPGDIAVFWGRNKDEGTLREACDTGAYTAVLISFLTGFGGGGANTSYSLDLSGHPLAGVGADIKHCQSKGILMLLSIGGPAAAGNNASYSLPTQRSAAELAAHLWDAYLGGARPGVPRPFGDAALDGVDFYIDDQQGAGHYDELARRLSARGRPGGVTLTATVRCAYPDPGL

SEQ ID NO: 43694 - DNA, 661 bp, Panicum virgatum
  misc_feature: Ceres CLONE 2017700
  misc_feature: Encodes the peptide sequence at SEQ ID NO. 43695
gtctagcaagggttggttttggttggtgccttgtgcctgtgtgttccagtctgtcgcacactagctagtagcagctgcatcggaccggagtggccacgacgcgtatgcgcgcggcgagcgtggaggcgacggggaggtgatccgatggagctggagctcgggctcgcgccgccgaacccgcacgcgctgggcggcggcggcggcggggagtccgtcggactccacgacggcgccccagcgggtgccgcctgcgggaagagggcgttcggcgaggcgttctgccgggccgagaaggccacgctcccgctcttcgtgcgcgacggcgacggcggcggcggtggcggcgcccgcgacggcgtcgactgtgaaatgagcaacaagaggaagaggctggtggggtggccgccggtgaagtgcgcgcacaggcggcggagctgcggcggcgggtacgtgaaggtgaggatggaaggggtggccatcgggcggaaggtggacgtctccctccacggctcctacgaggagctgctccgcacgctcgcccgcatgttcccgtccacgaacgaaggcgcgggtgcagatgtggagggggaggcggcggcccaggacggcgagcgccgccgtggccgtggccaccacccgtccgtggtgacctacgaggacg

SEQ ID NO: 43695 - protein, 172 aa, Panicum virgatum
  misc_feature: Ceres CLONE 2017700
  misc_feature (2)..(153): Pfam Name: AUX_IAA Pfam Description: AUX/IAA family
MELELGLAPPNPHALGGGGGGESVGLHDGAPAGAACGKRAFGEAFCRAEKATLPLFVRDGDGGGGGGARDGVDCEMSNKRKRLVGWPPVKCAHRRRSCGGGYVKVRMEGVAIGRKVDVSLHGSYEELLRTLARMFPSTNEGAGADVEGEAAAQDGERRRGRGHHPSVVTYED

SEQ ID NO: 43696 - DNA, 1226 bp, Panicum virgatum
  misc_feature: Ceres CLONE 2017744
  misc_feature: Encodes the peptide sequence at SEQ ID NO. 43697
tcatcgaacaccaattgaaccacaaccagagcacaccatggctggctcatcgataaagaagcgctcaatcagcgatggtcctaagagccgggcggcacggccgaccaaaaagcaaaggaaaatagcggcctaccacagcagctctgaagaaagtggaagcgacgatgagaatgcacctgttcccgccaacctgctcgactcggacgacgaggacctcgacaacatcgaggtagacgacggcgcatcttcagccggctccgcatccgattccaactcacaatccgaggccgaaacagcaccaaaacctaaacccttcgtcgcccgagacgcccccgcctcccccaactccgccggcagcaaagaagatcactcatccgacgacggcgaccaagatgagttctccgacgccgccagtcacagcgacgacgattcggcaacagaatcacggcgcggcggcaacgacacgcggtcaaaacgcaacgacccggcggcgttcgcgacgtccatctccaagatgctagcgtccaagctgccggcgtcgcggcgggcagacccgatcgtggcgcgcagcgcggcggcggcggagcagtcgcggcaggcggtggacgcggcgcttgaggccaaggcgcgcaagcggctgcgcgagcagaagcggctggccatggagaagggccgcgtgcgcgacgtactggtcgccagcaccgcgcgcaccctcaacgtcgccaccggcgagatcgaggaggtccccgacgtcgcccccggcgaggccgccaccacgggcgagatcctggccgccgagaagaggctgcgcaaggtcgcccagcgcggtgtcgtcaaattgttcaacgccgtgcgcgccgcgcaggtcaaggccaccgaggcggagagggccgcccgcaaggagggggtcgtcggggtggatcggaagcaggagaaggttaccgagatgagtcggaaggggtttttggatctgatcgcgagcgggggtggggggttgaagaagggcggtttggaggaggcgtagtagcgtcgcggggtgtttttattttgtttggtttcaactgctcttttcagagcagagtctctggttgtctatgtacggcccttcctcgtggggaacacctgctatcgtacatgtacattgtatcggccgatattggctttttttttaagaacgtccaggatgccaccgcgccagattaaggaggatatcatcgtcgaaccag

SEQ ID NO: 43697 - protein, 328 aa, Panicum virgatum
  misc_feature: Ceres CLONE 2017744
  misc_feature (152)..(315): Pfam Name: Rrp15p Pfam Description: Rrp15p
MAGSSIKKRSISDGPKSRAARPTKKQRKIAAYHSSSEESGSDDENAPVPANLLDSDDEDLDNIEVDDGASSAGSASDSNSQSEAETAPKPKPFVARDAPASPNSAGSKEDHSSDDGDQDEFSDAASHSDDDSATESRRGGNDTRSKRNDPAAFATSISKMLASKLPASRRADPIVARSAAAAEQSRQAVDAALEAKARKRLREQKRLAMEKGRVRDVLVASTARTLNVATGEIEEVPDVAPGEAATTGEILAAEKRLRKVAQRGVVKLFNAVRAAQVKATEAERAARKEGVVGVDRKQEKVTEMSRKGFLDLIASGGGGLKKGGLEEA

SEQ ID NO: 43698 - DNA, 688 bp, Panicum virgatum
  misc_feature: Ceres CLONE 2017753
  misc_feature: Encodes the peptide sequence at SEQ ID NO. 43699
agggatcctgatccagattcgtcgtgggggataccggacaccccccttactcccgcaaagcatcgaaactgggatccatggcggcggcggagggggcgaggaagaaggtcatcatcgacaccgaccccggaatcgatgacgcgatggccatcttcgtggcgctgcgctcgccggagctcgaggtgctcggcctcaccaccaccttcggcaacgtccacaccgccctcgcgacgcgcaacgcgctccacctgctggaggctgttggccggaccgacatccccgtcgcggagggatcccatgtaacggtcaagaaagccagcaagctcaggatcgcgagctttgtccacggttcagacggtctaggaaaccaggacttccctgcaccgactacgaaaccgatagatcagacagctgctgccttccttgttgagcagtcaaatctgtaccccggacaagttaccgtcgtcgctcttggtccgctgaccaaccttgctctggccatcgagcttgacccttccttccccaagaagatagggcagattatcattctcggtggtgcatattcggtcaatggaaatgtcaaccctgcagctgaggcaaatatatttggggatcctgacgcggcagatattgtgttacttgcggtgctgatattttggccataggactaaacgtaacgcaccaagta

SEQ ID NO: 43699 - protein, 195 aa, Panicum virgatum
  misc_feature: Ceres CLONE 2017753
  misc_feature (8)..(195): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MAAAEGARKKVIIDTDPGIDDAMAIFVALRSPELEVLGLTTTFGNVHTALATRNALHLLEAVGRTDIPVAEGSHVTVKKASKLRIASFVHGSDGLGNQDFPAPTTKPIDQTAAAFLVEQSNLYPGQVTVVALGPLTNLALAIELDPSFPKKIGQIIILGGAYSVNGNVNPAAEANIFGDPDAADIVLLAVLIFWP

SEQ ID NO: 43700 - DNA, 713 bp, Panicum virgatum
  misc_feature: Ceres CLONE 2017776
  misc_feature: Encodes the peptide sequence at SEQ ID NO. 43701
ctctcctaacgccgctcgcgtcccctctcgccctcgcgccgccgccgccgctgcagctgcagctgcagcaagaccccgccccgccgtcgccggagacaaacccccagccgccgccatggggcgtatgcacagccgcgggaagggtatctcgtcgtcggcgctgccgtacaagaggactcccccgacctggctcaagatcgccgccaacgatgtggacgagatgccgtcgcagattggcgtcctcctccgtgaccagcacggtatcccgctcgtcaagagcgtcactggtagcaagatcctccgcatcctcaaggcccatgggctcgcacccgagatcccggaggacctttacttcctgattaagaaggcggtggcgattaggaagcatctggagaggaacaggaaggacaaggactccaaattcaggctcattcttgttgagagcaggatccaccgccttgcccgttactacaagcgcaccaagaagctcccgccaacctggaagtatgagtcgaccactgccagcactctggtggcctaagtgatcccatcagatggtgtggtccttaccttctttgagattggcttgttctagatatgaaatttatgtaatgtttaatgagtctggagcgggttagatggacaaggaacctcaactttttctatgtttactttttggagaatcccataaaccattttttggtttctcgaat

SEQ ID NO: 43701 - protein, 141 aa, Panicum virgatum
  misc_feature: Ceres CLONE 2017776
  misc_feature (55)..(141): Pfam Name: Ribosomal_S15 Pfam Description: Ribosomal protein S15
  misc_feature (1)..(50): Pfam Name: Ribosomal_S13_N Pfam Description: Ribosomal S13/S15 N-terminal domain
  misc_feature: Functional homolog of the protein sequence given in SEQ ID NO 50384
  misc_feature: Useful for making plants with modulated nitrogen use efficiency
MGRMHSRGKGISSSALPYKRTPPTWLKIAANDVDEMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 43702 - DNA, 593 bp, Panicum virgatum
  misc_feature: Ceres CLONE 2017811
  misc_feature: Encodes the peptide sequence at SEQ ID NO. 43703
gagtgaggttattcctggagcaacggaaattggaatgagggtgcaagcttacttatatgatggttactgggaagatattggcactatcgaggcattttataatgccaacttgggaataaccaagaagcctgtaccggattttagcttctatgaccgttctgctccaatttatacgcaacctaggtacttgcctccttcaaaggttcttgatgctgatgtaacagacagtgtcattggtgaaggttgtgttattaaacattgcacaatcaaccattctgtggttggactccgttcctgcatttctgaaggtgcagttatagaggactctttgctaatgggtgcagactattacgagactgaagatgataagaaagtcctttcagagaccggcggtattcccattggtattgggaagaatgcacatatcagaaaagcaataatcgacaagaatgctcgtattggagaaaatgtgaagataaccaattttgataatgtccaagaagcagtaagggaggcagaaggatactttatcaaaagtggcatagtcacggtgattaaggatgccttgatccctagtggaacagtcatataga

SEQ ID NO: 43703 - protein, 196 aa, Panicum virgatum
  misc_feature: Ceres CLONE 2017811
  misc_feature: SWISSPROT Homolog: EC 2.7.7.27 Glucose-1-phosphate adenylyltransferase
SEVIPGATEIGMRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETEDDKKVLSETGGIPIGIGKNAHIRKAIIDKNARIGENVKITNFDNVQEAVREAEGYFIKSGIVTVIKDALIPSGTVI

SEQ ID NO: 43704 - DNA, 387 bp, Panicum virgatum
  misc_feature: Ceres CLONE 2017812
  misc_feature: Encodes the peptide sequence at SEQ ID NO. 43705
agagacggtcctccgctagccgcccccatggcaaagcgaggagcgaggaggctcccatgggaagaacttccagatgtctctgggtctgcgggcggccgagacagcgaactgcgcagacagcactggccccgagatcgttttcatcatctcagacaagggaagctccgggcggccccaccgtctcccctccccctgcgtccgcgacctgcacagcggcatgcgcgcagaaagggaagcctgacctgccgaagaacgtcaggccggccacccatcacctcccagcgcagggacgtggctccggaaggaccgcatctacatgtacttcgaaaataatgcgggagcggatgctgactcccacggctgagatgaaaggctctgatgtcactg

SEQ ID NO: 43705 - protein, 55 aa, Panicum virgatum
  misc_feature: Ceres CLONE 2017812
  misc_feature: Functional homolog of the protein sequence given in SEQ ID NO 50297
  misc_feature: Useful for making plants with modulated biomass
  misc_feature: Useful for making plants with modulated heat sensitivity
MSLGLRAAETANCADSTGPEIVFIISDKGSSGRPHRLPSPCVRDLHSGMRAEREA

SEQ ID NO: 43706 - DNA, 654 bp, Panicum virgatum
  misc_feature: Ceres CLONE 2017824
  misc_feature: Encodes the peptide sequence at SEQ ID NO. 43707
ccccactcatccattcctcgcaacccagctctcctcttcctcctccctcagctcccaagctaagctaagccaaagcttacgcttccgccgccatgggcaaggacgacgtgatcgagagcggcgccggcggcggcgagttcgcggccaaggactacacggacccacctccggcgccgctcatcgacgcggcggagctgggctcctggtccctctaccgcgcggtgatcgccgagttcatcgccacgctgctcttcctctacatcacggtgctcaccgtgatcgggtacaagcaccagacggacaccaacatcaacggaaccgacccgtgcggcggcgtgggcgtcctcggcatcgcctgggcgttcggcggcatgatcttcgtgctcgtctactgcacggcggggatctccggtggccacatcaacccggccgtaaccttcggcctcttcctcgcgcgtaaggtctccctggttcgtgctgtgctctacatcgtggcgcagtgcttgggagccatctgtggtgtgggacttgtgaaggcgttccagagggcgtactttgataggtatggtggcggcgccaactccctcgcggagggatactccaagggaaccgggcttggtgctgagattattggcacttttgtgcttgtctaca

SEQ ID NO: 43707 - protein, 187 aa, Panicum virgatum
  misc_feature: Ceres CLONE 2017824
  misc_feature (34)..(187): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
MGKDDVIESGAGGGEFAAKDYTDPPPAPLIDAAELGSWSLYRAVIAEFIATLLFLYITVLTVIGYKHQTDTNINGTDPCGGVGVLGIAWAFGGMIFVLVYCTAGISGGHINPAVTFGLFLARKVSLVRAVLYIVAQCLGAICGVGLVKAFQRAYFDRYGGGANSLAEGYSKGTGLGAEIIGTFVLVY

SEQ ID NO: 43708 - DNA, 1177 bp, Panicum virgatum
  misc_feature: Ceres CLONE 2017827
  misc_feature: Encodes the peptide sequence at SEQ ID NO. 43709
aattaattattttttcgacgaatcttttagaaattccttacatccacaatggctccccactctgacaacaaaggcggtaaccccatcaagtccatcatctccggtggtatcactggtggtattgaaatctccatcacttacccccactgaatatatcaagactaaaatgcaactctgcaaggaattctctcaaaagggtcttgcttacaccgttaaggacacttatgccaaaaacggcatctctggtttctacagaggtctccccgtccttcttttcttctccgtccccaagactggtgttagattcggtgccaaccaagccttaaagaataatgtcttcactgacttcaaaaccaacaagctctccaacttcttggctggtgtcggtgctggtatcactgaagctatcttcgtcgttactccccaagaaaccttgaagaccaagcttatccacgacagattccaacccaaccctcaatataaaggtcttttcgatggtatccaaaagatctacgccactcaaggcttcggcggtatctacagaggtctcacccccactatcctcagacaaggatctaaccaaggtgtcagattcttcgtctacgaagaatgcagaactcacctctctaaagctttcggtgttgccaacactcacactggtatcactttcttctctggtgctattgctggtgctgcttccgtctttgccaacactcccgtcgatgtcgtcaagactcaaatgcaaggtctcgatgccaagaaatacaagaacggtcttgattgcttcgtccaaatcttcaagaatgaaggtatcagaggtctctacaagggtaccgtccccagattgggaagagtcgttctcgatgtcgccttgaccttcaccctctacgaaaagatctctgctttgttgaacaaggtcatctaagctatttgatgcttaaataaataaaatttctgcttgctcgaaaaggaatagtggcagaaaaaataaaattatgcttggatccaatcaagccagttagacaagcttcttgcatgaaaattttttgtctgatcccccatttagaatgtccggtcgtatacatatacaatattcctatatccctttgaatacagatttattgcattttatatgtatgcgaatctttcatagtagttaaattatgacaatgacacg

SEQ ID NO: 43709 - protein, 252 aa, Panicum virgatum
  misc_feature: Ceres CLONE 2017827
  misc_feature (163)..(252): Pfam Name: Mito_carr Pfam Description: Mitochondrial carrier protein
  misc_feature (64)..(157): Pfam Name: Mito_carr Pfam Description: Mitochondrial carrier protein
MQLCKEFSQKGLAYTVKDTYAKNGISGFYRGLPVLLFFSVPKTGVRFGANQALKNNVFTDFKTNKLSNFLAGVGAGITEAIFVVTPQETLKTKLIHDRFQPNPQYKGLFDGIQKIYATQGFGGIYRGLTPTILRQGSNQGVRFFVYEECRTHLSKAFGVANTHTGITFFSGAIAGAASVFANTPVDVVKTQMQGLDAKKYKNGLDCFVQIFKNEGIRGLYKGTVPRLGRVVLDVALTFTLYEKISALLNKVI

SEQ ID NO: 43710 - DNA, 1039 bp, Panicum virgatum
  misc_feature: Ceres CLONE 2017848
  misc_feature: Encodes the peptide sequence at SEQ ID NO. 43711
gcaatactagcatccgtcgccgtccccacacgcccaacaccgcaccgctccgtccgaatgccaagtacagcagacatgcgtccccatccctgatatccccaccaccaccaccgctccggccgccgcctctcgcccagcaaatcccactctccacccagccagcccgcagctccagctcgcgttcccctttcttcctccctccctcaccctgcgtcgccggacgaacaccgggacatcgccctgcggcggccgggccagaggcgtcgatcggcgcggcggcattggttggtgttagctaggcggggagggggcgggcaggatgagcatgtacgggagggacccgtggggcgggccgctggagatatgccacgactcggccacggacgacgaccgcagccggaacctggacatcgaccgcggcgcgctgtcgcggacgctcgacgagacgcagcagagctggctgctggcggggcccggggaccagggccgcaggaagaagaagtacgtggacatcggctgcctcgtcgtcagccgcaagttcttcgtctggacgctcggggtgctcctcgccgccgccgtcttcgcgggggtcgtggccgggatcgccaaggccatacccaggcgacaccgcccgccgccgcagcccgacgactacaccgtcgcgctgcacaaggcgctcatgttcttcaacgcgcagagatctggcaagcttccgaagcacaacaatgtaccatggcgtggcaactcttgcatgaaggacggactctctgacccggcagtccggcgaagcctggttggcgggtactatgacggtggcgacgccgtcaagttcaacttcccagctgcattctccatgaccctcctcagctggagtgtcattgagtacagtgccaagtatgaagctgttggggaacttggccatgtccgtgacattatcaagtggggagcagactacttcttgaagacctttaactccacagccgatagcattgatcgtgtcgttgcgcaggtaaaaaaaataaaggaacaagtccaattt

SEQ ID NO: 43711 - protein, 239 aa, Panicum virgatum
  misc_feature: Ceres CLONE 2017848
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MSMYGRDPWGGPLEICHDSATDDDRSRNLDIDRGALSRTLDETQQSWLLAGPGDQGRRKKKYVDIGCLVVSRKFFVWTLGVLLAAAVFAGVVAGIAKAIPRRHRPPPQPDDYTVALHKALMFFNAQRSGKLPKHNNVPWRGNSCMKDGLSDPAVRRSLVGGYYDGGDAVKFNFPAAFSMTLLSWSVIEYSAKYEAVGELGHVRDIIKWGADYFLKTFNSTADSIDRVVAQVKKIKEQVQ

SEQ ID NO: 43712 - DNA, 670 bp, Panicum virgatum
  misc_feature: Ceres CLONE 2017860
  misc_feature: Encodes the peptide sequence at SEQ ID NO. 43713
aactaacgctaaaaaagtaacagtttctgtactttattgatcttcatgtcgcattcgcgctacgagcgactgcgcgagctgggggtaggcgggttcggcgtcgtcgacgcgtgcctcgacgttggctcgggaaatcaagtcgcggtcaagtcgatcctggcgagcaaggtccatgcggaggcgaagcgtctggtgcgcgaactggacatcatgatccgcttgaaagaccggcacccgaatttgatgacgatcctcgacgcgtacctgacatacccggatccaaccgatcagaccaatttcaatgtgcacatcgtcatgccccttatgcgcggcgacttgcatcgtttcacgcgcgagttcccgcggctgccggtgccgaaccgtgctgagttcggggcccgcgtaagtgtcgtgttcgcttttcacgttgcgtacgggctggatttccttcacaagagcaatatcgtccaccgcgatttgaagcccgacaacattcttgtcaacgtggacacatctgatcccttcggcagcctcgccgtcatcgcggatttcggccttgcccgcgcgacgtccccgaccgagaccttttacatttgcacgcgtcaataccgcccacccgaggtcatcacgaatacagcgcaaggcgatgcgtcgctcgacatctgggcgc

SEQ ID NO: 43713 - protein, 208 aa, Panicum virgatum
  misc_feature: Ceres CLONE 2017860
  misc_feature (6)..(206): Pfam Name: Pkinase Pfam Description: Protein kinase domain
  misc_feature: SWISSPROT Homolog: EC 2.7.11.24 Mitogen-activated protein kinase
MSHSRYERLRELGVGGFGVVDACLDVGSGNQVAVKSILASKVHAEAKRLVRELDIMIRLKDRHPNLMTILDAYLTYPDPTDQTNFNVHIVMPLMRGDLHRFTREFPRLPVPNRAEFGARVSVVFAFHVAYGLDFLHKSNIVHRDLKPDNILVNVDTSDPFGSLAVIADFGLARATSPTETFYICTRQYRPPEVITNTAQGDASLDIWA

SEQ ID NO: 43714 - DNA, 463 bp, Panicum virgatum
  misc_feature: Ceres CLONE 2017860-R
ccccccccccccccccccccggcgagaggcgagccccccgagcagcaagcatgccccggcggtcgtggcggcacgcgctggcggcggagcctcgcgcgggcgggcgcgcgcggtgccggcggcaagcttcgcgcgcgtgggcgcggcctagctgcggctgcggctccagcgggcgcggcccccggcggtgagctccccacgcgcagacacggcccaaccccagcggcggcgctggcgggcggcagccgtggcttcaggcgtgcgcaagcggcggccggcatgttccgtgtaggcgagttgtcaagctgtgtcgtgtctatttttttttcattttcaatagaatattgaatctagtagaatgttaatctttctctgttgagtgtttgctgttgtataattttttttaatcttgggactttgtaattttggcttagaatggtgtaatccaaccgaagcttttccg

SEQ ID NO: 43715 - DNA, 699 bp, Panicum virgatum
  misc_feature: Ceres CLONE 2017879
  misc_feature: Encodes the peptide sequence at SEQ ID NO. 43716
aaacacatctaatttgattgatgtgaacattgagcctgctgagacgacccttagtacacatgccaaacgcgctaaagagtttcatttctatcctatcgatgttccagagcctaaggaatctcagcctgctgttgttacctctatgcctgcagcagctcctgcaaaccctaccgttgatgttcccatgttcagtgcaactatagctgcttttgtgccttctgttagtgtgcctgcacctgagcttgttgtgccggctgtaccttcaccacctgttaatgtgcctatcgtgcctacagctgtgtctgtttccgcacctccccatgcacctgcacctgcatctgcatctgtatctgtccctgcttctatgcctgtgcctccacctgttagtactgctgcagcacctgagccttttgacacagatgatcataatgaagagaagctattgagggagctggaggaaatgggctttaggcagattgatctgaacaaggaaatccttaggcagaacaattacaacctggagcagtccgttgatgatctgtgtggtgtcaacgaatgggatccactccttgcagagctggaggagatgggttttgatgataccgagatgaacaaggagctgcttgcgaagaatgggggaagcatcaagcgagctgtgatggacctcatcgccagggagaagaaggacaagtgaagatc

SEQ ID NO: 43716 - protein, 230 aa, Panicum virgatum
  misc_feature: Ceres CLONE 2017879
  misc_feature (143)..(180): Pfam Name: UBA Pfam Description: UBA/TS-N domain
  misc_feature (185)..(222): Pfam Name: UBA Pfam Description: UBA/TS-N domain
NTSNLIDVNIEPAETTLSTHAKRAKEFHFYPIDVPEPKESQPAVVTSMPAAAPANPTVDVPMFSATIAAFVPSVSVPAPELVVPAVPSPPVNVPIVPTAVSVSAPPHAPAPASASVSVPASMPVPPPVSTAAAPEPFDTDDHNEEKLLRELEEMGFRQIDLNKEILRQNNYNLEQSVDDLCGVNEWDPLLAELEEMGFDDTEMNKELLAKNGGSIKRAVMDLIAREKKDK

SEQ ID NO: 43717 - DNA, 617 bp, Panicum virgatum
  misc_feature: Ceres CLONE 2017886
  misc_feature: Encodes the peptide sequence at SEQ ID NO. 43718
aaagaagacaagctccccgctcctccaacctcgtagccctctcctgatcctcctcttcctgacagcagtagcggcagcagcagcagcagccatggcggccgagccggagcagaacgcggcccccgctgcggcggcgcaggaggcggccgtgcacatcgtgtacgtgaaccgccccgagggcgccgacccggaggagttccacctccgcaccctcacccccgtcctcggcagcgagcagaaggccaaggacgcggtgctctaccactacaagcacgccgccagcgggttctccgcgaagctcaccccccagcaagtcgaggagctaaagaagcaaccatgtgttcttcaggttgtgccgagccagacctaccatctccatggacctgaatctggcactcaccagggcacgacgcgcaccatgggccttatgtgaaggcataaccgagaggactgtgttctagtacggcagcggcctcactagtgaatgtacaatacataaataagagatgtatcgaatgtacctacttctacacaggttcagtcctgttttgaagtgtgtaatgctgtgttgcgtactacatgtttgcttaatgcaatggcagacgactatattatcc

SEQ ID NO: 43718 - protein, 143 aa, Panicum virgatum
  misc_feature: Ceres CLONE 2017886
  misc_feature (49)..(126): Pfam Name: Subtilisin_N Pfam Description: Subtilisin N-terminal Region
  misc_feature: SWISSPROT Homolog: EC 3.4.21.25 Cucumisin
KKTSSPLLQPRSPLLILLFLTAVAAAAAAAMAAEPEQNAAPAAAAQEAAVHIVYVNRPEGADPEEFHLRTLTPVLGSEQKAKDAVLYHYKHAASGFSAKLTPQQVEELKKQPCVLQVVPSQTYHLHGPESGTHQGTTRTMGLM

SEQ ID NO: 43719 - DNA, 686 bp, Panicum virgatum
  misc_feature: Ceres CLONE 2017902
  misc_feature: Encodes the peptide sequence at SEQ ID NO. 43720
cagctgctgctgcaccagtgcaccacgcctgcgacgcccccaacgcacgcgagttgagctctttctcgttttccggcggcggcggagatggcggcgaacctggaggacgtgccgtcgctggatctgatgcacgagctgctccgccgcatgaagtgcagctccaagcccgacaagcgcctcatcctcatcggaccacccggctctggaaagggaactcagtctccccttattaaggatgaatattgcctgtgccatttagccactggtgatatgctgagggctgcggtggctgcaaagactcctctaggaatcaaagctaaagaagctatggacaagggagagcttgtttccgatgacttggttgtggagatcattgatgaagccatgaagaaaccctcatgccagaaaggtttcatccttgatggcttccctagaactgtcactcaagcacagaagcttgatgagatgttggcaaagcaaggtgctaatgttgacaaggtcctgaacttcgcaattgatgatgctatattggaagaacggattactggtcgctggatccacccagcgagtggtaggacttaccatacaaaatttgcacctccaaaggctccgggagttgatgatgtcactggagagccattgattcagaggagagatgatacagctgaggtcttgaagtccaggct

SEQ ID NO: 43720 - protein, 199 aa, Panicum virgatum
  misc_feature: Ceres CLONE 2017902
  misc_feature (33)..(199): Pfam Name: ADK Pfam Description: Adenylate kinase
  misc_feature (155)..(190): Pfam Name: ADK_lid Pfam Description: Adenylate kinase, active site lid
  misc_feature: SWISSPROT Homolog: EC 2.7.4.3 Adenylate kinase
MAANLEDVPSLDLMHELLRRMKCSSKPDKRLILIGPPGSGKGTQSPLIKDEYCLCHLATGDMLRAAVAAKTPLGIKAKEAMDKGELVSDDLVVEIIDEAMKKPSCQKGFILDGFPRTVTQAQKLDEMLAKQGANVDKVLNFAIDDAILEERITGRWIHPASGRTYHTKFAPPKAPGVDDVTGEPLIQRRDDTAEVLKSR

SEQ ID NO: 43721 - DNA, 709 bp, Panicum virgatum
  misc_feature: Ceres CLONE 2017913
  misc_feature: Encodes the peptide sequence at SEQ ID NO. 43722
attcagagctctcgcttcgaaactgaaccagcacacccagctgccgttgccgtttctagagaactccctgccgttcgagatcccgctcgccacgatgcctgctctcgccaagcccgcctcgcggcccgccaagaccgccgcggcgccgaagccgaagcccgccgccgccaagcccaaggccgcggccgccgctggcgcctcgcacccgccctacttcgagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcgtacaagctctccgacgccgccaagaaggaggcgcccaaggccaagaccgccgcggccaagccagccaaggccgccgcgaaaccgaagaagagtgccgccgccgccgccgccgccgccgccgccgccgccaagcccaagaagaccgccgccgggaccaagcgcaaggcgccggagaagaaggtcgtcgcgaagccgaagaagtcccccgcggcgaaagccaaggccaagcccaagacggtcaagtcccccgcctccaagaaaggcccgggaggttgccgcatgagatggttccgtaggtcgtagctctgatcg

SEQ ID NO: 43722 - protein, 201 aa, Panicum virgatum
  misc_feature: Ceres CLONE 2017913
  misc_feature (36)..(106): Pfam Name: Linker_histone Pfam Description: linker histone H1 and H5 family
MPALAKPASRPAKTAAAPKPKPAAAKPKAAAAAGASHPPYFEMIKEAITALKERTGSSSHAIAKYMEDKHGPSLPANYKKMLSIQLRGFAAKGKLVKVKASYKLSDAAKKEAPKAKTAAAKPAKAAAKPKKSAAAAAAAAAAAAKPKKTAAGTKRKAPEKKVVAKPKKSPAAKAKAKPKTVKSPASKKGPGGCRMRWFRRS

SEQ ID NO: 43723 - DNA, 704 bp, Panicum virgatum
  misc_feature: Ceres CLONE 2017925
  misc_feature: Encodes the peptide sequence at SEQ ID NO. 43724
gcatcatcacccaccgccgccgccgccgacatagccgaagcaccagcgcttgagcgtagttcaggagcgaggattggagtgatgtccgctgaggaggctgccgctgccgcgaccgaggtccccgagaccgaggtcgagtccgaggccccggccgccgaggaggcggaggccaagcccgccaaggccaagaaggcgccgaaggagaagaaggcgcccaaggagaagaaggcccccaaggagaagaaggagaagaagcccgccgcggcgaggaagatggccgcccacccgccgtacgccgagatgatctcggaggcgatcgcggcgctcaaggagaggaccgggtcgagctcggtggccatcggcaagtacgtggaggagaagcacggcgcgaagctgccgcccaacttccgcaagctgctggccgggcagctcaagaagctcgccgccgcggggaagctgacccgcgtcaagaactcgttcaagctgccggccgccgccgacgccaagcccaaggcggccaagcccgccgccgcggccaagccgaagccagccaaggccgccaagcccgcggtcaagcccaaggcgtccccgaaagccaaggccaagatcgccgcccaagacaagacggccgccgcctcccccaagcccaagcccaaggccaaggccgcccccgccgcgtcgccccagccccgcggccgcccggc

SEQ ID NO: 43724 - protein, 207 aa, Panicum virgatum
  misc_feature: Ceres CLONE 2017925
  misc_feature (67)..(137): Pfam Name: Linker_histone Pfam Description: linker histone H1 and H5 family
MSAEEAAAAATEVPETEVESEAPAAEEAEAKPAKAKKAPKEKKAPKEKKAPKEKKEKKPAAARKMAAHPPYAEMISEAIAALKERTGSSSVAIGKYVEEKHGAKLPPNFRKLLAGQLKKLAAAGKLTRVKNSFKLPAAADAKPKAAKPAAAAKPKPAKAAKPAVKPKASPKAKAKIAAQDKTAAASPKPKPKAKAAPAASPQPRGRP

SEQ ID NO: 43725 - DNA, 676 bp, Panicum virgatum
  misc_feature: Ceres CLONE 2017928
  misc_feature: Encodes the peptide sequence at SEQ ID NO. 43726
aacgactcacgagccgatctctcacacagtcacacgttgcggggctcctcccacctcgtcttcttgtcgtcgccctcgtcctcccctctcttcaaccaaggggcgcatgagctagtgtggactggagatccatccatctgctggacctggattgacttcttctttcctagggacatccgaggatgtcgactcctgcgagaaagcggttgatgagggatttcaagcggttgatgcaggaccctccggccggcataagtggcgccccgcaggataacaacatactgctatggaacgctgtgatctttgggtatgacgcagaactgctcctttcccctttatctatttggactgcagtttgacaatgactttgtatatgttgatttcatttacagccctgacgatactccatgggatggtggttagtttatctaacttccgttacgggttggatatatatgcttcatccttttgtgctacttgttttctttgaccacggcaaattcattatgtgctgaagtgcttctcgtgacctatccaaacaattaagtgcacacgtgtatgctgctgctgttggcaatgccagcgtaacgtctaacttactaatgtgattaagtgatacgggatgtgataatccaccatcagaaagtagtccattaattggccgctggcagaatga

SEQ ID NO: 43726 - protein, 58 aa, Panicum virgatum
  misc_feature: Ceres CLONE 2017928
  misc_feature: SWISSPROT Homolog: EC 6.3.2.19 Ubiquitin--protein ligase
MSTPARKRLMRDFKRLMQDPPAGISGAPQDNNILLWNAVIFGYDAELLLSPLSIWTAV

SEQ ID NO: 43727 - DNA, 588 bp, Panicum virgatum
  misc_feature: Ceres CLONE 2017939
  misc_feature: Encodes the peptide sequence at SEQ ID NO. 43728
tacgctgaaaaatatccaactgaagcagctgaattaaaacgaagatttgatggaactttaccagaaggatgggataaagatttaccaacttttacttcaaaagatgctgctgctgcaacaagaattacatcaggaaatgttcttaatcatttcgcaaagaaaattccagaactttttggaggatctgctgatcttaatccatcctgttttacttatttaaaaaccgacaaggattacttaaaaggtcactttggtgaaagaaatgttcgatttggagttcgtgaacatgcaatggctgctatctgtaatggacttaacgcctatggtgcaatcatcccattctgttcaactttcctcaactttatcggatatgcttatggtgcagttattttgagtgctttgtctggtcatcaagttctttatgtttttacccatgattcaatttatttgggtgaagatggaccaacacatcaacctattgaaaaatatttaacatgcagaggaactccaaatcttcatttctggagacctgcagatgcaaatgaaactgttgcaacatacgtttccgcaattcgctcaagacatact

SEQ ID NO: 43728 - protein, 195 aa, Panicum virgatum
  misc_feature: Ceres CLONE 2017939
  misc_feature (36)..(195): Pfam Name: Transket_pyr Pfam Description: Transketolase, pyrimidine binding domain
  misc_feature: SWISSPROT Homolog: EC 2.2.1.1 Transketolase
  misc_feature: Functional homolog of the protein sequence given in SEQ ID NO 50504
  misc_feature: Useful for making plants with modulated biomass
YAEKYPTEAAELKRRFDGTLPEGWDKDLPTFTSKDAAAATRITSGNVLNHFAKKIPELFGGSADLNPSCFTYLKTDKDYLKGHFGERNVRFGVREHAMAAICNGLNAYGAIIPFCSTFLNFIGYAYGAVILSALSGHQVLYVFTHDSIYLGEDGPTHQPIEKYLTCRGTPNLHFWRPADANETVATYVSAIRSRH

SEQ ID NO: 43729 - DNA, 615 bp, Panicum virgatum
  misc_feature: Ceres CLONE 2017961
  misc_feature: Encodes the peptide sequence at SEQ ID NO. 43730
atcacgagtccgaagaatcccatcgaaaaacccaaagaaaccgagagaaaaattccatcgtttcctcgatttaattcagctcgcgaatttcgccacccgggaagaaccatggccgccgagtccaccaacaacgacgctccgatcgccaacaaccagccgaccacggaggaggaggtgacggtggagaggacggcgaccgaggaggagaggctgatgtacctcgcgttcgtgcagcaggcggcggcgcaggcgctggtgctggcggccgccgcgtacgcgtacgccaagcagggcgccggcccgctccgccccggcgttgaccatgtcgagggcaccgtcaaggccgtcgtcgggcccgtctacgaccgcttccacgccgtcccgctcgacctcctcaagttcctcgaccgcaaggttggtgaatctgttgaggagattgaccgtcgtgtccctccagttgtgaaggaggcacccaccctggcccgctctgctgccaaggaggtccgtgaggcaggtctagtgggcacagccactggccttgctaaatcagccatcgcccgtgcggagcctaaggcccgggagctctatacccgctatgagcccgtggcagagcga

SEQ ID NO: 43730 - protein, 168 aa, Panicum virgatum
  misc_feature: Ceres CLONE 2017961
  misc_feature (26)..(168): Pfam Name: REF Pfam Description: Rubber elongation factor protein (REF)
MAAESTNNDAPIANNQPTTEEEVTVERTATEEERLMYLAFVQQAAAQALVLAAAAYAYAKQGAGPLRPGVDHVEGTVKAVVGPVYDRFHAVPLDLLKFLDRKVGESVEEIDRRVPPVVKEAPTLARSAAKEVREAGLVGTATGLAKSAIARAEPKARELYTRYEPVAE

SEQ ID NO: 43731 - DNA, 603 bp, Panicum virgatum
  misc_feature: Ceres CLONE 2017963
  misc_feature: Encodes the peptide sequence at SEQ ID NO. 43732
atctcaattcgcattcgtgtaaccaaagccgacagagagacatggcgaccggcggcgctctccccgtggtggatctggcgcctttcttcacccaagacgacagcgacggcgtcgcccgcgccaccgaggccgtgcgcgaggcgtgcctgacgcacggcttcttccgcgtcgtcaaccacggcgtaccggccgagctcatggcgcgcgcgctcgaactgtcgcccgtgttcttcgcgctgccggacgacgagaaggccaaggcccggcaggccgaggggaccgcggcgcccttccgggctggctactttcgggcgccggtgccggcgcactcgcccgacaagcacgagttcgtgctggtgtttgatccgaagctcgggttcaatgagtaccccgctgagccagccggattcaggtcagtcgaaatacgaattcgcacgtctaaattattcattattagaatttctaaaaggatttttttacccgatcgaatgcttcacaaattcagagaagcagtggaggagtgttacgccaagttgaccgagctggggctgctcctccaggacgtcctgaacgagtgcatgggtctgccgccgggcttcctca

SEQ ID NO: 43732 - protein, 187 aa, Panicum virgatum
  misc_feature: Ceres CLONE 2017963
  misc_feature (29)..(84): SWISSPROT Homolog: EC 1.14.11.11 Hyoscyamine (6S)-dioxygenase
  misc_feature (14)..(53): SWISSPROT Homolog: EC 1.14.17.4 Aminocyclopropanecarboxylate oxidase
MATGGALPVVDLAPFFTQDDSDGVARATEAVREACLTHGFFRVVNHGVPAELMARALELSPVFFALPDDEKAKARQAEGTAAPFRAGYFRAPVPAHSPDKHEFVLVFDPKLGFNEYPAEPAGFRSVEIRIRTSKLFIIRISKRIFLPDRMLHKFREAVEECYAKLTELGLLLQDVLNECMGLPPGFL

SEQ ID NO: 43733 - DNA, 547 bp, Panicum virgatum
  misc_feature: Ceres CLONE 2017964
  misc_feature: Encodes the peptide sequence at SEQ ID NO. 43734
atccactcccccagcttccaaaaatccccaaatctttcgaaggagcgcttgagctagagcggcggcggcggcggcggcgaagatgtcggggcgcggcaagggcggcaaggggctgggcaagggcggcgccaagcgtcaccggaaggtgctccgcgacaacatccagggcatcaccaagccggcgatccggcgtctggcgcgccgtggcggcgtcaagcgcatctccggcctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggccgcttatcggttgctgtcctgtgattagtggtggtggtggttcgttgtttagggatccttctgtgtcgtgctactagtcatcttactgcatgtgttgcgttcttggatgtaatcccgtgattctgatgaaatcctagtactgtgtggttgg

SEQ ID NO: 43734 - protein, 103 aa, Panicum virgatum; identical to SEQ ID NO: 12044
  misc_feature: Ceres CLONE 2017964
  misc_feature (25)..(94): Pfam Name: Histone Pfam Description: Core histone H2A/H2B/H3/H4

SEQ ID NO: 43735 - DNA, 668 bp, Panicum virgatum
  misc_feature: Ceres CLONE 2017974
  misc_feature: Encodes the peptide sequence at SEQ ID NO. 43736
gaggggaaaggaaggagggcgatccaatcatcactccaccggcgtccctgagcagccaggagcctaccaccgaaccgatcgagttctcggagggggcgatctcctcacgaatcgcaccaaccgaaaccccggtcgcccccgcgagccggaggatccaagatgagtttcttgttcgggaagcggaagacgcccgccgagctcttgagagagaacaagagaatgttagatcgatccatcagggaaattgagcgggagaggcaaggattgcaggcccaggagaaaaagctcatcactgagatcaagaaaacagctaaagaaggccagatgggagctgtcaaagtaatggccaaagatcttattcgtacccggcatcagataacaaagttctatcaacttaaatcccagctccaaggagtttctctaagagttcagacactaaaatcaactcaagctatgggtgatgctatgaagggtgttacaaaagcaatggctcaaatgaataggcagctaaatttgccaggattgcagaagataatgcaagagtttgaacgacaaaatgagaggatggagatggtgagcgaggtgatgggagatgccatagatgatgctatggaaggagacgaggaagaagaagaaaccgaggagcttgtgaatcaagtgcttgatga

SEQ ID NO: 43736 - protein, 169 aa, Panicum virgatum
  misc_feature: Ceres CLONE 2017974
  misc_feature (17)..(169): Pfam Name: Snf7 Pfam Description: Snf7
MSFLFGKRKTPAELLRENKRMLDRSIREIERERQGLQAQEKKLITEIKKTAKEGQMGAVKVMAKDLIRTRHQITKFYQLKSQLQGVSLRVQTLKSTQAMGDAMKGVTKAMAQMNRQLNLPGLQKIMQEFERQNERMEMVSEVMGDAIDDAMEGDEEEEETEELVNQVLD

SEQ ID NO: 43737 - DNA, 702 bp, Panicum virgatum
  misc_feature: Ceres CLONE 2017977
  misc_feature: Encodes the peptide sequence at SEQ ID NO. 43738
gagcacaagggaacgacggctccccccgttccgttcccgacgactcctgtgagaggcgtgggcgaagccatggcctccgccaccggctccggctccggccagcagcaattccctagcacagcagcagcagcagatgctgacccgggagctggggccgacaagctcgtgttcgaggcggcgccgcagcgtatgagggaggactacgtcgagaacgccgtcaagttcctctcccaccccaaggtcaggggctccccagtcgtctacaggcggtccttcctcgagaagaagggcctcaccacccaggagatcgacgaggccttccgaagagtccctgatccgcaaccaagtgccactaccgctacagcttcacaaccacagcaacaggcaagcatccagaatcaatccaccggagtccaaacttacacaccactgcagcctctgcagccaggaactgttggccctgtagtccttcgtacgcagcccaggttcagctggtaccgagcattccttgctgcagggctgttgcttggttttggtgccagtgctgctgtctttatcaagaaactgttccttcccaggctcaagtcttggatacgcaaagttgtagcagaaggcgatgaaactcaaggcaaccaacttaaggccaagattgatgaggaaacggcagaggctgtaaaggcttctgggtctgctgtttctgct

SEQ ID NO: 43738 - protein, 210 aa, Panicum virgatum
  misc_feature: Ceres CLONE 2017977
  misc_feature (41)..(171): Pfam Name: Pex14_N Pfam Description: Peroxisomal membrane anchor protein (Pex14p) conserved region
MASATGSGSGQQQFPSTAAAADADPGAGADKLVFEAAPQRMREDYVENAVKFLSHPKVRGSPVVYRRSFLEKKGLTTQEIDEAFRRVPDPQPSATTATASQPQQQASIQNQSTGVQTYTPLQPLQPGTVGPVVLRTQPRFSWYRAFLAAGLLLGFGASAAVFIKKLFLPRLKSWIRKVVAEGDETQGNQLKAKIDEETAEAVKASGSAVS

SEQ ID NO: 43739 - DNA, 714 bp, Panicum virgatum
  misc_feature: Ceres CLONE 2017983
  misc_feature: Encodes the peptide sequence at SEQ ID NO. 43740
atcgttcctccccctgccttgcaggatctccagcacctccacgcctcgatccagatccaggtatcgttccgcagcagcttcacctcttccttctcccgtatacgtactcatcgttctcatcactctctggagtctggacttgcgcgggttggagatccatcctcgattggttacgatggcgttcaacgtgaagttgtgccatagcgggtgtttttaactggtgatctcacgaccgtttcacctacaatgttttgttgattctgaatttcgtcctcttcatgcagcagctgaaatatggatgcgaacagacgccagagtggaattcagcagttgttggctgcagagcaagaggctcagcagattgtaaatgcagctagggcagccaaatcggcaaggcttaggcaagccaaggaagaagctgagagggaaatagctgaataccgttcccaaatggaggctgaattccagagaaaggttgcagaggaagaagaagatgggagaagaagaaaatagagagaggagagggtggggaagaggtagaagaagacatcagccccccttacgtctcttggctagatccgccactgaacgttgctgtgcggtgaatatatgattgcaaccttttgtatctctcaatttctttatatcagaggggtaataaaggatttgtcacttatagttgtaattccatgttattgatcacagattaagctg

SEQ ID NO: 43740 - protein, 72 aa, Panicum virgatum; identical to SEQ ID NO: 16438
  misc_feature: Ceres CLONE 2017983
  misc_feature (5)..(72): Pfam Name: V-ATPase_G Pfam Description: Vacuolar (H+)-ATPase G subunit
  misc_feature: SWISSPROT Homolog: EC 3.6.3.14 H(+)-transporting two-sector ATPase

SEQ ID NO: 43741 - DNA, 708 bp, Panicum virgatum
  misc_feature: Ceres CLONE 2017984
  misc_feature: Encodes the peptide sequence at SEQ ID NO. 43742
agggccgggccggtcccccactagctctagctgtctagcaggccgcgccgcctataaaacccggcgccggccgcctgccgttggccgccgcatccaccggtgaccaagaccaaccagaccccagccggccatcccctccccagcgtcggagcctctgctccccatcgacttgtccccattcctcagctcccactcgccaccggaccaagcggatggcgtcggcgtccaaggaggaggtgatcgggaagctcaacgtccgcgtgctgcggggcaacaacctgatcatcgccgatccgctcacccacaccagcgacccctacgtcgtcctccagtacggcgcccagaaggtgaagactagtgtccagaagaagaatcctaatccagtctggaatgaagtactgcagctctcagtcacaaatcctacaaagccagtgcaccttgaagtttttgatgaggacaaattcacagctgacgacagcatgggtgtggctgacatcaacataactgacatatacgatgctgcgaagttggatctgagccatgccactaacggaaccaggatcaagacaatatatccagtcggtgtaaactaccttggcggtgagagccatgttcagtggaaggatggaaaggttgtccaggacttgattctgaagctgaagaaggtcgatagtggcctgatcgtggtgcagctggaatgggttcatg

SEQ ID NO: 43742 - protein, 165 aa, Panicum virgatum
  misc_feature: Ceres CLONE 2017984
  misc_feature (13)..(94): Pfam Name: C2 Pfam Description: C2 domain
  misc_feature: SWISSPROT Homolog: EC 3.1.1.4 Phospholipase A(2)
MASASKEEVIGKLNVRVLRGNNLIIADPLTHTSDPYVVLQYGAQKVKTSVQKKNPNPVWNEVLQLSVTNPTKPVHLEVFDEDKFTADDSMGVADINITDIYDAAKLDLSHATNGTRIKTIYPVGVNYLGGESHVQWKDGKVVQDLILKLKKVDSGLIVVQLEWVH

SEQ ID NO: 43743 - DNA, 853 bp, Panicum virgatum
  misc_feature: Ceres CLONE 2018002
  misc_feature: Encodes the peptide sequence at SEQ ID NO. 43744
atcaacaacaaacacaagcagctgcaaagcctactcctagaagcaccaacatacaagcgagggggaaaccaaatggccacctcctcctacttcctccttgctgccttcgtagcactggtcacttctcaggctattgcttctgaccctagcccactacaggacttttgtgttgccgacaaacactctcctgtgaaggtgaatggatttgtttgcaaggaccccatggccgtgaatgcagatgacttcttcaaggcagcagaacttgacaagcctagggacaccaaggcaagcaaagttggatccaatgtcactctaatcaatgtcatgcagctccctggactcaacactttaggcatttcattggcccgcattgactatgcacccttaggtgagaatccaccgcatacccacccacgtgccacagagattctcacggtgctcgagggaacactctatgttggatttgtcacctccaacccaaaccagctctttgccaaggtgcttaacaagggtgacgtgtttgtattcccgcaagggctcatccacttccaattcaacccggaccattacaagccagctgttgcgatcgctggtcttagcagccaaaaccctggagttattactattgccaatgcagtcttcggatcaaagccaccgatttcagatgatgtcttggccaaggcattccaggtggagaaagggacgattgactggctccaggctcaattctgggagaacaaccactactagatacgttaaccagttatgatgtggttactttttccatattttagctatatggtgttgtttcaatactgtactcaataaaataaatgagaaggattgtggcacg

SEQ ID NO: 43744 - protein, 225 aa, Panicum virgatum
  misc_feature: Ceres CLONE 2018002
  misc_feature (62)..(213): Pfam Name: Cupin_1 Pfam Description: Cupin
  misc_feature: SWISSPROT Homolog: EC 1.15.1.1 Superoxide dismutase
MATSSYFLLAAFVALVTSQAIASDPSPLQDFCVADKHSPVKVNGFVCKDPMAVNADDFFKAAELDKPRDTKASKVGSNVTLINVMQLPGLNTLGISLARIDYAPLGENPPHTHPRATEILTVLEGTLYVGFVTSNPNQLFAKVLNKGDVFVFPQGLIHFQFNPDHYKPAVAIAGLSSQNPGVITIANAVFGSKPPISDDVLAKAFQVEKGTIDWLQAQFWENNHY

SEQ ID NO: 43745 - DNA, 726 bp, Panicum virgatum
  misc_feature: Ceres CLONE 2018023
  misc_feature: Encodes the peptide sequence at SEQ ID NO. 43746
aacgagccgcccattcgcgccgccgccgctcgccgccgcccttgcttgtcgccgcccgcggccgctcgatccgatggctcccacgaagaagtcgaagaagagcacggagagcatcaacaacaagctgcagctggtgatgaagagcggcaagtacacgctcggctacaagaccgtcctcaagacgctgcgcaactccaaggggaagctgatcatccttgcgaacaactgccctccgcttaggaagtctgagattgagtactatgccatgcttgccaaagttagcgtgcatcatttccatggaaacaatgttgatctcggcactgcctgcggcaagtactacagagtgtgctgcctcagtatcattgacccaggtgactcggacattatcagcaccacccctggcgcccagtgagcaaagaagaggagcgagctttgcctatccctagttgagatgagatatagggctcagacctttgttgcagggccaatggccatttcttgtttgtctttagtctatgatgagttgatcttgcatacagattatacctcatatggttgttatgtaaggcatatctatggttttgtttgatgagatcatcataattattccgttgtctcatagatgtgggtcacatcatatgagatcagtatgtcatgatcttgcttggtgacgctggtttgctgtggttgcgttggccagtaagcttggcatgattcattgatcgc

SEQ ID NO: 43746 - protein, 112 aa, Panicum virgatum; identical to SEQ ID NO: 12614
  misc_feature: Ceres CLONE 2018023
  misc_feature (12)..(106): Pfam Name: Ribosomal_L7Ae Pfam Description: Ribosomal protein L7Ae/L30e/S12e/Gadd45 family

SEQ ID NO: 43747 - DNA, 674 bp, Panicum virgatum
  misc_feature: Ceres CLONE 2018032
  misc_feature: Encodes the peptide sequence at SEQ ID NO. 43748
cccattcccatcccttgctacctgcatccatcgaccttagcgagctcacagttcaatcaggtccggttcggcttcaggccgggctcgtcaccgaggagatggcgctctctcgccgcatggccgcgccggtcctcgtcttcctgctcctcctcgtcgccacagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcctctcgtctcttgttctctttacctggaataaattaaactcggtgctggactgctggtgtctggtgatgcctgtgcgtgtggaacatctcactgttgttctgcacccgtatgcactccattattagtgtagttggcaagatgatgtaaggtcctcctttcaacattgatgtaataatgtgatgcagtttcgtgctagttcagcttaattaagtgcgaggttttctc

SEQ ID NO: 43748 - protein, 80 aa, Panicum virgatum; identical to SEQ ID NO: 11903
  misc_feature: Ceres CLONE 2018032
  misc_feature (32)..(80): Pfam Name: Gamma-thionin Pfam Description: Gamma-thionin family

SEQ ID NO: 43749 - DNA, 639 bp, Panicum virgatum
  misc_feature: Ceres CLONE 2018038
  misc_feature: Encodes the peptide sequence at SEQ ID NO. 43750
ctggcctcccactgcccacatgcgtgcacagtccactcctcctgcctagctgcttttccggcgagcagcagagctgagctccggcgccaggagcctcagaccagctccgaactcaactagctagccgccgccaccggtaggttaggtcgcgcgccatgagcaaggagaagcatatccgcgactggatcctccggcgctgctgcggcgccgcctgcgcctgcttcctcacgctcgccgccgtggtgggcttcatcgtgctcgtcatctacctggcgctccacccctccaagccctccttctacctccaggacgtgcagctccgctccatcgacctcagcgaccccgcgctctccctcaacctccaggtgacgatcgcgtcgcgcaacccgaacgagcgcgtgggcgtctactacaagagcctggacgcgttcgcgacgtaccgggacgagccggtgacggtggcggtggcgctgccggccatctaccagggccacaaggacgcgtcggtgtggtcgccggtgctggcgggggagtcggtgccggtggcggggggcgcggcggacgccatgcggcaggacatcgcggccgggtacgtgctgctccacgtccggggggaggggggcgtcagggggaagggcg

SEQ ID NO: 43750 - protein, 161 aa, Panicum virgatum
  misc_feature: Ceres CLONE 2018038
  misc_feature (38)..(161): Pfam Name: Hin1 Pfam Description: Harpin-induced protein 1 (Hin1)
MSKEKHIRDWILRRCCGAACACFLTLAAVVGFIVLVIYLALHPSKPSFYLQDVQLRSIDLSDPALSLNLQVTIASRNPNERVGVYYKSLDAFATYRDEPVTVAVALPAIYQGHKDASVWSPVLAGESVPVAGGAADAMRQDIAAGYVLLHVRGEGGVRGKG

SEQ ID NO: 43751 - DNA, 691 bp, Panicum virgatum
  misc_feature: Ceres CLONE 2018050
  misc_feature: Encodes the peptide sequence at SEQ ID NO. 43752
aaaagtgcaaacttgcaacttcacattgcgagcaggcaaaagctaacaatttagaaggaccacaggctggtgctgtctgggatgtattccgcaggcaggatcttccaaagcttaatgaatatttggctgctcaccgggaaggatttggagctaactgtcaagctgtgccctctgttaaatatcctatttatgatcaaaatgtgtacctcaacaatcatcataagaagacattgaaggatcaatatggtattgagccttgcacattccaccaacatattggtgaggctgtattcattccagccggctgtcctttccaagtgaaaaacctccagtccaccgttcaattggctctcaattttttgtctccggagagtttgccagagtcagtccggatggcccaagagatccgttgcctgtcgaatggtcattttgcaaaactgaagatgcttgaggtaaaaaagatctccttatatgcagcaagttcatctgtcagagaaattcagagaataactctggatcccaagttcaatcttgatgctagtttcgaggatcaaaatctgacaagggtggtttcagaaaacttggcaagagtgaataaacaaaggaaggtatcttgcacttgaggttctggagaacttcgagaaattgtgacggtgccattcaggatggaagccgatgcagaggatgatat

SEQ ID NO: 43752 - protein, 206 aa, Panicum virgatum
  misc_feature: Ceres CLONE 2018050
  misc_feature (3)..(119): Pfam Name: JmjC Pfam Description: JmjC domain
  misc_feature: The sequence is a functional homolog of SEQ ID NO 958 in the 10/666,642 US patent application
KCKLATSHCEQAKANNLEGPQAGAVWDVFRRQDLPKLNEYLAAHREGFGANCQAVPSVKYPIYDQNVYLNNHHKKTLKDQYGIEPCTFHQHIGEAVFIPAGCPFQVKNLQSTVQLALNFLSPESLPESVRMAQEIRCLSNGHFAKLKMLEVKKISLYAASSSVREIQRITLDPKFNLDASFEDQNLTRVVSENLARVNKQRKVSCT

SEQ ID NO: 43753 - DNA, 894 bp, Panicum virgatum
  misc_feature: Ceres CLONE 2018056
  misc_feature: Encodes the peptide sequence at SEQ ID NO. 43754
acggcaccaacagcgccaaacaggcaacacaccacacccaacgcaacctctcttccagtccagtagtggcagaaagcttctcctcttgcccttggacaacacagccacagcccacatcccacagagatgatgaagatgacgaggcgttgcggcagcaatacctcttcgccgctcgcggctgttgtcctgctcctcttcctgacgatggtctgcttcttccactgcgcggcagcggcaaggctcctgcccgctgccgttgctcctcttgttcaccaagggaatggtgccaaggctgctgctgcggctgtagataatggcctggtagtgcttcaggatggtgccgcgggcactggggatgatgagctcccatcagttttcgaggtgagaacagaagagatggcggaagaacaggcgaccgagtgcgaggaggggaacgacgactgccttcagcggcggctcctcagcgacgcccacctcgactacatctacacccagcacaagggcaagccatgatgaggagactggagacgacgacgacgacctgcacgtcgatctgttgccgggtgctacggtcggggctgggcacatatgccggacagtcgacgtacggaggccgctagctagcttgattctgccgcttaacaacagtgaccagcaactaggaattccagcatatatgcatatgtgtgacgtctgtctgtacatcaccatgcctacatggtagattcgatttctttagcgtcgagcagagtatgctgcatgaaacggtgcgtgaaaggtgactgcctatgcactatgctagattgctagtttacttgtttgatctacttacatcgagtgtaatttgtctagctgtgtacctatatgaagctgcgcaccccctaagttaccacc

SEQ ID NO: 43754 - protein, 125 aa, Panicum virgatum
  misc_feature: Ceres CLONE 2018056
  misc_feature (19)..(124): Pfam Name: PSK Pfam Description: Phytosulfokine precursor protein (PSK)
MTRRCGSNTSSPLAAVVLLLFLTMVCFFHCAAAARLLPAAVAPLVHQGNGAKAAAAAVDNGLVVLQDGAAGTGDDELPSVFEVRTEEMAEEQATECEEGNDDCLQRRLLSDAHLDYIYTQHKGKP

SEQ ID NO: 43755 - DNA, 712 bp, Panicum virgatum
  misc_feature: Ceres CLONE 2018062
  misc_feature: Encodes the peptide sequence at SEQ ID NO. 43756
cttcaatgaaatctttttttctttttaaaaaagaaaataaaagactatttcaattcctatataactcttatgtatcagaatatgaatttttcttattgtttcttcgtaaacaatcttcttgcttacgattaacctcttctggaacctttctggaacgaatccacttttctgggaagatggaacatttttgggtaatgtacccaggtttttttcggaaaaccatatggttctttatggatcctcttatacattatgttcgatatcaaggaaaggcaattcttgcatcaaaaggaactcttcttttaaagaagaaatggaaatcttaccttgtcaatttctcgcaatattttttctctttttggactcaaccacaaaggattcgcctaaaccaattaacaaactcttgcttcgatttcttggggtaccttccaagtgtaccaataaatactttgttagtaaggaatcaaatgctggagaattcttttctaatagatactcgaatgaaaaaattcgataccacagtccctgctacttccctcgttggatccttatcaaaagctcaattttgtactggatcagggcatcctattagtaaagccgtttggaccgatttatcagattgggatattcttgatcgttttggtcggatatgtagaaatctttttcattattatagtggatcttcgaaaaaacggattttgtatcgactaaa

SEQ ID NO: 43756 - protein, 178 aa, Panicum virgatum
  misc_feature: Ceres CLONE 2018062
  misc_feature (109)..(178): Pfam Name: Intron_maturas2 Pfam Description: Type II intron maturase
MEHFWVMYPGFFRKTIWFFMDPLIHYVRYQGKAILASKGTLLLKKKWKSYLVNFSQYFFSFWTQPQRIRLNQLTNSCFDFLGYLPSVPINTLLVRNQMLENSFLIDTRMKKFDTTVPATSLVGSLSKAQFCTGSGHPISKAVWTDLSDWDILDRFGRICRNLFHYYSGSSKKRILYRL

SEQ ID NO: 43757 - DNA, 644 bp, Panicum virgatum
  misc_feature: Ceres CLONE 2018065
  misc_feature: Encodes the peptide sequence at SEQ ID NO. 43758
attatgactctgctgaataagatgatcttgacttctctccatacagcaggagaaggcagtccaatgtagaaccaaacaaggaccttggcttcggggtgaacaaacaaggtgaaacatgggaaagggttactcaaattcgtgacaaatttgaatatgatagagaaaggagaatgagagaacgagcatttgctcccatgaacatggagagcaattttggtcggcatgaccggagatttagatgccaggatgattcaaattttgccccgacaaacatcactgacgattttggctcacatggacaaacttttggagaccattccgatcgaagtttcgaaaacaatccaagtttcaggaaccagcaagattttagtttccaaaatgaatcaagtttcagaagccgccgcaattcagatttccaaaatgactcaagtttcacaagtcacaattttccagatttccaaaaccaacatgacaagaggcaagacatttgatgactagaggcttgtagttgccgtgagcaaagtgggtgttgatttgctggcaacataagcatgctgtttttcttgatttttgtggtggcctgagatatagtaatttatctaaaatggcttgtgtaacaaacagtatattctatggtagtgccc

SEQ ID NO: 43758 - protein, 106 aa, Panicum virgatum
  misc_feature: Ceres CLONE 2018065
  misc_feature: SWISSPROT Homolog: EC 5.2.1.8 Peptidylprolyl isomerase
MRERAFAPMNMESNFGRHDRRFRCQDDSNFAPTNITDDFGSHGQTFGDHSDRSFENNPSFRNQQDFSFQNESSFRSRRNSDFQNDSSFTSHNFPDFQNQHDKRQDI

SEQ ID NO: 43759 - DNA, 633 bp, Panicum virgatum
  misc_feature: Ceres CLONE 2018087
  misc_feature: Encodes the peptide sequence at SEQ ID NO. 43760
gcgccggcgccgcagacacctcccttccctcgcgccgccgccgccgagaatggccccgaagaaggacaaggccccgccgccgtcctccaagccggccaagtccggcggtggcaagcagaagaagaagaagtggagcaagggaaagcaaaaggagaaggtgaacaacgcggtgctcctcgaccaggccacctacgacaagctgctctcggaggtgcccaagtacaagcagatcaccccctcagtcctctccgagcgtctcaggatcaatggctccctggctcggagggccatcaaggacctgatggctcgtggcctcatccgaatggtctcagtgcactcaagccagcagatctacaccagggcaaccaacacctaaggattcgggaagctgtaatgcctctgtttgccctctgtaggaggagctcctctgccttagaacagttgtcatctttgtcaagggtttgctaatgttatgttacctgtgatgagtatctccatgtggctgaaacatttcagtgattttgcgaattagttcagtactatggtttacctattataagttgccttgcatcaatagctatatgtttttcagtgttttgttactgttaatgccaaggctttcccactgagatc

SEQ ID NO: 43760 - protein, 108 aa, Panicum virgatum; identical to SEQ ID NO: 27128
  misc_feature: Ceres CLONE 2018087
  misc_feature (1)..(106): Pfam Name: Ribosomal_S25 Pfam Description: S25 ribosomal protein

SEQ ID NO: 43761 - DNA, 495 bp, Panicum virgatum
  misc_feature: Ceres CLONE 2018091
  misc_feature: Encodes the peptide sequence at SEQ ID NO. 43762
tattcaggtgcctctatatgtggcaacaaagatggcatctatcaggaaatcctccttcatggttccatctgcggacacttacgctcgtgctgctgttcgccacattggctatgagcctaggtgcacgccgtactggccacactctgtcatgtggttcttgatctccattcttcctgagtccctcatcgacaacttccgcctaggcatgtgcatcaagatccgcaagaaggggctagccaaagacgccaagaagaagtccctgtgatgtttcaaatagttggacacatgtcgcgattcacattgtttgttcaacatctttattggacatgtgcttctagcttcgctgtagtcacttttagagttttagtacaattacctcctgaatctgttaaaaacgagaatattgttgttccttacccaattgtgaagcaaaaacatgtgtttcctcatctcagaatgtaacactaatgcggttaagaatggaatgaattaacg

SEQ ID NO: 43762 - protein, 87 aa, Panicum virgatum
  misc_feature: Ceres CLONE 2018091
  misc_feature: SWISSPROT Homolog: EC 1.1.1.62 Estradiol 17-beta-dehydrogenase
IQVPLYVATKMASIRKSSFMVPSADTYARAAVRHIGYEPRCTPYWPHSVMWFLISILPESLIDNFRLGMCIKIRKKGLAKDAKKKSL

SEQ ID NO: 43763 - DNA, 1001 bp, Panicum virgatum
  misc_feature: Ceres CLONE 2018111
  misc_feature: Encodes the peptide sequence at SEQ ID NO. 43764
aaccgattccccccttctccttggcctccccttccacgctacgcctgagcgaagccccacatcaccaagtccactccaccaccccgccccgcgcgcaatcccgcgctcacccaccgcccccgctccccatggcgaaggccacgccgcgccccgcgggggagcgggatcccctgctcccctcccccgcctccgcctccccgccgccctacctcgaccaccaccccgccgactcctacgcggtggtcctcgtccccgtgcgcctccgccgccgcctgcgccgcgggggccgctgcctcgccccctgcctcgccgccctcttcctcctcgcgctcgcgggcttcctcctctggcccgccgacccggacgtctccctcgcccgcctccgcctcgcgcacgtctccgtcacggcgcgccccgccgtcgccgtcaccatctccgccgcgctcaaggtccgcgtccgcaacccggacctcttcgcgctcgactactcccgcctcgacgtcgacatcggctaccgcggcaagccgctcgggcgggtcacctccggcggcgggcgcgtccgggcgcgcgccgtgtcgtacgtcgacgccgacctgcagctcgacgggatacgcgtcgtcgaggacgcgatctacctgctcgaggacctcgcgcgggggtccgtgcccttcgacgccgtcgtcgaggtcgacggccacctccacttgttcttcctcagcgtccctgtcaagggaagaatatcatgcgtggtgcatgttaatccacacaaccaaaccatattacatcaggactgctatcctgagtgaatttgctaatggcgtggaaactatcctatctggcgaatggatgatttctaagcttcgcttgaacctgtggttgtaaaactcaaaaatccatcggctatgggtgtacgtatacgtgcaagaaacaacaaaactatagtgggtgatgtgcctgttgtaaagtcgttagcatggcatgttagttccaaatttgtttac

SEQ ID NO: 43764 - protein, 225 aa, Panicum virgatum
  misc_feature: Ceres CLONE 2018111
  misc_feature (72)..(206): Pfam Name: Hin1 Pfam Description: Harpin-induced protein 1 (Hin1)
MAKATPRPAGERDPLLPSPASASPPPYLDHHPADSYAVVLVPVRLRRRLRRGGRCLAPCLAALFLLALAGFLLWPADPDVSLARLRLAHVSVTARPAVAVTISAALKVRVRNPDLFALDYSRLDVDIGYRGKPLGRVTSGGGRVRARAVSYVDADLQLDGIRVVEDAIYLLEDLARGSVPFDAVVEVDGHLHLFFLSVPVKGRISCVVHVNPHNQTILHQDCYPE

SEQ ID NO: 43765 - DNA, 692 bp, Panicum virgatum
  misc_feature: Ceres CLONE 2018115
  misc_feature: Encodes the peptide sequence at SEQ ID NO. 43766
aatggccaccaatggcatggccccctccttcttccccgcaaacttcctgctccaaatgcagcagcccctccctcaccatccccagcagcaggagcaccaccaccaccaccaccaccatgacgccggccaccacgagcacgaggcgccgacgcaccatctcctcgctccccctccccccggcctcgtcagccccttcctccacgacttcggcggcgccatggccgcgccgccaatgctggccggcggcggcctcggcaagcgcatgtatcctgacggcgcgggcgacgacggtaacctgcagcacgcggcggcggatccgcagcagcaggacggcggcggcgccgcgtcggacgacgaggaagtctccgccgtggcgggcggctggtgcggcggggagcggaaccggcggctgagcgtggagcaggtgcgcacgctggagcggagcttcgaggtggccaacaagctggagccggagcggaaggcgcagctggcccgcgcgctggggctgcagccccggcaggtggccatctggttccagaaccggcgcgcgcggtggaagacgaagcagctggagaaggactacgacgcgctccgccgccagctcgacgccgcccgcgccgagaacgacgccctcctcgccgacaacaagaagctccacgccgaggtgatcccaaaacgcagtgcttccacaa

SEQ ID NO: 43766 - protein, 158 aa, Panicum virgatum
  misc_feature: Ceres CLONE 2018115
  misc_feature (61)..(115): Pfam Name: Homeobox Pfam Description: Homeobox domain
  misc_feature (116)..(158): Pfam Name: HALZ Pfam Description: Homeobox associated leucine zipper
  misc_feature: The sequence is a functional homolog of SEQ ID NO 577 in the 11/479,226 US patent application
  misc_feature: The sequence is a functional homolog of SEQ ID NO 260 in the 10/412,699 US patent application
  misc_feature: The sequence is a functional homolog of SEQ ID NO 571 in the 11/479,226 US patent application
MAAPPMLAGGGLGKRMYPDGAGDDGNLQHAAADPQQQDGGGAASDDEEVSAVAGGWCGGERNRRLSVEQVRTLERSFEVANKLEPERKAQLARALGLQPRQVAIWFQNRRARWKTKQLEKDYDALRRQLDAARAENDALLADNKKLHAEVIPKRSAST

SEQ ID NO: 43767 - DNA, 690 bp, Panicum virgatum
  misc_feature: Ceres CLONE 2018130
  misc_feature: Encodes the peptide sequence at SEQ ID NO. 43768
acccccgctcttcctcttctccgccgattctttccaccatcgcgaaaccctagcccgagcaagagagagagccgagagggaactcagagatcggcgccatgaacgacctcatgaccaaatccttcatgagctacgtcgacctgaagaaggcggcgatgaaggacctggaggcggggggcgacgggatcgagctcccggagtcgggcggcgtcacggacgagcgcctgcgcgggttcttcgaggaggcggaagcggtgaaggcggagatggcggcgatccgcgacgcgctcgaccggctccacgccgccaacgaggagggcaagtcgctgcaccaggccgacgccctccgcgcgcaccgtggccgcgtcaacgccgacatcgtcgccgtgctccgccgcgcccgcgacatccgcgccaggctcgagtccctggaccgcgccaacgccgcgcagcggaggctctccgcggggtgccgcgagggcacgccgctggaccgcacgcgcaccgccgtcaccgcggggctccggaagaagctcaaggacctcatgctcgacttccaggcgctgcggcagcggatgatgtccgagtacaaggagaccgtggagcgccgctactacacgctcaccggggaggtccccgaggaggaggtgatcgagcgcatcatctcagacggccgcggcgaggagctcc

SEQ ID NO: 43768 - protein, 197 aa, Panicum virgatum
  misc_feature: Ceres CLONE 2018130
  misc_feature (42)..(150): Pfam Name: Syntaxin Pfam Description: Syntaxin
MNDLMTKSFMSYVDLKKAAMKDLEAGGDGIELPESGGVTDERLRGFFEEAEAVKAEMAAIRDALDRLHAANEEGKSLHQADALRAHRGRVNADIVAVLRRARDIRARLESLDRANAAQRRLSAGCREGTPLDRTRTAVTAGLRKKLKDLMLDFQALRQRMMSEYKETVERRYYTLTGEVPEEEVIERIISDGRGEEL

SEQ ID NO: 43769 - DNA, 685 bp, Panicum virgatum
  misc_feature: Ceres CLONE 2018137
  misc_feature: Encodes the peptide sequence at SEQ ID NO. 43770
aattaagtttgttccttagtcctccctatcccaaccaagaaatgggagtgctgttgcaaactgctcattatcaaaactgcacctcttacaaatttgtcacaagaagattctcagttaaccaagaaatgatgcaacttgcagtgttatttcaggcagtgtttcccgaatgtataaatgattctgctagtcatgcaaaccctcacctgtgcctaatgctgacttgatattgcaggttgagggcaagatcatcaaggcacagatctgggacacggcaggccaagagcggtaccgggcgatcacgagtgcctactaccgtggagcccttggtgcggtcctcgtctatgatgtgagcaagcccaccaccttcgagaacatcagccggtggctcaaggagctgcgcgaccatgccgattccaacatcagaatcatgctcgtcggcaacaagactgacctcagacacctccgggctgtcaccagagagaatgcccagaactttgcagaggcagaaggcctgtcctacattgagacgtctgcgctggaggcgacaaatgttgaggaggcattccagctgatcctgggcgacatttatcgtgccatcagcaaaaaacccgtggggtcggatgagtctggggccggggctgctggaggtgtcaaggaaggcaagacgatcaaccgtgcagccggt

SEQ ID NO: 43770 - protein, 85 aa, Panicum virgatum
  misc_feature: Ceres CLONE 2018137
  misc_feature (1)..(55): Pfam Name: Ras Pfam Description: Ras family
  misc_feature: Functional homolog of the protein sequence given in SEQ ID NO 50162
  misc_feature: Useful for making plants with altered lignin content
MLVGNKTDLRHLRAVTRENAQNFAEAEGLSYIETSALEATNVEEAFQLILGDIYRAISKKPVGSDESGAGAAGGVKEGKTINRAA

SEQ ID NO: 43771 - DNA, 1307 bp, Panicum virgatum
  misc_feature: Ceres CLONE 2018163
  misc_feature: Encodes the peptide sequence at SEQ ID NO. 43772
gcacccaaccaacccaaccgcgcttgtgttgtgtacactccactagtcccagctagctccacccaagccaggaagcagagctagaggcgtccatggcggcgtggcgggcgctgtccgcggcggtggcgatggcgctgtccgcggcggtggcgatggcgctgctggcggcgtcggcgtcggcgtcggcggactcgtggctgtacgagaagttcacgacggacgggcacgtgcgcgccgactacaatgcgcaggggcagcaggtgacgtcgctcatcctcgaccgccagtccggcggcgccttctactcccgccagaagtacctctacggcgtcttcagcatccagatgaagctcatccgtggcaactccgccggcaccgtcacctccttctacgtactaagcagccgcttcttcaacaatcgatgatttttttttgtatgaattcttcaagtgatgattcatcaattgctacggatttgcctgctgcagctgacctccggcgacggccccgggcacgacgagatcgacatggagttcatgggcaacagcagcggcgagccggtggtgctcaacaccaacgtgtgggccgccggcaacggcaagaaggagcagcagttctacctgtggttcgacccggcctccgacttccacacctacaccgtcatctggaacgaccggaacgtcatcttcaaggtggacgacctcttcatccgcagcttccggcggcacgccgacctgccgtaccccggcgggaagcccatgtcggtgcacgccacgctgtgggacggcagcttctgggccacgcagcaggggaaggtgaaggtggactgggccggcgcgcccttcgtcgtctcctaccggggctactccgccgacgcctgcacgcccgacggcgacgggaggccgctcagctgccccgccggcaccgaccgctggatgacccgccagctcgacgccgccgagtggggcaccgtcgcctgggccaggaagaactacatgcactacaactactgcgaggacggctggaggttcccgcaggggttccccgccgagtgctcccgcaactgaatactcattgcttcttcttcttgatccatcatcgattgggttgattgatctgggacgatgctgattccaaattggcaaatttctttcaatccttggcgtgtgttcatttgttcgtcgccggccttccttcctcgggtcgatggacgggacaggacgattgctgcatctctatatctgcgatgttcttggctcgctatgtacattttgccaccccacccatactgttcttttctactgttc

SEQ ID NO: 43772 - protein, 204 aa, Panicum virgatum
  misc_feature: Ceres CLONE 2018163
  misc_feature (3)..(128): Pfam Name: Glyco_hydro_16 Pfam Description: Glycosyl hydrolases family 16
  misc_feature (154)..(201): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
  misc_feature: Functional homolog of the protein sequence given in SEQ ID NO 50991
  misc_feature: Useful for making plants with altered carbohydrate content
  misc_feature: Functional homolog of the protein sequence given in SEQ ID NO 51620
  misc_feature: Useful for making plants with altered cell wall content and/or composition
MIHQLLRICLLQLTSGDGPGHDEIDMEFMGNSSGEPVVLNTNVWAAGNGKKEQQFYLWFDPASDFHTYTVIWNDRNVIFKVDDLFIRSFRRHADLPYPGGKPMSVHATLWDGSFWATQQGKVKVDWAGAPFVVSYRGYSADACTPDGDGRPLSCPAGTDRWMTRQLDAAEWGTVAWARKNYMHYNYCEDGWRFPQGFPAECSRN

SEQ ID NO: 43773 - DNA, 1087 bp, Panicum virgatum
  misc_feature: Ceres CLONE 2018167
  misc_feature: Encodes the peptide sequence at SEQ ID NO. 43774
aaatcgattcattctccaacccctcgtctctctttctctctcccagtctttcctcccgaagccagccgccaccagccagggcagctggggtaccgcaaggccagcagccaggggctgcaggcgccgcaacaggccgccgggtccgcgatgcccctccgccgccgccgggtccatgacgcctcaggtgcacgacgctctccgccgccgggtctacgatccccttcgccgccagatccaccccacgccgccggagggctgccaggaggacctccgctgcagcttgaggccggcaggggcggacccctgcagcctttggctgtgcagggacggatcctccatgagcacgagggcacaacaccagtggagcaatgcatttctcaaatctcctctctggcaactgaaggcctttaccccttcgaggcgacgctccgtgttcctgcaggttgctgaggagaatagcatgaagcagggcatgcagaagcagttacgacattaggaggcaagaagttattcactgtttggatgccaaagatgattaattccacttctgcccaaagtacagaaggcataatcttgataccagcagtgaggggagagggatgcttcagttcaagacaggtttacaatctgttattaagcaaaaacttgctaagaaggatggggctttgatagacgggcaaaatgacattcaagatctatggaatttttgtctggatcacaagatcccgattacacattcagtttattttatttttacaaaaatgacttgcatggattgtaagtcaaaccataccattgctggccgatgatgctgtactacaatttctggtacagaatgaacaacaagatggagctacaggctatggtggtgactactcatgttcctgaacaaggtggtattggtggaccatattatttgtggcataagtagtaaagactgtcgatctgatagatgattagctatatgatattgtcgatctggtagatgtgttgctatattgtattatctctactagagatgaatttaaaaaaaatgatttttgctacattggatctggttacatatgtgaacatttggttctgttgc

SEQ ID NO: 43774 - protein, 69 aa, Panicum virgatum
  misc_feature: Ceres CLONE 2018167
  misc_feature: Functional homolog of the protein sequence given in SEQ ID NO 51679
  misc_feature: Useful for making plants with altered cell wall content and/or composition
MLQFKTGLQSVIKQKLAKKDGALIDGQNDIQDLWNFCLDHKIPITHSVYFIFTKMTCMDCKSNHTIAGR

SEQ ID NO: 43775 - DNA, 708 bp, Panicum virgatum
  misc_feature: Ceres CLONE 2018176
  misc_feature: Encodes the peptide sequence at SEQ ID NO. 43776
atcctcctctccctccgatcagaagcagcacagccagcaccggccgaccagcgcagcggccacaccgagcgaccggtccaccatccacagcttcattcacacgaccatggcgtcgcagcagcggaggcagatgcagcagcagcagcagcagcaggcggcggcggcggcgccggtggggttcgaggactacctgccggtgatggcggagcggctgggcgaggagggcctgatgcgggagctggcgagcgggttccggctgctcatggacccggcgcgcgggctcatcaccttcgacagcctccgccgcagcgcgccgctgctgggcctgggcgccatgtccgacgacgacctccgcgggatgctcgccgagggcgacttcgacggcgacggcgcgctcagcgagatggagttctgcgcgctcatgctccgcctcagccccgagctcatggacgggccccgcaggtggctcgacgacgccgtctcgcaggcctcgcacttcctcttcttcaccagctaggcgcgctgcctgcccgggacgtgcgcataggaattcctgagctcttcttcttcgttctcgttgttcatagctggattaggaagggactggcggctgattggtcgatcgatggattccatatcatgtgtactcgcctgttcctcccctactggagtctgaattgatcaaacatgcttcttcctcttttgacc

SEQ ID NO: 43776 - protein, 136 aa, Panicum virgatum
  misc_feature: Ceres CLONE 2018176
  misc_feature (81)..(109): Pfam Name: efhand Pfam Description: EF hand
  misc_feature: Functional homolog of the protein sequence given in SEQ ID NO 51220
  misc_feature: Useful for making plants with altered glycerol content
MASQQRRQMQQQQQQQAAAAAPVGFEDYLPVMAERLGEEGLMRELASGFRLLMDPARGLITFDSLRRSAPLLGLGAMSDDDLRGMLAEGDFDGDGALSEMEFCALMLRLSPELMDGPRRWLDDAVSQASHFLFFTS

SEQ ID NO: 43777 - DNA, 950 bp, Panicum virgatum
  misc_feature: Ceres CLONE 2018186
  misc_feature: Encodes the peptide sequence at SEQ ID NO. 43778
gttcgtctcagctcctcttcctcctctgccccgccgccccagcctccacacgcagccaggcaccccaacagcgacggtgccatggagagacgacggagaagcctacccctaatagcggcggcggcggcggcggcgttcttggttgtagccgcaatgccgtaccccggcggggccgcgacgacgccgctgcggaaggactactacgacaagagctgccgcaacctggaggccatcgtgcgggaggaggtggccaggaagataaacgagacggtggtcaccatcccggcgacgctccggctcgtcttccacgactgcatggttggggtgagtaatagcagcgcactgcccggctcgcagcgtcctgattcctgatggaaccggggctcctccccggcccttcgcttcgaccgcactcatcgttcagctttcatccttgcttcgagatgcgcaatgcatccagggtgcatttgatctattactattgtttgtttggttcttcgttgatctatgattcgtgcttcttgagtaacagtagagtttttggttccactctggccaatcgcatcctcttgctctgttttggaatcatttctccccccaatctcctttcttcaagaagccagccatctttggaaccacaaagttgcaagttgcaggctcctttttcagcctgataacatgggctgtctctgcacacggcacacactgtccactgcatcatcttgctacccagttcattgcagccctgagtgacgccctgagctggtgttctagtagttctgaagaaaatgggaaaagaaaccggtctcttcagatgttgccaatagaaaacttggatcccctttcgctaaaagctatgggcccggcctagtttagtttctaaatttttttctaaagtacttgtcacatcaaatttttttgacacatgtatatagcattaaatggagttg

SEQ ID NO: 43778 - protein, 96 aa, Panicum virgatum
  misc_feature: Ceres CLONE 2018186
  misc_feature: SWISSPROT Homolog: EC 1.11.1.7 Peroxidase
  misc_feature: Functional homolog of the protein sequence given in SEQ ID NO 50952
  misc_feature: Useful for making plants with altered cell wall content and/or composition
MERRRRSLPLIAAAAAAAFLVVAAMPYPGGAATTPLRKDYYDKSCRNLEAIVREEVARKINETVVTIPATLRLVFHDCMVGVSNSSALPGSQRPDS

SEQ ID NO: 43779 - DNA, 733 bp, Panicum virgatum
  misc_feature: Ceres CLONE 2018189
  misc_feature: Encodes the peptide sequence at SEQ ID NO. 43780
aagtcactgaatctgattccctctcctctcctctctctctctctccaagcggcgacgagccgacgacaggggagtggcgccgcccttgccagttcttcgtcggacgcttcgccgggcgacaagctggtctgagcatcgttaagtacagtatgtcggagaaaccatctgatgctgcaactggtgatgtgaggcctgaaggaattgtttctgatgagaaagtggaaggttctgatcagaatgaaagagatggtatgccttcgccacaacaagaggaagcagcgatcaagaaaaagtatggagggataatgcccagaaagacaccacttatttccaaggaccatgagcgagcgtactttgattctgctgattgggctttggggaagcaaggaggaaatcctcaaaaacctaaaggaccgctcgaagcacttcgaccaaaattacagcctactcaacaacaaactcgttcacgtcgatttcttggtgaatctgctgataatgaagagagtgcccattcgcctactgaggatgtcaattcacctactgaggatgctggcaagaaccaggataacgctgaaggcaacggcaaggaatgatgggcggttccaagttttgtctacgattttctgcttaaagcaataagcactcgggttcatgtaatgatcatgccccgtgaggtcaagctgaatttcgaatcgtcaaatgctgtatcaacgtgttatgttgttccatttat

SEQ ID NO: 43780 - protein, 147 aa, Panicum virgatum
  misc_feature: Ceres CLONE 2018189
  misc_feature (46)..(129): Pfam Name: Lg106 Pfam Description: Lg106-like protein
  misc_feature: Functional homolog of the protein sequence given in SEQ ID NO 50181
  misc_feature: Useful for biocontainment applications
MSEKPSDAATGDVRPEGIVSDEKVEGSDQNERDGMPSPQQEEAAIKKKYGGIMPRKTPLISKDHERAYFDSADWALGKQGGNPQKPKGPLEALRPKLQPTQQQTRSRRFLGESADNEESAHSPTEDVNSPTEDAGKNQDNAEGNGKE

SEQ ID NO: 43781 - DNA, 988 bp, Panicum virgatum
  misc_feature: Ceres CLONE 2018204
  misc_feature: Encodes the peptide sequence at SEQ ID NO. 43782
gccctggcaaactaaagcattagcaagcaaagagaagctgcaatcttaatcgctgaaacttactaactttgcaggacgacacggagtggccggaggtgagatgaagctactcggcacatggtacagtgtctgggcttgcagggtcaggattgcgctccatctcaaggacctgagctatggctacatcgaggaggacctcgagaacaagagcgacctcctcctggcgtccaaccccgtgcataagaaggtgcccgtgctcatccacaacggcaagcctatcagtgagtcacgtgtcatcgtgcagtatatcgacgaggcctttccgggcaatggttcccccctcctccccgccgaccctcacgaacgcgcaactgcccgcttctggaccgcttacatcgacgacaagctagtggcggcgtggtttcaggcgttcaggggcaagacggaggaggagaggttggaggggaccaagcagttgctcgtggtggtggagacgctggaaggcgccctgagagagtgctccaagggcaagcctttcttcggcggcgacagcgtcgggttcctggacgtcatgctgggtgggctcctctcgtggctgcacgggaccggggccctgtgcggtgtcgagttcctggacgccgccaggaccccgctcctgtcggcgtgggcggagcgcttcggcgctctggacgctgccaaggccattctgccggacgtcggcgaggcggtcgagttcgccaagacgtggcgcgcgcagaaggctgcggccgccgccgcgaagaacgaataagccggccggcactgcacgacatcgtgagtgcagtcttgtcgcagcaaatagtaatgtttgggtccatgaataatggaagcatatataataaaggtttcacggcagtgtagtccttgatttgttgtccatgattatccgattcatgttagatgataatgtagtgcataatgaagatatgttcttgttgtgcgttgatgc

SEQ ID NO: 43782 - protein, 229 aa, Panicum virgatum
  misc_feature: Ceres CLONE 2018204
  misc_feature (1)..(72): Pfam Name: GST_N Pfam Description: Glutathione S-transferase, N-terminal domain
  misc_feature (99)..(197): Pfam Name: GST_C Pfam Description: Glutathione S-transferase, C-terminal domain
  misc_feature: SWISSPROT Homolog: EC 4.4.1.5 Lactoylglutathione lyase
MKLLGTWYSVWACRVRIALHLKDLSYGYIEEDLENKSDLLLASNPVHKKVPVLIHNGKPISESRVIVQYIDEAFPGNGSPLLPADPHERATARFWTAYIDDKLVAAWFQAFRGKTEEERLEGTKQLLVVVETLEGALRECSKGKPFFGGDSVGFLDVMLGGLLSWLHGTGALCGVEFLDAARTPLLSAWAERFGALDAAKAILPDVGEAVEFAKTWRAQKAAAAAAKNE

SEQ ID NO: 43783 - DNA, 927 bp, Panicum virgatum
  misc_feature: Ceres CLONE 2018207
  misc_feature: Encodes the peptide sequence at SEQ ID NO. 43784
gttcaatgtgataagtttgcaaaactttgccatcccaactaaaacagggctgtttgagctttatcttggccctagttgcaactgaccggagtttttttgtgggattccaaatgtgctggcagctggctgtgcgcatccaaatgtgctgtgcacatagtcatttatcaccgtcatcagcagctactcccatcatcagtataccaccatgcctatgtccacatacttatttattatttttagtatttttaaatactaagatactactaagcaaattatgaaaattatcaaaaccacccaatatatgcatacacatatacatgaagatcggttatgtgtttctcgcaggtgttttctctatatgtcactggatcactcaacaccatcatatcgaaagagcacaggcatgagatatgccgctgtatttacaaccatcaggcatgttaagaaaagtctacttattttctagtcaagcatgtaaaatttttctacgtgggaagcaaattatgagaagttttgtaagaaatgttatccatgcagaatgaagatggcggttggggcacaagtgagagaggaccaagcaccatgtttggatcttgcatgaactatgttaccctcagacttcttggcgaaccttgcacagataaggccttgacaaaaggacgtgaatggattttatctcgtggaactgcagttgcaataccacaatggggaaagatatggctctcggtataaatgtcctgaaaacaaaagaaagatccatatactttttacttatggttttgcatgtataaaagttaataagtttccatgtttcattgaatccgtgtataatatttcttgtacccacagccaccatattcatttttaattcaaatatgtcgacaatttaaatagggccgtttataatgaatttacattttttttgct

SEQ ID NO: 43784 - protein, 66 aa, Panicum virgatum
  misc_feature: Ceres CLONE 2018207
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
MQNEDGGWGTSERGPSTMFGSCMNYVTLRLLGEPCTDKALTKGREWILSRGTAVAIPQWGKIWLSV

SEQ ID NO: 43785 - DNA, 690 bp, Panicum virgatum
  misc_feature: Ceres CLONE 2018210
  misc_feature: Encodes the peptide sequence at SEQ ID NO. 43786
aaaacggcacaccgtcctcgcgtgtgggttcctcccaaaccccaaccaccacctccacctacacggcgccgctcttcgtcgtcccccgggcctataaatacgaggcgaggcggaagggggcgcagatgggaatcacctcctcttcgtcctcgaacccggaatccagggctatggcgctcgtcaaggccaaggagatcgtcgcctccgcgcccgtcgtcgtcttcagcaagtcttactgccctttctgcgtccgcgtgaagcagctgttcgagaagctgggagcaagcttcaaggccattgagatggatgtggaaagtgatggagctgagctccaggatgctctcaaggagtggactggacagaggaccgttccaaatgtcttcatcaatgggaagcatattggtggctgcgatgataccatggcactgaacaatgatgggaagctggtgtctctgctaactgaggctggagcgatcaagggttctacttccaagaaaaccgccactgcttagctcgatctgagagttgtcctggttaacatgtttatactctgttcccatggtatgaaataagggggctatgcttcgcaggtcctgaactttgtgctgtcagcgtcaagtactatcatgactgtctagtccccctgttgaaccgctcagacatctgtctgagttgcatgcctgcgctaat

SEQ ID NO: 43786 - protein, 128 aa, Panicum virgatum
  misc_feature: Ceres CLONE 2018210
  misc_feature (30)..(92): Pfam Name: Glutaredoxin Pfam Description: Glutaredoxin
  misc_feature: SWISSPROT Homolog: EC 1.11.1.15 Peroxiredoxin
  misc_feature: Functional homolog of the protein sequence given in SEQ ID NO 50111
  misc_feature: Useful for biocontainment applications
MGITSSSSSNPESRAMALVKAKEIVASAPVVVFSKSYCPFCVRVKQLFEKLGASFKAIEMDVESDGAELQDALKEWTGQRTVPNVFINGKHIGGCDDTMALNNDGKLVSLLTEAGAIKGSTSKKTATA

SEQ ID NO: 43787 - DNA, 689 bp, Panicum virgatum
  misc_feature: Ceres CLONE 2018212
  misc_feature: Encodes the peptide sequence at SEQ ID NO. 43788
agcacatcccgcggccgcctccctcagatcctccgtcctcgctcggtcaagtgccgccgctaccccgcctccgtcactcttctcccgtggccaccacccaccgcatccgccgctccccgcccctctccaccggccggtttggtttgtctctgaaaggcggcggcggcggcggcagcggagatgtccgaaaagaagcgcggtggcggcggcacccgcaaggacgaggtggtgacccgcgagtacacaattaacctccacaagcgcctccacggatgcaccttcaagaagaaagcaccaaatgccatcaaggagatcaggaagtttgcacagaaggctatgggaaccactgatgtccgaattgatgtgaagctcaacaagcacatctggagcagtggtatccggagcgttccaaggcgagttcgcgtcaggatcgcccggaagaggaatgatgaggaagatgccaaggaggagctctactctctggtcacagttgctgagatccctgcagagggtctcaaaggtttgggtactaaggttgttgaggatgaggattaagcccacccatggattgaatctgctagcacttagtgcatatcatgagagcaagtttgagaatgttaccttagcttattgttatctaccgttgatgacttatgtaatagaagattcaagactttgctcatttcttt

SEQ ID NO: 43788 - protein, 124 aa, Panicum virgatum; identical to SEQ ID NO: 12126
  misc_feature: Ceres CLONE 2018212
  misc_feature (12)..(106): Pfam Name: Ribosomal_L31e Pfam Description: Ribosomal protein L31e

SEQ ID NO: 43789 - DNA, 732 bp, Panicum virgatum
  misc_feature: Ceres CLONE 2018226
  misc_feature: Encodes the peptide sequence at SEQ ID NO. 43790
agatcagatcggcgaaagcccaaatcccaagcagaggagcgaaatctcgagcgctcgtgccggcgaagaccacgagaaggaggccgcggcacgagagctccccaggcatctgtttctcttcgcagcaccagcggcatcggcgtcagcagcggcagcaagagggagatgtctgcgttcagcggcgatgagaccgcccccttcttcggcttcctcggcgccgccgccgcgctcatcttctcatgcatgggggcggcgtacgggacagccaagagtggcgtaggcgtagcgtccatgggtgtcatgcgccctgagctcgtcatgaagtccatcgtgcccgtggtcatggctggtgtgctcggtatctacggcctcatcattgccgtcatcatcagtactgggatcaaccccaaggccaagccatactacctcttcgacggctatgcccacctgtcgtctggcctagcctgtggtcttgctgggcttgccgccggcatggccattggcattgtcggtgatgctggtgtgagggctaacgctcagcaacctaagctgttcgtgggcatgatcctcatcctcatttttgccgaagcacttgccctctacggtcttatcgtcggcatcatcctctcatcccgcgccggccagtcccgtgcagactaggcacgttccagatgtcgataccatgcctggccctggctggggcttgttttatattcatgagacaagaagctg

SEQ ID NO: 43790 - protein, 164 aa, Panicum virgatum; identical to SEQ ID NO: 40074
  misc_feature: Ceres CLONE 2018226
  misc_feature (92)..(157): Pfam Name: ATP-synt_C Pfam Description: ATP synthase subunit C
  misc_feature (13)..(78): Pfam Name: ATP-synt_C Pfam Description: ATP synthase subunit C
  misc_feature: SWISSPROT Homolog: EC 3.6.3.14 H(+)-transporting two-sector ATPase

SEQ ID NO: 43791 - DNA, 698 bp, Panicum virgatum
  misc_feature: Ceres CLONE 2018231
  misc_feature: Encodes the peptide sequence at SEQ ID NO. 43792
aactaacgatacgcccatggccgccgccgccgtgctgcccctcctccttttgctggccgccgcctcgccggcgtccgcggtggcgggcggcgacaagcagacgcacatcaagctgtactggcacgacgtgctgagcggtgcgagcccgacggcggtgcgggtggcgagcgccgccgtcaccaacacctccaagacgagcttcggcgccgtggtggtgatcgacgacccgctcaccgagggccccgacctcaactcctccaccacgcccctcggccgcgcccagggcacctacatctccgccggcaaggacgaggtggccctgctcatgaacatgaactccgtcttccaggccggcgcctacaacggcagcaccgtcgccatcatgggccggaacccggtgttcgactccgtccgggagatggccgtcgtcggcggcaccggcgtgttcaggatggcgcgaggctacgcgcaggcacggacgcacacactcgatctcaacaccggcgacgccaccgtcgagtacaacctctacatcaaccactgatcatgcttccgagtgctctgctctgttccatccatcgtgcgcagcagtaatacaatacaggctttgatttgtgctttagtttgggggcatgaacgaattttatattcataattcatgggagaagaatcaagctcgaattcctagattttcccta

SEQ ID NO: 43792 - protein, 175 aa, Panicum virgatum
  misc_feature: Ceres CLONE 2018231
  misc_feature (9)..(175): Pfam Name: Dirigent Pfam Description: Dirigent-like protein
MAAAAVLPLLLLLAAASPASAVAGGDKQTHIKLYWHDVLSGASPTAVRVASAAVTNTSKTSFGAVVVIDDPLTEGPDLNSSTTPLGRAQGTYISAGKDEVALLMNMNSVFQAGAYNGSTVAIMGRNPVFDSVREMAVVGGTGVFRMARGYAQARTHTLDLNTGDATVEYNLYINH

SEQ ID NO: 43793 - DNA, 694 bp, Panicum virgatum
  misc_feature: Ceres CLONE 2018232
  misc_feature: Encodes the peptide sequence at SEQ ID NO. 43794
aacgaaaccctaagcagtgaaggccccggtagctgccatcaccgtcgatctggcgatctcccatattccgaagacagcaactcggctgaaggcggaggagaaagcaggcgccaggtagccgccgccggagcaggagaagatgatactcccggtggcgaagctcgggacgctgttgctgaagacgatgtcgaagcccatcgcaaccaggctcaagacggaggccagccgccaccccaagttccggcagctcatcatcaacctcgcgcaggcaaatcaccgcatctccacaaacatccaaagaagagtctatggtcatgcaactaatgttgagattcgtccgttgaatgaggagaaggctgttcaagctgctgccgatcttattggggagctcttcgttttctcggttgctggagctgccgtaatttttgaggtgcaaagaagtgcaaggtcagaggcccgaaaagaggaggcccgtaaaaatgaaattgaggcaataaggcaaaaggaggatcagctggctgaagagatattgactatgaagcagaaacttagtgagttggagcgcctcgccaactctcgaggtctctctggactgttcaggagcagcagtgtgccagaccaaataaagcccacatgaccagtttgtttgactggaacaaaattacccttaatgggatctaaccaggtgaatcga

SEQ ID NO: 43794 - protein, 165 aa, Panicum virgatum
  misc_feature: Ceres CLONE 2018232
  misc_feature (4)..(136): Pfam Name: OPA3 Pfam Description: Optic atrophy 3 protein (OPA3)
MILPVAKLGTLLLKTMSKPIATRLKTEASRHPKFRQLIINLAQANHRISTNIQRRVYGHATNVEIRPLNEEKAVQAAADLIGELFVFSVAGAAVIFEVQRSARSEARKEEARKNEIEAIRQKEDQLAEEILTMKQKLSELERLANSRGLSGLFRSSSVPDQIKPT

SEQ ID NO: 43795 - DNA, 736 bp, Panicum virgatum
  misc_feature: Ceres CLONE 2018243
  misc_feature: Encodes the peptide sequence at SEQ ID NO. 43796
gcccgttcgtgtctcccccctgttcaatcaatcgttcccccacctcgcctcgctagggtttcctccgccgcagttccagtcgctaccatgcctcgccgcagctcaggaaggtcagcaccacgccctgctccgcgtgctgctcctatgaggaacccaccacagccagcacgccaggctcctcctccagcccctgctcagagtggtggtggctccatccttggaggaattgggtccacaattgctcaaggtatggcgtttggtactggcagtgccatggcacacagagctgttgatgctgtaatgggcccccgtaccattcagcatgagactgttgtctcggaggctgctgctgctgctcccgcttctccaatgatgaacgctgatgcttgcggcaaccattctaaggccttccaagattgtctcaaccactatggcagcgacatcagcaagtgccagttctaccttgacatgctgaacgagtgccgccgcggtggcgcaactgcataagctgctgcttcattggagttgattcgtgggtttccttttcactttcatgatatcttattaataagactaagttgaaactatgaactacagccacaacttggatgttttgtgtgccgtgaccactatcactggtgcatgaggttgtggttatgttctgtcgtcctgggagtagtacattctgctatcctatattgttggtccagacttgtatggcaccgatgattataat

SEQ ID NO: 43796 - protein, 139 aa, Panicum virgatum
  misc_feature: Ceres CLONE 2018243
  misc_feature (94)..(135): Pfam Name: CHCH Pfam Description: CHCH domain
MPRRSSGRSAPRPAPRAAPMRNPPQPARQAPPPAPAQSGGGSILGGIGSTIAQGMAFGTGSAMAHRAVDAVMGPRTIQHETVVSEAAAAAPASPMMNADACGNHSKAFQDCLNHYGSDISKCQFYLDMLNECRRGGATA

SEQ ID NO: 43797 - DNA, 704 bp, Panicum virgatum
  misc_feature: Ceres CLONE 2018245
  misc_feature: Encodes the peptide sequence at SEQ ID NO. 43798
caagctcgtgcatcaaaaagcatcatcacttcatcagctcgctagctagcagcggcagcaatggcgttcgccaagctctccgcggtgctggtcctcgccgccgtgctcgcgctctcctcctcgccgctcgccctcgcgtgggagaaagcggaaacagagtgcggctcgtgccagaaaggcacgccgccctcggccggcgggctcccgttgccccccgtcaccctgccatccgtccctctgccgtcgatgcccctgccaccagtcgccgtgccgtcggtgcccctgccgccggtcgccgtgccgtcgctccccctgcccccgttgccgaagctccccgtgcccgtcccgccgatcatcggtgggagcccgccgacgaagacgcccggcggccggaaggcgtgcccgccgcctccgacgcccacgcccccgaccccgacgcccccgccgtcctcggacaagtgccccatcgacgcgctgaagctgggcgcgtgcgtggacgtcctcggcaacgaggtgcacatcggcgacgccaacgtcaagtgctgcccgctcgtgaagggcgtcgccggcctctcggccgcggcgtgcctgtgcaccgccctcaaggccaaggtgctggacctctccgtctacgtgcccatcgcgctcgaggtgctcctcaactgcggctgcgccgtcccgcccggctacaaatgcgcttaaac

SEQ ID NO: 43798 - protein, 213 aa, Panicum virgatum
  misc_feature: Ceres CLONE 2018245
  misc_feature (134)..(212): Pfam Name: Tryp_alpha_amyl Pfam Description: Protease inhibitor/seed storage/LTP family
MAFAKLSAVLVLAAVLALSSSPLALAWEKAETECGSCQKGTPPSAGGLPLPPVTLPSVPLPSMPLPPVAVPSVPLPPVAVPSLPLPPLPKLPVPVPPIIGGSPPTKTPGGRKACPPPPTPTPPTPTPPPSSDKCPIDALKLGACVDVLGNEVHIGDANVKCCPLVKGVAGLSAAACLCTALKAKVLDLSVYVPIALEVLLNCGCAVPPGYKCA

SEQ ID NO: 43799 - DNA, 1003 bp, Panicum virgatum
  misc_feature: Ceres CLONE 2018247
  misc_feature: Encodes the peptide sequence at SEQ ID NO. 43800
aacattccacatcactctatcatcgtccatccatcctttcaattaagttgttgatacaaaaaaagaagaggatctgaggatggcggtgccaactccagagttcacggattcctttctggtgcaggacctgaacaacaactacggcgtcttcatcggcatcgtccggaagaacgtgatcaggtactgcagcgaccggcgtcccggcatcgtgcagccggtgctgccaccggagcagaaagtccccaggtactggttccacgtcctcctccgcaccagcaccagctccctcacgctcgccatacgtatggacaacctctacctggtgggcttcaagacccaggccggggtgtggtgggagttcaacaacgaggacaagaagcacctcatcagggacgcccagtggctcggcttcggcggccggtaccagaaccttatcggccagaaggcactggagacagtctcgctgggccgcggccagatggccgccgccgtcaatgccctggcgaactatggcaccaagatcctggaggaacagctgcagcagggcatcctagcattggaggaggaagagctgctgcaggccggtcgggctgacccgaccgccgtggccaagagcatgctggccaagctgctgatcatgatatgcgaggggctgcgcttcatcaccgtgtccggcacggtgggcaaggaattcgagaatcctgcggcgacgataacccagcagcaggggaagcaagtgactaattgggataggatctcggcggcggttttcgaatgggccaaggaccccaacgccaagttcccagagctggagccgctaggcgttaagaataaagatgacgcagccaaggtcgtcgcgctcgtcaaggatcagaactagtaccgatggtgttatcattctagtattttctatgactatgccgtatgcgagcgtgctactccggacagtattgtaagaacaaataaatacaccgcccgtacgtggtgttcctactgtacgttc

SEQ ID NO: 43800 - protein, 266 aa, Panicum virgatum
  misc_feature: Ceres CLONE 2018247
  misc_feature (3)..(266): Pfam Name: RIP Pfam Description: Ribosome inactivating protein
  misc_feature: SWISSPROT Homolog: EC 3.2.2.22 rRNA N-glycosylase
MAVPTPEFTDSFLVQDLNNNYGVFIGIVRKNVIRYCSDRRPGIVQPVLPPEQKVPRYWFHVLLRTSTSSLTLAIRMDNLYLVGFKTQAGVWWEFNNEDKKHLIRDAQWLGFGGRYQNLIGQKALETVSLGRGQMAAAVNALANYGTKILEEQLQQGILALEEEELLQAGRADPTAVAKSMLAKLLIMICEGLRFITVSGTVGKEFENPAATITQQQGKQVTNWDRISAAVFEWAKDPNAKFPELEPLGVKNKDDAAKVVALVKDQN

SEQ ID NO: 43801 - DNA, 644 bp, Panicum virgatum
  misc_feature: Ceres CLONE 2018275
  misc_feature: Encodes the peptide sequence at SEQ ID NO. 43802
aacccaaatcctccagcctgccagcacaactccgctatcccgagctcatcggaaggcagtaatcgtgcacaatctccatggcccgcacgaagcagacggcgcgcaagtccaccggcggcaaggccccgaggaagcagctggcgaccaaggcggcgcgcaagtcggccccggcgaccggcggcgtgaagaagccgcaccgcttccgcccgggcaccgtcgcgctcagggagatccgcaagtaccagaagagcacggagctgctcatccgcaagctgccgttccagcggctggtgcgggagatcgcgcaggacttcaagaccgacctccgcttccagagctccgccgtcgccgcgctgcaggaggccgccgaggcatacctcgtcgggctcttcgaggacaccaacctctgcgccatccacgccaaacgcgtaaccatcatgcccaaggacatccaactcgcgcgccgcattcgtggcgagagggcctagagtgccacatctggggggacttgtagagatgatgcgtttcgttcgtcgtggttctgtggtcagatagatgtttcaaatctgttcgtgattcgtgtgatctagtacctgatgttactatctcagtattgtcggcaatggaaaagtttgtttcggctg

SEQ ID NO: 43802 - protein, 136 aa, Panicum virgatum; identical to SEQ ID NO: 10238
  misc_feature: Ceres CLONE 2018275
  misc_feature (58)..(132): Pfam Name: Histone Pfam Description: Core histone H2A/H2B/H3/H4

SEQ ID NO: 43803 - DNA, 715 bp, Panicum virgatum
  misc_feature: Ceres CLONE 2018303
  misc_feature: Encodes the peptide sequence at SEQ ID NO. 43804
aacactgccacagcagccgtgtccacctcacgtatgatctgtagccactcatagtcatagacgctagctgcttagcctgtgctgccgtagctgtcctgctgtcctttactctgcctgcctgcctgattgcccctcgcgcctctgagcggccgccatggatatctggaagtccaaggtgctgcccaagatcaagctcgtcttcgccaagtccgccggcaagaaggccgccgccgccgccgagctcgtcaagtccttcgacgagtccaaggaggggatcaatggccagttcgaggagaagaaggcggatctccagcctaaggtcgtcgagatctacgagtctgttcctgccccgctcaaggttctgatcaaggagaggagcaaggtgtccgggatcaagaagaactcggccgccatcaccaagttcttcgaggatctggccaagatcgagttccctggcgccaagcaagtgagcgagggcatctccaaggtcggcccggccctgctgtccggccccatcttcgccacgttcgagaaggtctcctccctgctccctgccgccgccgaggaggcagccgagaagaacgccgccgccgccgctgtcgaggagaagaaggaggaagcgccggccggtgagaagaaggaagaggctccggcagccacggagtagaagaaagaggacgcggctcctgcagccgccgaggagacaaccacagcc

SEQ ID NO: 43804 - protein, 170 aa, Panicum virgatum
  misc_feature: Ceres CLONE 2018303
  misc_feature (1)..(170): Pfam Name: DREPP Pfam Description: DREPP plasma membrane polypeptide
MDIWKSKVLPKIKLVFAKSAGKKAAAAAELVKSFDESKEGINGQFEEKKADLQPKVVEIYESVPAPLKVLIKERSKVSGIKKNSAAITKFFEDLAKIEFPGAKQVSEGISKVGPALLSGPIFATFEKVSSLLPAAAEEAAEKNAAAAAVEEKKEEAPAGEKKEEAPAATE

SEQ ID NO: 43805 - DNA, 655 bp, Panicum virgatum
  misc_feature: Ceres CLONE 2018304
  misc_feature: Encodes the peptide sequence at SEQ ID NO. 43806
aaaacttcccaaagctcgcggcggcttccttccacacccctcgcttcccccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgtcaagctcatcttcatccccatcaacaacatcatcgtcggttccagctagacctcgagtcccggagaagtgcagaacgagtgactagcatgggtgtagtgcaatacttttgaggagagcaaaggataacgacgtttttcgcaaagtattgtaaaagacagtttctcatttgtgtttttggagtaatcctcatactgtttaagaattcaggatgcctgtatacccgattctgagtagacatgcactctgttcgcagcaaccagccaacactcacaccaaaccagcaccagccagcagtcgccagccagtagtacttttctctcacaacaaatcagcaccagcgacagcacaacaaacagaggtatggatgaagtagcgagttgtgaaaaaaaataatatattgtcgtcccgtt

SEQ ID NO: 43806 - protein, 69 aa, Panicum virgatum
  misc_feature: Ceres CLONE 2018304
  misc_feature (10)..(66): Pfam Name: SecE Pfam Description: SecE/Sec61-gamma subunits of protein translocation complex
MDAIDSVVDPLRDFAKDSVRLVKRCHKPDRKEFTKVAARTAIGFVVMGFVGFFVKLIFIPINNIIVGSS

SEQ ID NO: 43807 - DNA, 687 bp, Panicum virgatum
  misc_feature: Ceres CLONE 2018306
  misc_feature: Encodes the peptide sequence at SEQ ID NO. 43808
gaaggtggtgcggcgcgtgggaggcgaggggaagctgccggcggagctgatgaagtcggtgaaagacatgctccccgacagcaaggtcgtcatggggcgggccaagcgcggcatcttcgccggccgccacatccagttcgggaacaaggtctccgaggacggcggcaacaaatcaaggcgatcatggaagccaaatgttcaggagaagcgtctcttcagctatattcatgaccgtcacattagagttaaggttaccacacatgcacttcggtgcattgacaaagctggtggtatagatgaatacctcctgaagacaccttacagcaaaatggatactgagatggggatagcgtggaaagcaaagattgaaaagatgtattcagagctggctgaaatggaagtaggcttcttccctcctgaggaagaggctaaaattgaacagggctttgacgaggtccgtgctgccaagagagatttccgtagggaagcaagaagagctttggcaaagcaaaggcagttagaagcgggtaaagaccaaacaactgaagtcacagacaaaaaggaagaggtatctgctactgctgctgcagcttgaatctgaacctttgtacctgtcttgaatgataaatggaggcagcaaaacattggttgtttctgggcaaataatggaaggcttactcttgatat

SEQ ID NO: 43808 - protein, 197 aa, Panicum virgatum
  misc_feature: Ceres CLONE 2018306
  misc_feature (35)..(96): Pfam Name: Ribosomal_L28 Pfam Description: Ribosomal L28 family
KVVRRVGGEGKLPAELMKSVKDMLPDSKVVMGRAKRGIFAGRHIQFGNKVSEDGGNKSRRSWKPNVQEKRLFSYIHDRHIRVKVTTHALRCIDKAGGIDEYLLKTPYSKMDTEMGIAWKAKIEKMYSELAEMEVGFFPPEEEAKIEQGFDEVRAAKRDFRREARRALAKQRQLEAGKDQTTEVTDKKEEVSATAAAA

SEQ ID NO: 43809 - DNA, 750 bp, Panicum virgatum
  misc_feature: Ceres CLONE 2018316
  misc_feature: Encodes the peptide sequence at SEQ ID NO. 43810
acactcgcttcgcttccccattctctcgctctccaatcatggtggcgatggcggcgatggggcgagcggcggcagcggacgaggaagaggacgtggagttcgtcgactacgaccaggatgacgaggacgccatggaggaggacggccctgccgcccgcgcactccccgtgccccacatcgtctcccccgccgtggtgcgcacccgcgggcgcttcgccggccgcagcccatccatcctcgcctccagccgcaaccgcttcgactccctcaccaacgacggcgaccagggacatggcccgcagcgctctattgaaggatggacaattcttgtctgtggagttaaagaagatgtagaagaaggagatctgcatgacattttcagtgaatttggtcgtgtcaaggacttgcatttgaatctagaacgccgcactggatatgccaagggatatgcgctgattgagtatgaaagctttgaggaagcacaggctgcgatcagagcaatgaatgggagtcagctgttgacaaagactgtctatgttgattgggcattcagcagaggtcctataaagaatgtcatgtgtacaaggccaccacgcccaagatcaaggactccaccgcgcaggcttgctgccttgacaccttattgagggggagtgcctaggttatttgtcagttctaactgatcatgtttgggcgatgagcagcagctaaacaatgtggaagtatcgtttagaacttgaacctcgattc

SEQ ID NO: 43810 - protein, 202 aa, Panicum virgatum
  misc_feature: Ceres CLONE 2018316
  misc_feature (96)..(167): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MVAMAAMGRAAAADEEEDVEFVDYDQDDEDAMEEDGPAARALPVPHIVSPAVVRTRGRFAGRSPSILASSRNRFDSLTNDGDQGHGPQRSIEGWTILVCGVKEDVEEGDLHDIFSEFGRVKDLHLNLERRTGYAKGYALIEYESFEEAQAAIRAMNGSQLLTKTVYVDWAFSRGPIKNVMCTRPPRPRSRTPPRRLAALTPY

SEQ ID NO: 43811 - DNA, 511 bp, Panicum virgatum
  misc_feature: Ceres CLONE 2018340
  misc_feature: Encodes the peptide sequence at SEQ ID NO. 43812
ctaccctatcctgcctcgccgcctaccccgagcagccgagcgaggaaccgaaccactcctccccacaccaccggaggagcaccatggcggcggcgggagtttacggtgggctcgaggggaatcttggcgtccaggacgcccacgacctgccgctctaccgcatccgcatatccctgacctcctagaacgtcaagaacttggaagaattttgtgcggatttggtgaacgggagccaacgacaagcagactgggggtgaagggacctgtcacgatccctactaaggttctcctcatcatcacccgcatgtccgcttgtggtgaaggaacaaacacatgggagtcgctttgacttccgcatcccctagacggtgattgacctgatcagctcccctgatgtggtgaagcaaatcacctccatcacgatctagcctggtgtctaggtcaaagtgaccatccctgacttgtcatggcatgcactttagatctgtcatcttatatcttgctttgcttt

SEQ ID NO: 43812 - protein, 33 aa, Panicum virgatum
  misc_feature: Ceres CLONE 2018340
  misc_feature: Functional homolog of the protein sequence given in SEQ ID NO 50532
  misc_feature: Useful for making plants with modulated biomass
  misc_feature: Useful for making plants with modulated flowering time
MAAAGVYGGLEGNLGVQDAHDLPLYRIRISLTS

SEQ ID NO: 43813 - DNA, 725 bp, Panicum virgatum
  misc_feature: Ceres CLONE 2018347
  misc_feature: Encodes the peptide sequence at SEQ ID NO. 43814
gtccattccgagctctcgctttgaaaccgaaccagctcacaccacccagctgccgtttctagagaatcccctgcgtttcgagatcccggtcgccacgatgcctgccctcgccaagcccgcctcgcgccccgccaagaccgccgcggcgccgaagccgaagcccgccgccgccaagcccaaggtcgcggccggcgccggcgcctcccacccgccctacttcgagatgatcaaggaggcgatctcggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcctacaagctctccgacgccgccaagaaggaggcccccaaggccaagcccgcagccgccaagaccgtcgcggccaagccggccaaggccgccgcgaagccgaagaagaccgcggccgccgccgccgggaccaagcgcaaggcgccggagaagaaggtcgtggcgaagccgaagaagtcccccgcggcgaaggccaaggccaagcccaagactgtcaagtcccccgcctccaagaaggcccggaaggtcgccgcatgagatggttccataggtcggagctctgattgtggtgtggttgtccctagggagttgtacaaatgaagtgcgt

SEQ ID NO: 43814 - protein, 185 aa, Panicum virgatum
  misc_feature: Ceres CLONE 2018347
  misc_feature (36)..(106): Pfam Name: Linker_histone Pfam Description: linker histone H1 and H5 family
MPALAKPASRPAKTAAAPKPKPAAAKPKVAAGAGASHPPYFEMIKEAISALKERTGSSSHAIAKYMEDKHGPSLPANYKKMLSIQLRGFAAKGKLVKVKASYKLSDAAKKEAPKAKPAAAKTVAAKPAKAAAKPKKTAAAAAGTKRKAPEKKVVAKPKKSPAAKAKAKPKTVKSPASKKARKVAA

SEQ ID NO: 43815 - DNA, 985 bp, Panicum virgatum
  misc_feature: Ceres CLONE 2018349
  misc_feature: Encodes the peptide sequence at SEQ ID NO. 43816
accggcacacttcaattccacacaaaactttcctcatcatcatcatcttcgtcttcctctcctcctcgtcctctctccagctgctgtggtcatattttctctctcctcttcctctgccaagaacaccggccggtcggctagcagctcgtgctcccatggagatcgacgccgagaacctcagcaccacctcggcctcggcctgccgggaaccagcagcggcgacgccgagcgcccgaagaggccggcgccctccgtcggcgccaagcgcgcgctcgacgacacccggagcgaggcctcgggcaccagcccggctgccgggggcgaccacgacgccgccacgcctgccaaagcgcaagtggtggggtggccgccggtgagggcgtacaggaagaacaccttccaggcggcggcggcggcgaagaaggccgagcagccgggagggctgtacgtgaaggtgagcatggacggggcgccgtacctcaggaaggtggacctccggatgtacaagaggtaccgggagctcagggaggcgctggacgccctcttcaccaagtccttctccgccgccgccggagcggagggcggtgacggccagcacgccctcgcctacgaggacaaggacgtcgacctcatgctcgtcggagatgtgccctgggacatgttcatctcttcgtgcaagaagctcaggataatgaagggttctgaggccaggtgaccgctgatgcacaggcagaggctgcaaactcatggggatgaatcgaggagcacagatcgtgcaaaggagctgtgtggcttggactctccagtgctgtacaaagagatggttgtttctgaaaccaagaaggaggaggatctatgaattgtgtatatagtcttaggctcttagttagccgccttgtttttcgagttgtgttttgtatgagcgaaggctgtaaaaaactgaaaaagaaaaaaagaagaagagaaacttgacttaagtttggtc

SEQ ID NO: 43816 - protein, 237 aa, Panicum virgatum
  misc_feature: Ceres CLONE 2018349
  misc_feature (63)..(237): Pfam Name: AUX_IAA Pfam Description: AUX/IAA family
  misc_feature: The sequence is a functional homolog of SEQ ID NO 636 in the 11/479,226 US patent application
  misc_feature: Functional homolog of the protein sequence given in SEQ ID NO 50516
  misc_feature: Useful for making plants with altered terpenoid content
  misc_feature: The sequence is a functional homolog of SEQ ID NO 652 in the 11/479,226 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Functional homolog of the protein sequence given in SEQ ID NO 50147
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 656 in the 11/479,226 US patent application
PAHFNSTQNFPHHHHLRLPLLLVLSPAAVVIFSLSSSSAKNTGRSASSSCSHGDRRREPQHHLGLGLPGTSSGDAERPKRPAPSVGAKRALDDTRSEASGTSPAAGGDHDAATPAKAQVVGWPPVRAYRKNTFQAAAAAKKAEQPGGLYVKVSMDGAPYLRKVDLRMYKRYRELREALDALFTKSFSAAAGAEGGDGQHALAYEDKDVDLMLVGDVPWDMFISSCKKLRIMKGSEAR

SEQ ID NO: 43817 - DNA, 954 bp, Panicum virgatum
  misc_feature: Ceres CLONE 2018350
  misc_feature: Encodes the peptide sequence at SEQ ID NO. 43818
ctttctctctctagccccgcacaaatctctcctccccccttctcgccctcgccgcattgcccgccgacgaccccccgccggatagagaggaggaggagcggcgcggctgcgggagaagcgggcggcggcggagcgggcggcatgtgcgacctggtggcccgcacgggccggcatcagcagcggtacgaggatggccgtcggctagtggccggatgcataccatttaggtatagaactaataatgatgaaacctctgatgatgaacataagaaacttgtggaagttctcatgataaattcccaaagtggacctggtcttttgtttccaaagggaggatgggagaacgatgaaactgttgaagaggcagcagctcgagaagctatagaagaggctggagttcgaggtgatatagtgcatcttctggggttttatgactttaaaagcaagacacatcaagatgcgtgctgtcctgagggtatgtgcagagctgccgtgtttgcactgcatgtgaaggaagagctgacctcatggcctgagcagagcacccggcagagaacctggctcacggttcctgaagctgcatcacagtgccggtaccagtggatgcaagaggccctgctcacaggcttctctgattggcacaagtggagcagaggtggcggtggtactaactgtgacccagcctaaccgctgagtccatcaggagaactccaatttcatcttctctttccctaggctccaactttgcagaatgcaataatacagtgtacttctcttgtgtctgggtaggccattgacccttgatgtcacatgtcaggatggttatctagtttagtgggatgtggtatatctcatcaagacgagaattctcacaacttttaagtgtcgattctcgcgcttattatttctcggtttcagctgctgttgttgcggtgctgcaaggacgcgccgtgc

SEQ ID NO: 43818 - protein, 181 aa, Panicum virgatum
  misc_feature: Ceres CLONE 2018350
  misc_feature (19)..(165): Pfam Name: NUDIX Pfam Description: NUDIX domain
  misc_feature: SWISSPROT Homolog: EC 3.6.1.52 Diphosphoinositol-polyphosphate diphosphatase
MCDLVARTGRHQQRYEDGRRLVAGCIPFRYRTNNDETSDDEHKKLVEVLMINSQSGPGLLFPKGGWENDETVEEAAAREAIEEAGVRGDIVHLLGFYDFKSKTHQDACCPEGMCRAAVFALHVKEELTSWPEQSTRQRTWLTVPEAASQCRYQWMQEALLTGFSDWHKWSRGGGGTNCDPA

SEQ ID NO: 43819 - DNA, 686 bp, Panicum virgatum
  misc_feature: Ceres CLONE 2018354
  misc_feature: Encodes the peptide sequence at SEQ ID NO. 43820
acaagcacacagccgctcagttcttcttgtctaataggctaactagctagttcctccctcctcccctccgtctctccctctctcctattcatgttctctctcacctcgatcgcagcttgagagagacttgtgcaacaaaaattagagagagagagataggagatacacgagagatcgatcgatcatgtcgatgagcttcttgagcatggtggaggcggagctggcaccggggttccggttccacccgagggacgacgagctcatctgcgactacctcgcgcccaagctcggcggcaaggtcgggttctccggccgccgcccgcccatggtcgacgtcgatctcaacaaggttgagccatgggatctccctggtgagtccaactcgatgaaccgcccatctatatccctctaaagtttcgatccttttgtctcctcaattgttccttcttgttaatagccatgacttctttcaccaagttgatgggcgtgcacacacagagagagagagaggattccctattgcacaaaaaggatcctttaatttgatttttttccccatcggatgatcgaatatatatatatatatatatatatatatatatatatatatatatatatatatatatatatatatatatatatatatatatatatatatatatatatatatatatatatatatatat

SEQ ID NO: 43820 - protein, 75 aa, Panicum virgatum
  misc_feature: Ceres CLONE 2018354
  misc_feature: Functional homolog of the protein sequence given in SEQ ID NO 51050
  misc_feature: Useful for making plants with altered lignin content
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 612 in the 11/435,388 US patent application
MSMSFLSMVEAELAPGFRFHPRDDELICDYLAPKLGGKVGFSGRRPPMVDVDLNKVEPWDLPGESNSMNRPSISL

SEQ ID NO: 43821 - DNA, 974 bp, Panicum virgatum
  misc_feature: Ceres CLONE 2018366
  misc_feature: Encodes the peptide sequence at SEQ ID NO. 43822
gaaaaatcctaggctcatttccgtttccctccctcctttccgttcgaacgacgaaatcaaatccccactctccattcccaaatctccgaaccctagcccccccaatctccgatcccgccatgcccctgcacgctgacgaagacgccggcgccagcgacgccggcgcgcgcctcttcgccggcgtccgcttcgcgctctacggcttcaacacacactccgagtcccagtaccgcttagagatggtacggtgcggcggcgtccacgtcggggcttgggacggagactgcacccacgtcatagtttccaacaccttatatgatgaccccgtgtgcgtggcggcgcggttggacaagaagaaggtcgtcaccgaccaatgggtggaagacagcttcgaacttggagaattggctgacgccgatcgggtattatatgcgccaatcagagatcccaatggcattccgggtagtgatcaacttcacatttgcctcacagggtaccagaagaattggcgcggagacataatgaaaatggtttctttgatgggagcacacttctccaagtctttgagaggaaacgaagacacccatctcatttgctacaaatttgaaggtacttcttcatagttttgtatactgtatacttttcactgaacttgtgttgcaattagtgtacttcattgtgtactcattagtctccttatctctttttgttggaccatttagagatgtacgtccatctgttcaatgcattgcattggcaattttgaggctcatttctcctccattttcttataaaaggcgccaacatgttgatttatgggcgctgctggtagttgtttgcattgacaatacaaatttcgatctttcttttttgtctttggtttggcttactttcaacaagaatgcaataatttaaccaaagcattcctctgaacattctcttgaaaagcttaacctgaaaattattctactttc

SEQ ID NO: 43822 - protein, 167 aa, Panicum virgatum
  misc_feature: Ceres CLONE 2018366
  misc_feature (14)..(91): Pfam Name: BRCT Pfam Description: BRCA1 C Terminus (BRCT) domain
MPLHADEDAGASDAGARLFAGVRFALYGFNTHSESQYRLEMVRCGGVHVGAWDGDCTHVIVSNTLYDDPVCVAARLDKKKVVTDQWVEDSFELGELADADRVLYAPIRDPNGIPGSDQLHICLTGYQKNWRGDIMKMVSLMGAHFSKSLRGNEDTHLICYKFEGTSS

SEQ ID NO: 43823 - DNA, 689 bp, Panicum virgatum
  misc_feature: Ceres CLONE 2018367
  misc_feature: Encodes the peptide sequence at SEQ ID NO. 43824
aatctctcacgccaccccctccttcctcctgctcccaacccgtgtgccaccccagccgccggccatggcctgcctcaccgacctcgtcaacctcaacctctccgactccactgagaagatcatcgccgagtacatatggatcggtggatctggcatggatctcaggagcaaggccaggaccctccccggacctgtaagcgatcccagcaagctgcccaagtggaactatgatggctccagcaccgggcaagctcccggcgaggacagtgaggtcatcctatacccacaggccatcttcaaggacccattcaggaagggcaacaacatggacccctacgtggtgacctccatgatcgccgataccaccatcatctggaagccctgaacgcgtcccacctcaccaggatttggcgatcgcgctgtggcccgggggaaacaattcatcttctgattcaagcaaagcgtctcatttccttcccgtcgtattctgttccatttggttacactctactactactattactacagcatttagttaggtctgggtctgttcatttcacctctcgggtgagtgatgatcatagtggcaagtggtgtgaaggacaatgacattgttgcttgcttccttgctgggtggtcctgtgtaatcccacaataatggccgtaccacaggtgtggtacttttcagt

SEQ ID NO: 43824 - protein, 106 aa, Panicum virgatum
  misc_feature: Ceres CLONE 2018367
  misc_feature (17)..(100): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MACLTDLVNLNLSDSTEKIIAEYIWIGGSGMDLRSKARTLPGPVSDPSKLPKWNYDGSSTGQAPGEDSEVILYPQAIFKDPFRKGNNMDPYVVTSMIADTTIIWKP

SEQ ID NO: 43825 - DNA, 677 bp, Panicum virgatum
  misc_feature: Ceres CLONE 2018373
  misc_feature: Encodes the peptide sequence at SEQ ID NO. 43826
actattcgcctttccgcacccgccgctcggtcgccttcgagttccaccagccaccaaacccgccggggagaagtcgagaggagcaagtcgccgagaagaggagatggcccgtacgaagcagaccgcccgcaagtccaccggagggaaggcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcaccatcatgcccaaggacatccagctcgcccgccgcatccgcggcgagcgcgcgtaagccgctgccgtaccagtagtggagatggaggaggtcaagatggaatcggcttgttgatctccgccgctgcgcttagtggatctggatttagctgtactagttgtcgttctcgatttggttagtgtaaaaacaggtttacaagtctattttgtgcttcgctgct

SEQ ID NO: 43826 - protein, 136 aa, Panicum virgatum; identical to SEQ ID NO: 9871
  misc_feature: Ceres CLONE 2018373
  misc_feature (58)..(132): Pfam Name: Histone Pfam Description: Core histone H2A/H2B/H3/H4

SEQ ID NO: 43827 - DNA, 336 bp, Panicum virgatum
  misc_feature: Ceres CLONE 2018381
  misc_feature: Encodes the peptide sequence at SEQ ID NO. 43828
accattacagtacgcgctccggctgacgcgccccgcactctcacacaaaagctcaagtcttgcgctcgctcgctcgcggctacatctacaatggagcgcttccagctcgcggccctggccatggccatgctcttcggctcggcgggggcccacgccccggccgcccccccgaccccggcgcccagggcggccccccctccggccacgcctccgcctaccccggcgccggagacttcgcccgcaccagcccgcaccgggacaaacacggccccccggccatcaacatccgccccaccgctcaggtgagccccgtgccgccgccggagggcaaggagc

SEQ ID NO: 43828 - protein, 71 aa, Panicum virgatum
  misc_feature: Ceres CLONE 2018381
  misc_feature: Functional homolog of the protein sequence given in SEQ ID NO 50206
  misc_feature: Useful for making plants with altered carbohydrate content
MERFQLAALAMAMLFGSAGAHAPAAPPTPAPRAAPPPATPPPTPAPETSPAPARTGTNTAPRPSTSAPPLR

SEQ ID NO: 43829 - DNA, 670 bp, Panicum virgatum
  misc_feature: Ceres CLONE 2018383
  misc_feature: Encodes the peptide sequence at SEQ ID NO. 43830
gcatcggtggacctcatggtgatgctggtctcactggccggaagatcatcattgacacctatggtggctggggagcccatggtggtggcgctttctctggcaaggatccaaccaaagtcgatcgaagtggagcctacattgcaaggcaggctgccaagagcatcgttgctaatggccttgctcgccgcgccatcgtccaggtctcgtatgccattggtgtgcctgagccgctctctgtgtttgttgacacatacggtactggcacaatccctgacaaggagatcctcaagattgtgaaggagaactttgacttcaggcctggcatgatcatcatcaaccttgacctcaagaaaggcggcaacgggcgctacctcaagacagcagcctatggtcacttcggaagggatgactctgacttcacctgggaggtggtgaagcccctcaagtgggagaagccttctgcctaaggtgcccttccagaagaagcttttggtctgctgggcttatcatgtggcttctgtgttgtgattcttgatctgccccttgctatcatttgtattgtactgtcgtaataactggtacttgtgagggtattgctgtcttgttatttacgtagaggatttattgtctgctatttctactttcactacttactatgtaatggtcaacc

SEQ ID NO: 43830 - protein, 154 aa, Panicum virgatum
  misc_feature: Ceres CLONE 2018383
  misc_feature (1)..(143): Pfam Name: S-AdoMet_synt_C Pfam Description: S-adenosylmethionine synthetase, C-terminal domain
  misc_feature: SWISSPROT Homolog: EC 2.5.1.6 Methionine adenosyltransferase
  misc_feature: Functional homolog of the protein sequence given in SEQ ID NO 50364
  misc_feature: Useful for making plants with modulated biomass
IGGPHGDAGLTGRKIIIDTYGGWGAHGGGAFSGKDPTKVDRSGAYIARQAAKSIVANGLARRAIVQVSYAIGVPEPLSVFVDTYGTGTIPDKEILKIVKENFDFRPGMIIINLDLKKGGNGRYLKTAAYGHFGRDDSDFTWEVVKPLKWEKPSA

SEQ ID NO: 43831 - DNA, 704 bp, Panicum virgatum
  misc_feature: Ceres CLONE 2018389
  misc_feature: Encodes the peptide sequence at SEQ ID NO. 43832
acatccccacacctcctccttcgtcctctcctcgccgcgacccgccgccgccatggcaccaggcctctacgccgacatcggcaagaagaccagagatctgctgtacaaggactacaacacgcaccagaagttctccgtcaccacctgctccccccacggcgtcgcgattacagctgcaggaacaaggaaaaatgagtccatatttggcgagcttcacacccagattaagaacaagaagttgacagttgatgtcaaagcaaactcagagtcagatcttttgacgacaatcactgtggatgagtttggaacaccagggctcaaatcgattctcagcttggtttttccagaccagagatcagggaagcttgaactccagtacttgcatgcatttgctggtgtgaatgcaagcattgggcttaatcccaaccctatggttaacttctctggtgtctttggaagcaaagcactctcagttggtgttgatgtttcatttgatacggcaactagcaatttcaccaagtacaatgcggcactgagccttaccaatccagatcttattgcttccctccatttgaataaccatggtgataccttggttgcatcatactaccacttggtaaagcatcattcaggcaccgctgtgggggctgagctgtcacacagcttctctagaaatgagagcacgctgatctttggttctcagc

SEQ ID NO: 43832 - protein, 217 aa, Panicum virgatum
  misc_feature: Ceres CLONE 2018389
  misc_feature (2)..(217): Pfam Name: Porin_3 Pfam Description: Eukaryotic porin
  misc_feature: Functional homolog of the protein sequence given in SEQ ID NO 50463
  misc_feature: Useful for making plants with modulated drought sensitivity
MAPGLYADIGKKTRDLLYKDYNTHQKFSVTTCSPHGVAITAAGTRKNESIFGELHTQIKNKKLTVDVKANSESDLLTTITVDEFGTPGLKSILSLVFPDQRSGKLELQYLHAFAGVNASIGLNPNPMVNFSGVFGSKALSVGVDVSFDTATSNFTKYNAALSLTNPDLIASLHLNNHGDTLVASYYHLVKHHSGTAVGAELSHSFSRNESTLIFGSQ

SEQ ID NO: 43833 - DNA, 687 bp, Panicum virgatum
  misc_feature: Ceres CLONE 2018395
  misc_feature: Encodes the peptide sequence at SEQ ID NO. 43834
ggcgctcccgctgctgctctgctctcgcatagggtttatctcctcccctctgcccccgactcgcttctcgcgcacggcagccggattccaaagcgcggccccggcccaggctccagccccgaaggtagtcgttgttcagcggggacactagaatgtcgtcggtgcagctctctggtgctggtgtcgccgccgtggccttcacgaacaagggcctagcctcaccgccgtcggcgctcagggtctgctcgtcgaggcgctctgtccgtagcctggtcgtcagggctgccactgttgtcgccccgaagtacacttcgctgaagcctttaggagacagggtgcttgtgaagcttggggtggctgaggagaagacggttggtggaattttgcttccatcaaccgcgcagagtaagccacaaggaggtgaggttgttgctgttggagcgggaaggaccatcggtgataagaaaatagaggtcggcgtacaggttgggtcagaagttgtgtactcaaagtatgctggaaccgaggttgaattcaacgactccaagcatctcattctaaaagaggatgatatcatcggtattcttgagagcgatgatgtgaaggatatgaagcctctcaatgatcgtgttctcatcaaggttgcagaagctgaggacaaaactcctgggggccttatcctgactg

SEQ ID NO: 43834 - protein, 178 aa, Panicum virgatum
  misc_feature: Ceres CLONE 2018395
  misc_feature (54)..(145): Pfam Name: Cpn10 Pfam Description: Chaperonin 10 Kd subunit
MSSVQLSGAGVAAVAFTNKGLASPPSALRVCSSRRSVRSLVVRAATVVAPKYTSLKPLGDRVLVKLGVAEEKTVGGILLPSTAQSKPQGGEVVAVGAGRTIGDKKIEVGVQVGSEVVYSKYAGTEVEFNDSKHLILKEDDIIGILESDDVKDMKPLNDRVLIKVAEAEDKTPGGLILT

SEQ ID NO: 43835 - DNA, 680 bp, Panicum virgatum
  misc_feature: Ceres CLONE 2018400
  misc_feature: Encodes the peptide sequence at SEQ ID NO. 43836
ccgtcgtcgtgtagctcccatccatcgtgattcgtgacaccattgaccccaaccacctcctccgccacctactcgtccatccgcgccctgcttcccctgcgccgtgagggcggtctcgtcccagatccgcccgatcctgcgcggatccatccttccaccgcatccctccggtccggcgggtggttttctcgaagatttccactgattgtggcggttgattaggataaagctgcatttgatcctcagaaatgatgaacgagtcttttcttgataggatggtttcccagcttcgatcagcatgcaagtactacactggatatcccaaggacctagggccatcaagaattataccattcacatctgagcgtcagtttgtacagctattgcatgaaggaaggcctgtagttgttgcctttactattaagtgcacttatacacagcatcttgataaagtactggaagaggctgccgccacattttatccacatatcaagttcgtcagagttgaatgcccaaagtatccagggttttgcctcacgaggcaaagaaatgaatatccatttgttgaagtattttacaatccagaacaggctgcaagccaaggaaagagcgtggatcctaacatcaccaagtattctgtaaaagtgctacccttcaactatgatcagagcttgtatgga

SEQ ID NO: 43836 - protein, 143 aa, Panicum virgatum
  misc_feature: Ceres CLONE 2018400
  misc_feature: SWISSPROT Homolog: EC 5.3.4.1 Protein disulfide-isomerase
MMNESFLDRMVSQLRSACKYYTGYPKDLGPSRIIPFTSERQFVQLLHEGRPVVVAFTIKCTYTQHLDKVLEEAAATFYPHIKFVRVECPKYPGFCLTRQRNEYPFVEVFYNPEQAASQGKSVDPNITKYSVKVLPFNYDQSLY

SEQ ID NO: 43837 - DNA, 649 bp, Panicum virgatum
  misc_feature: Ceres CLONE 2018411
  misc_feature: Encodes the peptide sequence at SEQ ID NO. 43838
gctacccaaagattggtcttccagcatccactactgcagctagctttggaaaagtgaactcaagcaaactatcagactacaaaatggaggatcttgctgctgctctactgaattctttcacttacaacattggacagatagcctacttcgtggctaatctttcaggcctaaagcgaattttcttcagaggtgcttatgtctgtggtcatgaaaagactatggacaagatctctcgttccctaaaatattggtccaaaggtgaagtccagactacatttctatgtcatgaagggttcttgggaacactgggtgcattttggagttacgaaaacatgggcattgatagcttggcggcgcatgaagtcattagggaggtcttgcttggcgcaccatacactggccaattcccgtctttacctgtcactgaacagcaggagaatggagaaaataatacacttgaaggggaaattgaatgcctacggaataacaacgctgcgcttaaggctgaggttgagcgattacagagggagaacgcagaattgagagctaagctgcaaggtgcaaccttgtgaaccaataaaaggccaagctctgttgtaacctataacagttgagggaatggctcaaaaatgtaactcgtataggaaga

SEQ ID NO: 43838 - protein, 189 aa, Panicum virgatum
  misc_feature: Ceres CLONE 2018411
  misc_feature (1)..(109): Pfam Name: Fumble Pfam Description: Fumble
  misc_feature: SWISSPROT Homolog: EC 2.7.1.33 Pantothenate kinase
YPKIGLPASTTAASFGKVNSSKLSDYKMEDLAAALLNSFTYNIGQIAYFVANLSGLKRIFFRGAYVCGHEKTMDKISRSLKYWSKGEVQTTFLCHEGFLGTLGAFWSYENMGIDSLAAHEVIREVLLGAPYTGQFPSLPVTEQQENGENNTLEGEIECLRNNNAALKAEVERLQRENAELRAKLQGATL

SEQ ID NO: 43839 - DNA, 719 bp, Panicum virgatum
  misc_feature: Ceres CLONE 2018412
  misc_feature: Encodes the peptide sequence at SEQ ID NO. 43840
gcgccaagcacttcgtcggcgacggcggcacgcagcgcggcatcaacgagaacaacacggtgctgagcttccacgacctgatgcgcatccacatgccgccctacgacaacgccgtcatcaagggcatctccaccgtcatgatctcctactccagcttcaacggggtgaagatgcacgagaacaagttcctcatcaccgacacgctcaagaacaagatgaacttcaggggctttgtcatcaccgactggcaggccgtggaccggatcaccaacccgccgcacacgcactactaccactccatcgaggagaccatccacgccggcatcgacatggtcatgatcccctacgactaccccgagttcgtcgccgacgtggtgaagcaggtcaaggccgggcagatcaggctggaccgcgtcaacgacgccgtcagccggatcctccgggtcaagttcgccatgggcctcttcgaggacccgctcccggacccgcgcctcgccaaggaactcggctccaaggagcaccgggcgatcgcgcgcgaggccgtccgcaagtccctcgtcctgctcaagaacagcaagaaagggggcgggcacaaggatcagcccgggatgctgccgctgtccaagaacgccaagaaggtcctcgtcgccggcacccacgcgcacgacctgggcaaccagtgcggcggctggaccatcaagtggcagggcgagagaggc

SEQ ID NO: 43840 - protein, 238 aa, Panicum virgatum
  misc_feature: Ceres CLONE 2018412
  misc_feature (1)..(113): Pfam Name: Glyco_hydro_3 Pfam Description: Glycosyl hydrolase family 3 N terminal domain
  misc_feature: SWISSPROT Homolog: EC 3.2.1.21 Beta-glucosidase
AKHFVGDGGTQRGINENNTVLSFHDLMRIHMPPYDNAVIKGISTVMISYSSFNGVKMHENKFLITDTLKNKMNFRGFVITDWQAVDRITNPPHTHYYHSIEETIHAGIDMVMIPYDYPEFVADVVKQVKAGQIRLDRVNDAVSRILRVKFAMGLFEDPLPDPRLAKELGSKEHRAIAREAVRKSLVLLKNSKKGGGHKDQPGMLPLSKNAKKVLVAGTHAHDLGNQCGGWTIKWQGER

SEQ ID NO: 43841 - DNA, 677 bp, Panicum virgatum
  misc_feature: Ceres CLONE 2018413
  misc_feature: Encodes the peptide sequence at SEQ ID NO. 43842
ctcgaggtcccaatctcaaccccatcgctgaccttatcctcaagatttttccgatctgatcttatctcggccttaattgaacgtaaattcgatcgttatcctcgtattgtggaggacatcttcgagtggcaatttgctatcctgggtcctcgcgacagtgagtttgagggtggaatctaccacggcaggatccagctgccctctgactatccgttcaagccaccttccttcatgctgctcacaccaagtggacgctttgagattaagaagaagatttgtttgagcatatccaattaccaccctgagcactggcaaccatcatggagtgtgcgcactgcactagtagccctgattgcattcatgccaacaaaccctggtggggcgctgggctctctggactacaaaaaggaagataggcaagcacttgctataaaatcacgtgaagcaccaccgaaatttggctccccagaacgccaaaaactaattgacgagatccatgagcaaatgctcagtaaggctcctcctgttccccaagtgctaccgaatgggacaaatgaggagtctaaccatttacccgcacctgactctttcgttgagaatgcagacagggcagatgaaggtggcaacacagtggggtctgtgtcaggctccttgaatgaccttactgggcctgaatc

SEQ ID NO: 43842 - protein, 225 aa, Panicum virgatum
  misc_feature: Ceres CLONE 2018413
  misc_feature (25)..(148): Pfam Name: UQ_con Pfam Description: Ubiquitin-conjugating enzyme
  misc_feature: SWISSPROT Homolog: EC 6.3.2.19 Ubiquitin--protein ligase
LEVPISTPSLTLSSRFFRSDLISALIERKFDRYPRIVEDIFEWQFAILGPRDSEFEGGIYHGRIQLPSDYPFKPPSFMLLTPSGRFEIKKKICLSISNYHPEHWQPSWSVRTALVALIAFMPTNPGGALGSLDYKKEDRQALAIKSREAPPKFGSPERQKLIDEIHEQMLSKAPPVPQVLPNGTNEESNHLPAPDSFVENADRADEGGNTVGSVSGSLNDLTGPE

SEQ ID NO: 43843 - DNA, 700 bp, Panicum virgatum
  misc_feature: Ceres CLONE 2018415
  misc_feature: Encodes the peptide sequence at SEQ ID NO. 43844
tccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtctgtatgtgttgatcattgcaaagaaaccatgcaggcatacatctctgcatgtgtctctgtaatgatcggtccagagtgatgaatatataaaactggtttgctttaaaaaaaaaaaaaaaaaattcattcagctgagtgtgctcgatcatcaagcaatcaacaaagcctcccaattatcctttcatcagatcatcttccttcttccaaaatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttc

SEQ ID NO: 43844 - protein, 75 aa, Panicum virgatum; identical to SEQ ID NO: 12809
  misc_feature: Ceres CLONE 2018415
  misc_feature (1)..(75): Pfam Name: Metallothio_2 Pfam Description: Metallothionein

SEQ ID NO: 43845 - DNA, 732 bp, Panicum virgatum
  misc_feature: Ceres CLONE 2018416
  misc_feature: Encodes the peptide sequence at SEQ ID NO. 43846
acacagcgattccactcgactccgccgcgccccccatggctgtcgccacctcccaccacctcgtcggcgtcgcccccgccgcctcccgcctgccgcggcgggggctcctccgctcccgggtcgcctgccctgctccgctcgcggccgcgcggagaatatgttgccaatctgtcaactcagctaatgtgttgggagcttcttcgacgacacctgaggaggcaatcccagtcccagtcgtcatgatagatcaagattcagaccatgatgcgaccattgtacagttgagttttggagaccgtttggggccactacttgacacgatgaaggcactcaaggaccttggccttgatgtcacgaaaggaactgtggcaactgactcagctgtcacaaaaacaaagttccacatcatgcgatttgggcgcaaagttgaggaccctgacatgttagagaggatacggctaaccatcattaacaatcttctgcaatatcatcctgaatcaagcgagaagttagcaatgggtgaattttttgggataaaatctcctgagaagaaggttgatattgatattgcaactcacgtggttgttgaagatgatgggccaaaaagaagcatgctttacatagagacagctgatcggcctggcctgcttctggaaattatcaagatcattgctgacacaaatattgatgtggaatctgctgagatcgacactgagggtttggttgccaagg

SEQ ID NO: 43846 - protein, 232 aa, Panicum virgatum
  misc_feature: Ceres CLONE 2018416
  misc_feature: SWISSPROT Homolog: EC 2.7.7.59 [Protein-PII] uridylyltransferase
  misc_feature: Functional homolog of the protein sequence given in SEQ ID NO 50834
  misc_feature: Useful for making plants with altered alkaloid content
  misc_feature: Useful for making plants with altered lignin content
MAVATSHHLVGVAPAASRLPRRGLLRSRVACPAPLAAARRICCQSVNSANVLGASSTTPEEAIPVPVVMIDQDSDHDATIVQLSFGDRLGPLLDTMKALKDLGLDVTKGTVATDSAVTKTKFHIMRFGRKVEDPDMLERIRLTIINNLLQYHPESSEKLAMGEFFGIKSPEKKVDIDIATHVVVEDDGPKRSMLYIETADRPGLLLEIIKIIADTNIDVESAEIDTEGLVAK

SEQ ID NO: 43847 - DNA, 711 bp, Panicum virgatum
  misc_feature: Ceres CLONE 2018426
  misc_feature: Encodes the peptide sequence at SEQ ID NO. 43848
actcctgcccgccgccgtcacttgagcctcctcttttcgctctgcttcttcttgcactccctcgatctcgccggcggaggaaatggcggaagttgaggcgcccacccaggaggtcaagctcttcggccgctggtccttcgatgacgtccaggtcaatgacatttctctggctgattaccttgccgtcagtcatacaaagcacgccatatatcttccccacaccgctggaaggtattctgctaagaggttccgcaaggctcagtgcccaattgttgagaggctgacaaactctctgatgatgcacggccgcaacaatggcaagaaggtcatggctgttcgcattgtgatgcatgctatggagattattcacctgctgactgatgccaaccctattcaaattatcgttgatgccatcataaacagtgggccaagagaagacgctacccggattggatctgctggtgttgttagaaggcaagctgttgatatatctcctttgaggcgtgtgaaccaggcaatctacctgcttaccactggtgctagagaaagtgctttcaggaacatcaagaccattgcagagtgccttgcagatgagcttatcaatgcagctaaaggttcttctaacaggtatgttttattcgctgtgttataccagtatccttgcgattaaatggtttggagcatctggcctgcaatttaccaaaggagaat

SEQ ID NO: 43848 - protein, 195 aa, Panicum virgatum
  misc_feature: Ceres CLONE 2018426
  misc_feature (44)..(182): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
MAEVEAPTQEVKLFGRWSFDDVQVNDISLADYLAVSHTKHAIYLPHTAGRYSAKRFRKAQCPIVERLTNSLMMHGRNNGKKVMAVRIVMHAMEIIHLLTDANPIQIIVDAIINSGPREDATRIGSAGVVRRQAVDISPLRRVNQAIYLLTTGARESAFRNIKTIAECLADELINAAKGSSNRYVLFAVLYQYPCD

SEQ ID NO: 43849 - DNA, 719 bp, Panicum virgatum
  misc_feature: Ceres CLONE 2018443
  misc_feature: Encodes the peptide sequence at SEQ ID NO. 43850
atgccgattattcaatgggaagcaaaatctttccgacgccccgtgttagcggtcgtgataattgcttctctagcactcttccccgttgtgttcctgccttctggtccagcaatgtggctaacaggaataattttcggctatggcttcggcttcttgatcatcatggctgggatcaccatcggcatgtcgataccttattggattggcttattgtttcgtgaccgcctaaatctctggttagaaaagagatggccacggcagattgctctgattaaactggctggtgaagggagttggttccaacaattccgtgtggttacattgctcagaatctcaccattcccatatgcactgcttaactatgctgtaactgtcactgagatgaagttcaacccttacatttgtggctcggttgttgggatgattcctgatgtgttcatcaacatctacagtgggcggctgatacgcacattggcagagctgaattatcacaagcatcgaatgacaacagttgagatagtgtacaacattgtctctgttattgtcgccgttgtcttcgcgattggatttacaatctatgcaaggagagctctggataacatggaacgttcaggcatctgctccgaacttgttggcgtccatactgcctcgactgagttcagagataaccttcaaggttgttcaactgcacgttctgtgccaattgatgttgtataata

SEQ ID NO: 43850 - protein, 201 aa, Panicum virgatum
  misc_feature: Ceres CLONE 2018443
  misc_feature (1)..(117): Pfam Name: SNARE_assoc Pfam Description: SNARE associated Golgi protein
MWLTGIIFGYGFGFLIIMAGITIGMSIPYWIGLLFRDRLNLWLEKRWPRQIALIKLAGEGSWFQQFRVVTLLRISPFPYALLNYAVTVTEMKFNPYICGSVVGMIPDVFINIYSGRLIRTLAELNYHKHRMTTVEIVYNIVSVIVAVVFAIGFTIYARRALDNMERSGICSELVGVHTASTEFRDNLQGCSTARSVPIDVV

SEQ ID NO: 43851 - DNA, 705 bp, Panicum virgatum
  misc_feature: Ceres CLONE 2018445
  misc_feature: Encodes the peptide sequence at SEQ ID NO. 43852
tgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgcgagacggggaggtcccgcgggttcggcttcgtcaccttctcaaccgagcagtcgatgctcgacgccatcgaggccatgaacggcaaggagctcgacggccgcaacatcaccgttaaccaggcccagtcccgtggcggtggcggtggcggtggcggtggcggtggcggcggcggttacggcggcggtcgccagggaggctacggcggcggcggcggcggcggcggctacggcggcggtcgccgtgagggcggctacggtggcggcggctacgacggtggcggtggcggatacggcggcggtcgccgcgagggcggctacggcggtggtggctacggcagccgcggtgactccggtggtaactggaggaactgatggggtggccctcccgtgctggcagccaagttatcctagatatctattagtgttcgtgttaccatttgatccgagttaccccagagtttagtgtccgtgttaccgtttgattaggtgttggttcccatg

SEQ ID NO: 43852 - protein, 166 aa, Panicum virgatum
  misc_feature: Ceres CLONE 2018445
  misc_feature (10)..(81): Pfam Name: RRM_1 Pfam Description: RNA recognition motif. (a.k.a. RRM, RBD, or RNP domain)
  misc_feature (48)..(158): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MAAADVEYRCFVGGLAWATDNASLQQAFASYGDVLDSKVITDRETGRSRGFGFVTFSTEQSMLDAIEAMNGKELDGRNITVNQAQSRGGGGGGGGGGGGGGYGGGRQGGYGGGGGGGGYGGGRREGGYGGGGYDGGGGGYGGGRREGGYGGGGYGSRGDSGGNWRN

SEQ ID NO: 43853 - DNA, 678 bp, Panicum virgatum
  misc_feature: Ceres CLONE 2018462
  misc_feature: Encodes the peptide sequence at SEQ ID NO. 43854
agcagcagcagcttgttctatcagcacacgcagtgtgccgagcaagtgagcagcaataacagctagctgcccaagaagatggccaggcttggccttgtcatcctggtcgcgctgcttggcgccgccgccgtggctgctcaagctccagggtccagcagctacggctatggcggcgttcctccgagcccggccccgcaaagcccgccaagcgcaagcccacccgctccaactccaagcccaccggcccaggctcccccgccgcgcctcaggttcggcttctacaagcgctcgtgccccaacacggagtacatcgtccgggaggccgtgaggaacgccaccagcgtcgaccccggcctcggcgccggcctcatccgcatggccttccacgactgcttcgtccagggctgcgacgcctccgtcctgctcgacccgacgcccgccaacccgcgcccggagaagctcggcccgcccaacttccccagcctccgcggcttcgacgtcgtcgacgccgccaaggccgcgctcgagaaggcctgccccggcgtcgtctcctgcgccgacgtcgtccagttcgccgcccgcgacgccgccttcttcctcagcggctccagggtcagctacaatctccccgcggggcgcctcgacggccgcgtgtccttcgacaacgagacgctcgcc

SEQ ID NO: 43854 - protein, 199 aa, Panicum virgatum
  misc_feature: Ceres CLONE 2018462
  misc_feature (79)..(199): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51043
  misc_feature: Useful for making plants with altered carbohydrate content
  misc_feature: Functional homolog of the protein sequence given in SEQ ID NO 50230
  misc_feature: Useful for making plants with modulated nitrogen use efficiency
MARLGLVILVALLGAAAVAAQAPGSSSYGYGGVPPSPAPQSPPSASPPAPTPSPPAQAPPPRLRFGFYKRSCPNTEYIVREAVRNATSVDPGLGAGLIRMAFHDCFVQGCDASVLLDPTPANPRPEKLGPPNFPSLRGFDVVDAAKAALEKACPGVVSCADVVQFAARDAAFFLSGSRVSYNLPAGRLDGRVSFDNETL

SEQ ID NO: 43855 - DNA, 376 bp, Panicum virgatum
  misc_feature: Ceres CLONE 2018463
  misc_feature: Encodes the peptide sequence at SEQ ID NO. 43856
actaagcgcggcgttaatatctccacccctcccgtctcctcccctccccccatcctcctcctcctcaggtcttccccctcccccgatccccaaatcctcctccggatttcgcactcagccgcggcgcaggtggtgaagggaggcagagaggggaaacatggggctcgcgttcgggaagctcttcagccggctcttcgccaagaaggagatgcggatcctcatggtcggcctcgacgccgccggtaaaaccaccatcctctacaagctcaagctcggcgagatcgtccccaccatccccaccataggattcaatgttgagaccggtgagtaaaagaacattagcttcaccgtctgggatgacgggggtcaggacaag

SEQ ID NO: 43856 - protein, 57 aa, Panicum virgatum
  misc_feature: Ceres CLONE 2018463
  misc_feature (5)..(57): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
  misc_feature: The sequence is a functional homolog of SEQ ID NO 11 in US patent 7259294
MGLAFGKLFSRLFAKKEMRILMVGLDAAGKTTILYKLKLGEIVPTIPTIGFNVETGE

SEQ ID NO: 43857 - DNA, 715 bp, Panicum virgatum
  misc_feature: Ceres CLONE 2018495
  misc_feature: Encodes the peptide sequence at SEQ ID NO. 43858
aaaaacccttctccgactcggttccatcacgccaccctcgtcgcgccgccaccgccgccgcctgctgcgtctccggccagccgcgcggccccgtggtctcctagccacagcagagagactagaagtcatggtgatccctccaccggaaagggcagctagagtcactcgtttcctcaagccatacctgttgaggatgcatttcacaaacaagtatgtatctgctcaggtcatccacaccccaacatcaacggttgcttgttctgcaagctcacaggagaagctgctgagaccaaacatggagtcgacacgtgacgtcgcagcagctgcgaagattggaaagttgtttggtgaacgcctgctcctcaagggaatacctgcagtgtccatccacatgaagagagaacaaaaataccatgggaaagtgaaggccgttatagattcagtgagagaagctggagtcaaattgttatgattgtgttgttgaaaacattgaacttagcatttgtgctgagatggagctggcaatggcgccatagcttgatactgagcagcagcgcctatgttgtgctgtgagaattctcttacctttattgagggtgttagtcaagtattagcacaaatgttatgtattaatatttttcactaggacaaagatatttaccgaatgatgtgcagctagcctaaagattctgcatattgtgagattcttctttcg

SEQ ID NO: 43858 - protein, 114 aa, Panicum virgatum
  misc_feature: Ceres CLONE 2018495
  misc_feature (4)..(113): Pfam Name: Ribosomal_L18p Pfam Description: Ribosomal L18p/L5e family
MVIPPPERAARVTRFLKPYLLRMHFTNKYVSAQVIHTPTSTVACSASSQEKLLRPNMESTRDVAAAAKIGKLFGERLLLKGIPAVSIHMKREQKYHGKVKAVIDSVREAGVKLL

SEQ ID NO: 43859 - DNA, 523 bp, Panicum virgatum
  misc_feature: Ceres CLONE 2018526
  misc_feature: Encodes the peptide sequence at SEQ ID NO. 43860
aattttccgcgctgcgcttgtagacatctatccagcgcagcgcagcaggatggtgtacgcgctcgtgctggtcgccttggcggccggcgccgccgcggcggtgctccgccactacctcccgctgctccgcggcagcctccccaagggcagcttccgctggcccctcatcggcaagaccatcgacttcctccacgcgcacccatcaaacaccgccggagacttactcgatgatcacgtccccaggcacgggacggagttcaagtctcacgtcttccgctcgccggcggtggtctactgccacgaggagctcaaccacttcgagcagcacaacgaggagcgcctgttcgagtgcagctaccccggcgccatccgcaccatcctcggtgagtcctccggcgctggtggtcaccgacgagcgccaccgccagatccggagcatgttcctcgtcctcgacgcctacacggagctcaaggcctcctacgtcgccagcgtcgacgagtccgcgcgctccctcatcgctgt

SEQ ID NO: 43860 - protein, 157 aa, Panicum virgatum
  misc_feature: Ceres CLONE 2018526
  misc_feature: SWISSPROT Homolog: EC 1.14.13.77 Taxane 13-alpha-hydroxylase
  misc_feature: Functional homolog of the protein sequence given in SEQ ID NO 50272
  misc_feature: Useful for making plants with modulated oxidative stress sensitivity
MVYALVLVALAAGAAAAVLRHYLPLLRGSLPKGSFRWPLIGKTIDFLHAHPSNTAGDLLDDHVPRHGTEFKSHVFRSPAVVYCHEELNHFEQHNEERLFECSYPGAIRTILGESSGAGGHRRAPPPDPEHVPRPRRLHGAQGLLRRQRRRVRALPHR

SEQ ID NO: 43861 - DNA, 751 bp, Panicum virgatum
  misc_feature: Ceres CLONE 2018531
  misc_feature: Encodes the peptide sequence at SEQ ID NO. 43862
ggaattctgacgacgacacaacatactttggcaagaagaaaaaagaatccgccacgaaaatggcgatggcagccgccgccgcctcctcctacttgagcaatgcaagtgccatcttgctctacgccgctctcttcctcgccggcgctcacgccgagcccgacacgacccaggtggcaacaacctctcaagtcccaagcatactccccgtctgcaagacagtcggcggtggcagcaccttcttcgacgtccagttctgcctggaggctctcggctccgatggccggagcgccaacgccggcgcgaactacggcgcctgctccgtcatcgccgccgacctcctcacggccaacgccaccagcacggcggacaagatcgacggcctgctccgggagcgcgccggcaaggacgacgacgaggccacgacgacgacgcgctgcctccgggcgtgccgtgcgctgtacggcggcgtggcgagagggcagcccggctgcgcggccgccgtcaggggcaggaggagcggcgaggccacgaggtgcctggagagagctgccagcgcggcggcggagtgtgaggaggggttccggaagagcaaggtggcctcgccggtgacgatggagaacgacgacgtgttcaagcttgccaagctcgccgtcgcgctgctcagctgggctcattagtagtaactgataaagaagcttcttgatgatgtgtcgtgtctagtagggcgaacatgtttcattctctctttttc

SEQ ID NO: 43862 - protein, 205 aa, Panicum virgatum
  misc_feature: Ceres CLONE 2018531
  misc_feature (41)..(200): Pfam Name: PMEI Pfam Description: Plant invertase/pectin methylesterase inhibitor
MAMAAAAASSYLSNASAILLYAALFLAGAHAEPDTTQVATTSQVPSILPVCKTVGGGSTFFDVQFCLEALGSDGRSANAGANYGACSVIAADLLTANATSTADKIDGLLRERAGKDDDEATTTTRCLRACRALYGGVARGQPGCAAAVRGRRSGEATRCLERAASAAAECEEGFRKSKVASPVTMENDDVFKLAKLAVALLSWAH

SEQ ID NO: 43863 - DNA, 738 bp, Panicum virgatum
  misc_feature: Ceres CLONE 2018533
  misc_feature: Encodes the peptide sequence at SEQ ID NO. 43864
acagcagccgtgtccacctcacgtatgatctgtagccactcatagtcatagatagacgctagctgcttagcctgttctgccgtagctgtctcgtgtcctttactctgcctgcctgcctgtctgattgcccctcgcgcctctgagcggccgccatggatatctggaagtccaaggtgctgcccaagatcaagctcgtcttcgccaagtccgccggcaagaaggccgccgccgccgccgagctcgtcaagtccttcgacgagtccaaggaggggatcaatggcgagttcgaggagaagaaggcggatctccagcctaaggtcgtcgagatctacgagtctgttcctgccccgctcaaggttctgatcaaggagaggagcaaggtgtccgggatcaagaagaactcggccgccatcaccaagttcttcgaggatctggccaagatcgagttccctggcgccaagcaagtgagcgagggcatctccaaggtcggcccggccctgctgtccggccccatcttcgccacgttcgagaaggtctcctccctgctccctgccgccgccgaggaggcgcccaaggaggctccggtcgccgccgaggaggcagccgagaagaacgccgccgccgccgctgtcgaggagaaggaggaagcgccggccggtgagaagaaggaagaggctccggcagccacggaggagaagaaagaggacgcggctcctgcagccgccgaggagacaacca

SEQ ID NO: 43864 - protein, 195 aa, Panicum virgatum
  misc_feature: Ceres CLONE 2018533
  misc_feature (1)..(195): Pfam Name: DREPP Pfam Description: DREPP plasma membrane polypeptide
MDIWKSKVLPKIKLVFAKSAGKKAAAAAELVKSFDESKEGINGEFEEKKADLQPKVVEIYESVPAPLKVLIKERSKVSGIKKNSAAITKFFEDLAKIEFPGAKQVSEGISKVGPALLSGPIFATFEKVSSLLPAAAEEAPKEAPVAAEEAAEKNAAAAAVEEKEEAPAGEKKEEAPAATEEKKEDAAPAAAEETT

SEQ ID NO: 43865 - DNA, 716 bp, Panicum virgatum
  misc_feature: Ceres CLONE 2018546
  misc_feature: Encodes the peptide sequence at SEQ ID NO. 43866
agtagtgatcagtccaaaattaagccacagtgctgccaacacagctaccacctcagccacacatacagtactccaacaacaatgtcagctgatgaggcgtcggccttgcgtgtgatcggcctatggccgagcccgttcgtgatccgcgtcctatcgcgctgaagctgaagggagtcgagtacgagttcgtggaggaggaggtgggcaagaagagcaagctgctgctcaggtccaaccccgtgcacaagaagatccccgtcctgctccaccacggcaagcccatctccgagtccctcgttatcgtccagtacgtcgacgaggcctggtcgtccgccgcgccggccatcctcccggccgacccgtacacccgcgccgtccatcggttctgggcacagtacatcgacgacaagctccctccggcgatccgcacgctcaggggattggacgacggcgacaaggagcaagcggcggggcagctgtccgccgccctgcagctgttggaggcagctttcctggagctcagccaggggaagagctacttcggcggcgacagcgtcgggtacctggacatcgccctggtgtcgcacgtcgggtgggtgagggcggtcgagaagatcgccggggtcgcgctccttgaccaaagccaggtcccgaacctggcggcgtgggctggccggctctgcgcgcacgcggcagtggcggacgcgatccccgac

SEQ ID NO: 43866 - protein, 197 aa, Panicum virgatum
  misc_feature: Ceres CLONE 2018546
  misc_feature (3)..(66): Pfam Name: GST_N Pfam Description: Glutathione S-transferase, N-terminal domain
  misc_feature (88)..(190): Pfam Name: GST_C Pfam Description: Glutathione S-transferase, C-terminal domain
  misc_feature: SWISSPROT Homolog: EC 4.4.1.5 Lactoylglutathione lyase
MAEPVRDPRPIALKLKGVEYEFVEEEVGKKSKLLLRSNPVHKKIPVLLHHGKPISESLVIVQYVDEAWSSAAPAILPADPYTRAVHRFWAQYIDDKLPPAIRTLRGLDDGDKEQAAGQLSAALQLLEAAFLELSQGKSYFGGDSVGYLDIALVSHVGWVRAVEKIAGVALLDQSQVPNLAAWAGRLCAHAAVADAIP

SEQ ID NO: 43867 - DNA, 687 bp, Panicum virgatum
  misc_feature: Ceres CLONE 2018551
  misc_feature: Encodes the peptide sequence at SEQ ID NO. 43868
aagttccgcggcgtcgtcgtgagcccacgaaacctccgctccttccaccaccgccacccgccgccccctcccgcccccaccatgtccgacctccggcgctacgtgtcgtccgtttccggcgagggggcggactgctcgctcgccgccgcggtgtatggcggggaagggggagtattgtcgcagctgcgcgagctcaaggcgtggttcgaggagcagactctgttccacttctactcggcctcgattcttctgggctacgatgccaatgcagtgtcagcgaccggagttgggggtggggtgagggtgaagctggtggactttgctcatgtcgctgagggtgatggggtgatcgaccacaacttcctgggcgggctctgctcgctgatcaagttcatttctgacattgtttcggaggctcctgagacgccgccattggctccttaactggaggagatcttggcgtatgggagttgatgacaaaggcgtaaagttttgtcccaaaaggaaacctacgagctgctggttgtggaaatgcgagacgactcagctcagccggttgccttccctgcaagcacacggcaacctgtgccttttttgaaatccaatcttctgaattctgaaatactctgggttcgaatacgttttggatctgattgcgtaatgaaaacctagaggtcaccactctcc

SEQ ID NO: 43868 - protein, 120 aa, Panicum virgatum
  misc_feature: Ceres CLONE 2018551
  misc_feature (1)..(106): Pfam Name: IPK Pfam Description: Inositol polyphosphate kinase
  misc_feature: SWISSPROT Homolog: EC 2.7.4.21 Inositol-hexakisphosphate kinase
  misc_feature: The sequence is a functional homolog of SEQ ID NO 8 in US patent 7067720
MSDLRRYVSSVSGEGADCSLAAAVYGGEGGVLSQLRELKAWFEEQTLFHFYSASILLGYDANAVSATGVGGGVRVKLVDFAHVAEGDGVIDHNFLGGLCSLIKFISDIVSEAPETPPLAP

SEQ ID NO: 43869 - DNA, 745 bp, Panicum virgatum
  misc_feature: Ceres CLONE 2018560
  misc_feature: Encodes the peptide sequence at SEQ ID NO. 43870
agggccatcatctgctgcccaccaacccgtaaccactccgccactgccccgcagccgagtccccgtctgcatcccatacccccggcgcggccatggctccgatcgccgtcggcgactccctccccgacggccagctcgggtggttcgacgagagcgaccagctgcagcaggtctccgtccacgcgctcgccgccggcaagaaggtcatcctcttcggcgtgcccggagccttcacgcccacctgcagcatgcagcatgtgccaggcttcattacacaggctgagcacctcaaagccaagggcgtagatgaaatcctgcttatcagtgttaacgacccctttgtcatgaaggcatgggcgaagacataccccgagaacaagcatgtgaagttcctggccgatggatcgggaaattacactaaggcactcggtctcgagcttgacctgacagagaaaggattgggcattcgctcaagacggtttgctctcctggccgacaacctcaaggtcactgttgcaaacatcgaggaaggcggccagttcacaatctctggcgctgaggagatcctgaaagcgctgtaggagcttcagctcttgtaaaagcgcagcaatgttgttgacgtcagtctagcttgaactcgtctgccataccgcgaaatacttgtcaatggacaagatccagttccatgtgcactagacgaaacttttggaggcttcctattactgctgtttgagtcatgcacaat

SEQ ID NO: 43870 - protein, 162 aa, Panicum virgatum
  misc_feature: Ceres CLONE 2018560
  misc_feature (5)..(162): Pfam Name: Redoxin Pfam Description: Redoxin
  misc_feature: SWISSPROT Homolog: EC 1.11.1.15 Peroxiredoxin
MAPIAVGDSLPDGQLGWFDESDQLQQVSVHALAAGKKVILFGVPGAFTPTCSMQHVPGFITQAEHLKAKGVDEILLISVNDPFVMKAWAKTYPENKHVKFLADGSGNYTKALGLELDLTEKGLGIRSRRFALLADNLKVTVANIEEGGQFTISGAEEILKAL

SEQ ID NO: 43871 - DNA, 726 bp, Panicum virgatum
  misc_feature: Ceres CLONE 2018578
  misc_feature: Encodes the peptide sequence at SEQ ID NO. 43872
ttatcgatcccaaggggtacagatccataatagacatatagagattattatacgccaagtaacatcaaaagtaagggtttccgaagatggaatgtctagtgtttttttacctggggaattaataggactattgcgagcggaacgagcagggcgggctttagatgaatcgatctattatcgggcaatcttattgggaataacaagggcttccctgaatacccaaagtttcatatctgaagcaagttttcaagaaactgctcgagttttagcaaaagctgccctacgaggtcgtattgattggttgaaaggcctgaaagaaaacgtagttctgggggggattatacctgttggtaccggattccaaaaatttgtccatcgttccccacaagacaagaacctttatttcgaaattcaaaaaaaaaatctattcgcgtcggaaatgagagatattttgtttctccatacagaattagtttcttctgattctgacgtaacaaacaatttctatgaaacataagaagccccttttaccgctatttatacgatttaagtatacataaagcaatttgtttttactttaatttaaactatacttttgaccttagaatgctaacaggtccgattttagattttgtattttaataagtaaaagaagtcagttaattcattaaggctatgtttataccgtgtataaatgggtaattctgagtagaaagttccatcaga

SEQ ID NO: 43872 - protein, 171 aa, Panicum virgatum
  misc_feature: Ceres CLONE 2018578
  misc_feature: SWISSPROT Homolog: EC 2.7.7.6 DNA-directed RNA polymerase
YRSQGVQIHNRHIEIIIRQVTSKVRVSEDGMSSVFLPGELIGLLRAERAGRALDESIYYRAILLGITRASLNTQSFISEASFQETARVLAKAALRGRIDWLKGLKENVVLGGIIPVGTGFQKFVHRSPQDKNLYFEIQKKNLFASEMRDILFLHTELVSSDSDVTNNFYET

SEQ ID NO: 43873 - DNA, 732 bp, Panicum virgatum
  misc_feature: Ceres CLONE 2018582
  misc_feature: Encodes the peptide sequence at SEQ ID NO. 43874
atcccgccagctgcctttcaattcgcttttgtacttttaacttgtactatttctgagcccaaggactcggtcccatatagctcggaaaatgtttcgacccctcctaccccgccattgctcgtctctcatccgaccttcctccctccttcgcaatcttccatccggtcaattcacttcggccaacttgccatctcttcaatctacacccagaatctcagctagagctttctctgcatcctccgccaacatggtcaagaaggtttttttcgacctcgagtggacaggccctgtcatcgacgacaactttgacgttgtcggaaaccagcaggaggcccagaaaggtcgcatcaacttcgaactcttcgatgatgtcgtccccaagacggccgaaaacttccggcagctgtgcacttttgagaagggttttggctacaagggctccgccttccaccgcatcatcccggagttcatgctccagggtggcgatttcacccgtggaaatggtaccggcggcaagtctatctacggcgagaagttcgccgatgagaacttcaaagtgaggcacacagagcccggcttgctctccatggccaatgccggcccgaacaccaacggttcccaattcttcattactaccgccgttactagctggctcgatggcaaacgcgttgttttcggcaaggtggctgatgaggaatctttcaaggtggtccaggcgggtggagctagtcg

SEQ ID NO: 43874 - protein, 161 aa, Panicum virgatum
  misc_feature: Ceres CLONE 2018582
  misc_feature (20)..(161): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MVKKVFFDLEWTGPVIDDNFDVVGNQQEAQKGRINFELFDDVVPKTAENFRQLCTFEKGFGYKGSAFHRIIPEFMLQGGDFTRGNGTGGKSIYGEKFADENFKVRHTEPGLLSMANAGPNTNGSQFFITTAVTSWLDGKRVVFGKVADEESFKVVQAGGAS

SEQ ID NO: 43875 - DNA, 705 bp, Panicum virgatum
  misc_feature: Ceres CLONE 2018584
  misc_feature: Encodes the peptide sequence at SEQ ID NO. 43876
accacgcgccccaacctccgaaaaaaagagagagaaaaaggaaacccccccccccccccaatcggaatccgcacgcaccccatggccgccgccgccctcctccgccgctcgccggcggctcgcgcgctcctctcgccggccctctcgtcccgcctcgtcgcgtccaagccccactcctcgtcccccgcgcctccgccgccgccgaaggcgcccacggccatgaagaccttctcgatctaccggtgggacccggactcgccgtcgacgaagccgcacctcaaggactaccaggtggacctctccgactgcgggccgatggtgctggacgcgctgctcaagatcaagaacgagcaggacccgtcgctcaccttccgccgcagctgccgcgagggcatctgcgggagctgcgccatgaacatcgacggcgacaacggcctcgcctgcctcaccaagatctcctccgcctcctcggcctccacggtctcgccgctgccccacatgttcgtcgtcaaggacctcgtcgtcgacatgaccaacttctacaaccagtacaagagcgtcgagccctggctcaagcgcaaggacccgccgccgcaggagggcaaggagatcctgcagaccaaggccgaccgcgccaagctcgacggcatgtacgagtgcatcctctgcgcctgctgctcaacctcgtgcccatcctactggtgg

SEQ ID NO: 43876 - protein, 207 aa, Panicum virgatum
  misc_feature: Ceres CLONE 2018584
  misc_feature (62)..(127): Pfam Name: Fer2 Pfam Description: 2Fe-2S iron-sulfur cluster binding domain
  misc_feature: SWISSPROT Homolog: EC 1.3.5.1 Succinate dehydrogenase (ubiquinone)
  misc_feature: Functional homolog of the protein sequence given in SEQ ID NO 51680
  misc_feature: Useful for making plants with modulated biomass
MAAAALLRRSPAARALLSPALSSRLVASKPHSSSPAPPPPPKAPTAMKTFSIYRWDPDSPSTKPHLKDYQVDLSDCGPMVLDALLKIKNEQDPSLTFRRSCREGICGSCAMNIDGDNGLACLTKISSASSASTVSPLPHMFVVKDLVVDMTNFYNQYKSVEPWLKRKDPPPQEGKEILQTKADRAKLDGMYECILCACCSTSCPSYW

SEQ ID NO: 43877 - DNA, 693 bp, Panicum virgatum
  misc_feature: Ceres CLONE 2018588
  misc_feature: Encodes the peptide sequence at SEQ ID NO. 43878
gccggatctggcggcggtggccgcagctacggcggcagctggggcggcgggaggagatccggtggcgggggcggcgccggcgcctgctacaagtgcggggagcccggccacatggccagggactgccccagcgctgatggcggcggcggatacggcgggggcggctacggcggcggcggtggatacggcgggggcggctacggcggcggcggtggcggtggatgctttaagtgcggggagcctggccacatggccagggactgctccagcggcggaggcggttacggcggcggcggctacggcggcggcggcggcggcggcggcggcgcctgctacaactgcggccagaccggccacttggcgagggactgcgcctccggcggcggcggcggcggcggccgcttcggaggcggcggcggcgaccgctcctgctacaactgcggcgaggccggccacatcgcccgcgactgccccgccggcgccgcgtgagatcgggtcggatcgcgccgcgccactacccggtagtggtgtggcctccctatagatctcgcctaagcctctcactgtgtctcgttcgtcggagtattgcttttagttttgccgatctgggcccgagcgcccgcctccttgctatagaggagcccaaccgccttttttcttcttctttcgttttccttttgctcttggatttgg

SEQ ID NO: 43878 - protein, 162 aa, Panicum virgatum
  misc_feature: Ceres CLONE 2018588
  misc_feature (27)..(44): Pfam Name: zf-CCHC Pfam Description: Zinc knuckle
  misc_feature (142)..(159): Pfam Name: zf-CCHC Pfam Description: Zinc knuckle
  misc_feature (109)..(126): Pfam Name: zf-CCHC Pfam Description: Zinc knuckle
  misc_feature (73)..(90): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 468 in the 11/479,226 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
AGSGGGGRSYGGSWGGGRRSGGGGGAGACYKCGEPGHMARDCPSADGGGGYGGGGYGGGGGYGGGGYGGGGGGGCFKCGEPGHMARDCSSGGGGYGGGGYGGGGGGGGGACYNCGQTGHLARDCASGGGGGGGRFGGGGGDRSCYNCGEAGHIARDCPAGAA

SEQ ID NO: 43879 - DNA, 710 bp, Panicum virgatum
  misc_feature: Ceres CLONE 2018598
  misc_feature: Encodes the peptide sequence at SEQ ID NO. 43880
gaggtccccaggagcgcagcacccactccccaaatcttccggcgaccacccccgactccggcgagatgagccgcggcacaggcgcgggctacgaccgccacatcaccatcttctcccccgagggccgcctctaccaagtcgagtacgcgttcaaggcggtcaagtcggtgggggtcacgtcgatcggcgtccgcggcgaggactccgtatgcgtcgtcacccagaagaaagtgccggataagttgctggatcagacgagcgtgacgcacctgttctcaatcaccaagttcgtcggattgcttgccactggccttacagctgatgcaaggtcgttggttgcccaagcaaggaatgaagcagctgagtttcgcttcaaatggggttatgagatgcctgtagatgtgttagcgaaatggatcgctgacaaagcgcaagtttacacgcagcatgcctacatgagaccccttggcgtagttgctatggtcttgggctatgacgaagagaaaaatgctcaactcttcaagtgtgaccctgctggtcacttctttggacacaaggcaactagtgccgggcttaaggagcaagaagcaataaattttcttgagaagaaaatgaaggatgatccaaaattcacctatgacgaaactgttcagattgcaatctctgcgttgcaatcagttctccaggaagatttcaggccactgagatcg

SEQ ID NO: 43880 - protein, 214 aa, Panicum virgatum
  misc_feature: Ceres CLONE 2018598
  misc_feature (33)..(209): Pfam Name: Proteasome Pfam Description: Proteasome A-type and B-type
  misc_feature: SWISSPROT Homolog: EC 3.4.25.1 Proteasome endopeptidase complex
MSRGTGAGYDRHITIFSPEGRLYQVEYAFKAVKSVGVTSIGVRGEDSVCVVTQKKVPDKLLDQTSVTHLFSITKFVGLLATGLTADARSLVAQARNEAAEFRFKWGYEMPVDVLAKWIADKAQVYTQHAYMRPLGVVAMVLGYDEEKNAQLFKCDPAGHFFGHKATSAGLKEQEAINFLEKKMKDDPKFTYDETVQIAISALQSVLQEDFRPLR

SEQ ID NO: 43881 - DNA, 742 bp, Panicum virgatum
  misc_feature: Ceres CLONE 2018611
  misc_feature: Encodes the peptide sequence at SEQ ID NO. 43882
aagtcaaaacagaaacatccagctccaggccaattcctcgaccgcatcgccgaccgaccgaccgcctccatggccacctccgccgctctcgccgcgctctccgccacggccaccgccgccggcaagcgcctgctcctcccgcgcccctcgtccgccgcctcctccctctccttcgcctcgcgccgcctgggcgccgcggggtccctccgggcccgcgggtccccggtccgggccgcggcgtcgtccgcgtcggcgccccccgcggcggcggccaagaccatcgcggtcggggaccggctccccgacgcgacgctctcctacttcgactcccccgacggcgagctcaagacggtgacggtgcacgacctgacggcggggaagaaggtggtgctcttcgcggtgcccggcgcgttcacgcccacctgcacccagaagcacctcccggggttcgtcgccaaggccggggagctccgcgccaagggcgtggacgccgtggcctgcgtctccgtcaacgacgccttcgtgatgcgcgcgtggaaggagagcctcggggtcggcgacgaggtgctgctcctgtccgacgggaacggggacctcgcccgcgccatgggcgtcgagctcgacctctccgacaagcccgtcgggctcggcgtccggtcccggcggtacgcgctgctggcccaggacggcgtcgtcaaggtgctcaacctcgaggagggcggcgccttcacaaacagcaacg

SEQ ID NO: 43882 - protein, 224 aa, Panicum virgatum
  misc_feature: Ceres CLONE 2018611
  misc_feature (72)..(221): Pfam Name: Redoxin Pfam Description: Redoxin
  misc_feature: SWISSPROT Homolog: EC 1.11.1.15 Peroxiredoxin
MATSAALAALSATATAAGKRLLLPRPSSAASSLSFASRRLGAAGSLRARGSPVRAAASSASAPPAAAAKTIAVGDRLPDATLSYFDSPDGELKTVTVHDLTAGKKVVLFAVPGAFTPTCTQKHLPGFVAKAGELRAKGVDAVACVSVNDAFVMRAWKESLGVGDEVLLLSDGNGDLARAMGVELDLSDKPVGLGVRSRRYALLAQDGVVKVLNLEEGGAFTNSN

SEQ ID NO: 43883 - DNA, 684 bp, Panicum virgatum
  misc_feature: Ceres CLONE 2018613
  misc_feature: Encodes the peptide sequence at SEQ ID NO. 43884
aaaaagtcattttagccgtgccgtcgcttataaaaccccaaggccagccatcctattgtcatgcacagacgagagcgagccaagtgtactactcccagtgaagccacactagctagccacaccagcagcttgacaagctagctagctagctaggccgcagccatgtcggaggagaagcaccaccacttcttccaccaccacaagaaggacgaagaggagcagcccgccggcgggtactcggaggccgtggccgccgaggtggtggccgccggcgacaacgagtacgagaggtacaagaaggaggagaaggagcacaagcacaagcagcacctcggcggggccggcgccatcgccgccggcgccttcgcgttctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggaggccagcggcgagaagaagcaccaccacctcttcggctgacccgccggcaagcgagctccggcccggccgccgcgcacggcgcacccgcctgcttgctccaataattgtggccatgatttcgcaataagtcccttccggacccttagcttgcttgcttgtgtg

SEQ ID NO: 43884 - protein, 132 aa, Panicum virgatum
  misc_feature: Ceres CLONE 2018613
  misc_feature (42)..(121): Pfam Name: ABA_WDS Pfam Description: ABA/WDS induced protein
MSEEKHHHFFHHHKKDEEEQPAGGYSEAVAAEVVAAGDNEYERYKKEEKEHKHKQHLGGAGAIAAGAFAFYEKHEAKKDPEHAHRHKITEEIAATAAVGAGGYAFHEHHEKKKDHKDAEEASGEKKHHHLFG

SEQ ID NO: 43885 - DNA, 663 bp, Panicum virgatum
  misc_feature: Ceres CLONE 2018618
  misc_feature: Encodes the peptide sequence at SEQ ID NO. 43886
cctcatcagcagccactgctgcaatcttccttctgctggttgctttttcagtgactctctcagtaccaagctagcttcttgtgtcgtagcagcacttgcaattgcaagttgcgagaaataatggcgaaggcagtgaggtgcttgctgatgacggtcgccgtggtgctgtctcccctcctcgccggaagcggcgaggctgccggcgggacgctgtctacgagcttctacagcaagaggtgcccgagcgtgcagggcatcgagcgggcggggatggcgtcggccgtggcggcggagcggcgcatgggcgcgtccatcctccgcatgttcttccacgactgcttcataaatggctgcgacgcgtccatcctgctcgacgacaatccgaccttcaccgaagagaataacgccgggcccaacgccaactccgtgcgcggctactaggacatcgacgccatcaaggcccatgtcgaggcggtctgcaacgccaccgtctcctgcgccgacatactcgacctcgccgcctgcgacgccggcaacctcctcggcaggccgacgtggacggtgtacctcggccgccatgacgcgctgacggcgagccagagcgacaccaacgccaacctcatctgtccggggctcagactcgccacgctcgtctccttgttc

SEQ ID NO: 43886 - protein, 106 aa, Panicum virgatum
  misc_feature: Ceres CLONE 2018618
  misc_feature: SWISSPROT Homolog: EC 1.11.1.7 Peroxidase
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 50229
  misc_feature: Useful for making plants with altered cell wall content and/or composition
MAKAVRCLLMTVAVVLSPLLAGSGEAAGGTLSTSFYSKRCPSVQGIERAGMASAVAAERRMGASILRMFFHDCFINGCDASILLDDNPTFTEENNAGPNANSVRGY

SEQ ID NO: 43887 - DNA, 666 bp, Panicum virgatum
  misc_feature: Ceres CLONE 2018630
  misc_feature: Encodes the peptide sequence at SEQ ID NO. 43888
gaactccagtctgatgatattgcaaaagcattggttgctatcagcactgaagcagcttcaattcctgtacctaaactaaagaatgtgcacaggctccgaacagaacactatgtatacgaacttccagattcacatccacttgtacaacagctaagacttgaacggcgggagcctgatgatcctaccccatacttattggccatatggacaccagacgaaataaatgaaataagcaaggtaccaaaaccatgcagcgacccgcaaatggaaggcagattatgcaataatgagatgtgccacagttgtactgatgagcaagagaatcaataccgatatgtgagaggcacaattttggttccttgtcgaacagctatgaggggtagtttcccactgaatggcacttactttcaagtcaacgaggtatttgctgaccacagctctagtcacaaccctatacatgtcgaaagggcgcagctatggaatttgcaaaggcgcatggtcttcttcgggacttcagtatctagcatattcaaaggtctaacaacagaagaaatacaacaatgcttctggagaggatttgtctgtgtgcgaggattcgacatggagacaagggcaccaaggcctctgtgccctcatttgcatattgtagcaaggccgaaatcccgc

SEQ ID NO: 43888 - protein, 221 aa, Panicum virgatum
  misc_feature: Ceres CLONE 2018630
  misc_feature: Functional homolog of the protein sequence given in SEQ ID NO 51390
  misc_feature: Useful for making plants with modulated endosperm cell number
  misc_feature: Useful for making plants with modulated endosperm cell size
  misc_feature: Useful for making plants with modulated seed quality
ELQSDDIAKALVAISTEAASIPVPKLKNVHRLRTEHYVYELPDSHPLVQQLRLERREPDDPTPYLLAIWTPDEINEISKVPKPCSDPQMEGRLCNNEMCHSCTDEQENQYRYVRGTILVPCRTAMRGSFPLNGTYFQVNEVFADHSSSHNPIHVERAQLWNLQRRMVFFGTSVSSIFKGLTTEEIQQCFWRGFVCVRGFDMETRAPRPLCPHLHIVARPKS

SEQ ID NO: 43889 - DNA, 736 bp, Panicum virgatum
  misc_feature: Ceres CLONE 2018643
  misc_feature: Encodes the peptide sequence at SEQ ID NO. 43890
atcactcacatccaaatccatcccaccacctccacgcacatcgagctccccacgccatggcatcccgacgccggccaagccctccggcggcggaagctctcctcccgctcgcgttcctgctcctatcctgcctgtccagcgccgccgccgcggccaagcagaccggccagctcaccgtcttctggggccggaacgcgggcgagggcaccctgcgcgaggcctgcgacacggggctctacaccaccgtcgtcatctccttctacagcgtcttcggccacggacgctactggggcgacctgtcgggccacccgctcgccggcgtcggcgccgacatcaagcactgccagtcccggaacgtcctcgtgctcctctccatcggcgggcccgggaccggctactccctcccgtcgtcccagtccgccgccgacgtcgccgacaacctctggaacgcgcacctcggcgggcgccgccgcggcgtgttccgccccttcggcgacgccgccgtcgacggcatcgacttctacgtcgaccgcggcgggccgggccactacgacgagctggcgcaccgcctcgacgggtacaaccggttctaccgcggccggaaaggggtgcggctgacggcgacgccgcggtgcgggttcccggactcccggctcgacggcgcgctgcggacggggctgttcgagcgcatccacgtccggttctacggcaacgacacgcggtgcgcctacggggc

SEQ ID NO: 43890 - protein, 226 aa, Panicum virgatum
  misc_feature: Ceres CLONE 2018643
  misc_feature (37)..(226): Pfam Name: Glyco_hydro_18 Pfam Description: Glycosyl hydrolases family 18
  misc_feature: SWISSPROT Homolog: EC 3.2.1.14 Chitinase
MASRRRPSPPAAEALLPLAFLLLSCLSSAAAAAKQTGQLTVFWGRNAGEGTLREACDTGLYTTVVISFYSVFGHGRYWGDLSGHPLAGVGADIKHCQSRNVLVLLSIGGPGTGYSLPSSQSAADVADNLWNAHLGGRRRGVFRPFGDAAVDGIDFYVDRGGPGHYDELAHRLDGYNRFYRGRKGVRLTATPRCGFPDSRLDGALRTGLFERIHVRFYGNDTRCAYG

SEQ ID NO: 43891 - DNA, 618 bp, Panicum virgatum
  misc_feature: Ceres CLONE 2018646
  misc_feature: Encodes the peptide sequence at SEQ ID NO. 43892
attgctcccgtcatcttcctctccaagacaagcaccagcgctaatccggtctcgccgcctgtctcgccggctcgcggctcccgtctcatccctccaggccggccatggcgttcaacaagatcaaggtcgccaaccccgtcgtggagatggacggcgatgagatgaccagggtgttctggaaatctatcaaggacaagctgatcttcccgttcgtggacttggatatcaaatactttgaccttggacttccacaccgtgatgccactgatgacaaagtcacagtggaggctgcggaggccacactcaagtataatgtggctatcaagtgtgccaccattacaccagacgaagcacgagtagaggagtttggcttgaaggccatgtggaaaagcccgaatggcacaattaggaacattctgaatggtactgtgttcagagaaccaatcatctgcaaaaacatcccacggcttgttccaggctggacaaaacccatttgcattgggaggcatgcatttggtgatcagtaccgggcaactgatgctgttatcaaggggcctggcaagcttaaattagtttttgagggaaaagaagaacaagttgagctagaggtgttcaact

SEQ ID NO: 43892 - protein, 171 aa, Panicum virgatum
  misc_feature: Ceres CLONE 2018646
  misc_feature (7)..(169): Pfam Name: Iso_dh Pfam Description: Isocitrate/isopropylmalate dehydrogenase
  misc_feature: SWISSPROT Homolog: EC 1.1.1.42 Isocitrate dehydrogenase (NADP(+))
MAFNKIKVANPVVEMDGDEMTRVFWKSIKDKLIFPFVDLDIKYFDLGLPHRDATDDKVTVEAAEATLKYNVAIKCATITPDEARVEEFGLKAMWKSPNGTIRNILNGTVFREPIICKNIPRLVPGWTKPICIGRHAFGDQYRATDAVIKGPGKLKLVFEGKEEQVELEVFN

SEQ ID NO: 43893 - DNA, 675 bp, Panicum virgatum
  misc_feature: Ceres CLONE 2018665
  misc_feature: Encodes the peptide sequence at SEQ ID NO. 43894
aataattgacacagcgcagagctctccatctccttccaccttccttggcagcaggtaactatacggttgtggaagatggcctcgccggttcgccgcccagggtccggcgagggaatggatgcaccaccaattggaacaggcgacgactcgcaggtgccggccagggactggtcggagctgccgctggacgccctcgcgtcggtcttcgtcaagctcggcgccatcgagatcctgatgggcgcgggcctcgtgtgccgctcctggctccacgccgccaagctgcccgacctgtggcgatccgtggacatggcgcgccacaaggtggtggacgacgtcttgtacatattcggcgcctctcctgtgaagccaaagatcaaccgcgatgtcctctgcgccattgcaagggtcgccgtggaccgctcccgcgggcagctggagacgttcgtggccaagcggttcgttaccgatcaactcctggagtacatcggcgacaggtcgccggctctgaaggccgtcgtcctcgtgtcgtgctgcggcgtctccaaccaagggttcacgcaactggtggccaggtgccctctgctagaggacctcatgcttgtgttctgccccaagatcggcggccgcgacgtctacgaggctaccggccgggcatgcccacagctcaagcgcttc

SEQ ID NO: 43894 - protein, 186 aa, Panicum virgatum
  misc_feature: Ceres CLONE 2018665
  misc_feature (17)..(65): Pfam Name: F-box Pfam Description: F-box domain
MDAPPIGTGDDSQVPARDWSELPLDALASVFVKLGAIEILMGAGLVCRSWLHAAKLPDLWRSVDMARHKVVDDVLYIFGASPVKPKINRDVLCAIARVAVDRSRGQLETFVAKRFVTDQLLEYIGDRSPALKAVVLVSCCGVSNQGFTQLVARCPLLEDLMLVFCPKIGGRDVYEATGRACPQLKR

SEQ ID NO: 43895 - DNA, 690 bp, Panicum virgatum
  misc_feature: Ceres CLONE 2018667
  misc_feature: Encodes the peptide sequence at SEQ ID NO. 43896
atgaaaaggactttgaaaagagagtcaaagagtgcttgaaattgccgggagggaagcggatgggggcctctcggcccacaaccacagctccgccgcttccgctctcggcttcgtctgcacgctaccccgcctcgccgccgcttctccctcgccccagcatggccgccgcgtcgtccgccacctccgtccacgacttcaccgtcaaggatgcgagcgggaaggacgttgacctcagcacctacaagggcaaggttctcctcatcgtcaacgttgcatcccagtgtggattaactaactccaactacaccgagttggcccagctctatgagaagtacaaggaccaaggctttgagatcctcgcttttccatgcaaccagtttggtgggcaggagcctggcaccaatgaggaaattgtccaatttgcctgcacacgcttcaaggctgagtaccccatctttgacaaggttgacgtcaacggtagcaatgccacacccctctacaagttcctgaagtctagcaagggtggcctgttcggtgacagcatcaagtggaacttctcaaagttcttggttgacaaggaggggcgcgttgtggatcgctacgctccgaccacttcccctctgagcattgagaaggacatcaagaagctgcttgggagctcttaaaccatctgtctagaacctgtagcgc

SEQ ID NO: 43896 - protein, 168 aa, Panicum virgatum; identical to SEQ ID NO: 18691
  misc_feature: Ceres CLONE 2018667
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50171
  misc_feature: Useful for making plants with modulated nitrogen use efficiency
  misc_feature: Functional homolog of the protein sequence given in SEQ ID NO 50170
  misc_feature: Useful for making plants with modulated flowering time

SEQ ID NO: 43897 - DNA, 706 bp, Panicum virgatum
  misc_feature: Ceres CLONE 2018674
  misc_feature: Encodes the peptide sequence at SEQ ID NO. 43898
attgctttgaggcttcaatgaatcgagaaaaattccctgaaaaagtaccattccgcttgaccagaatgcttgtgaaagctatggaagttagtggtatcgagggtacattccgaacaacttgtgaaaacgtgatgcaagtccttcgaacaaacagagacagcgtcatggccatgatggaggcatttgtacatgacccattaatcaattggcgtttgttcaatttcaacgaagttcctcaagtgtcaaactatggtaatgctcatgcagtcgtcagcagcgaagaggcagctgctaatcgggaactcgtacaacctctgcggggagcccgtgaaagggagctgttacaggctgtcaatcaacttggtgatgccaatgaggttttgaacgagcgtgctgtagcggtgatggcacggatgagtcacaagctaacagggcgcgacttctcttccgggtcagcatcaggagctggcagctcgacccaacatggcagtgaacactggtcttcaggagatgcccgggatacagaacctggtttatcagtgaaggttcaggttcagaagctcatactacaagcgacatctcacgaaaacttgtgccaaaattacgttgggtggtgccctttctggtgagctcttttgcaagcagtagctgtttagcctgtaaatactgtaaataccgtgtacatgcaagtatagtggtgttgttt

SEQ ID NO: 43898 - protein, 208 aa, Panicum virgatum
  misc_feature: Ceres CLONE 2018674
  misc_feature (176)..(208): Pfam Name: FATC Pfam Description: FATC domain
  misc_feature: SWISSPROT Homolog: EC 2.7.1.137 Phosphatidylinositol 3-kinase
CFEASMNREKFPEKVPFRLTRMLVKAMEVSGIEGTFRTTCENVMQVLRTNRDSVMAMMEAFVHDPLINWRLFNFNEVPQVSNYGNAHAVVSSEEAAANRELVQPLRGARERELLQAVNQLGDANEVLNERAVAVMARMSHKLTGRDFSSGSASGAGSSTQHGSEHWSSGDARDTEPGLSVKVQVQKLILQATSHENLCQNYVGWCPFW

SEQ ID NO: 43899 - DNA, 672 bp, Panicum virgatum
  misc_feature: Ceres CLONE 2018679
  misc_feature: Encodes the peptide sequence at SEQ ID NO. 43900
cttcgcacgcattcgcattcgcatccggcatccctcacccccaccgcacccacctccacacctccttcctcttccccccgctaaaacccaccgccaccgccgacggaaagggaccacggcgcgatggccgccatgcgggtggtgcggaacctggacctggagcggtacgcggagcggtggtacgagatcgcgtgcttcccgtccaggttccagcccaagacgggcaccaacacgcgcgccacctacacgctgaacgcggacggcaccgtgaaggtgctcaacgagacgtggaccgacggccgccggggccacatcgagggcacggcctggctcgccgacccggccagcgacgaggccaagctcaaggtccgcttctacgtgccgcccttcctccccgtcttccccgtcaccggcgactactgggtgctccacgtcgacgccgactaccagtacgcgctcgtcgggcagccctccaggaactacctctggatcctttgcaggcagcctcacatggacgagtccgtgtacaacgagctggtggagcgtgccaaggaggaagggtacgacgtgtcgaagctccgcaagacggcgcaccctgacccgccgccggagagcgagcagagcaccagggacggcgggatgtggtggatcaagtccatttttggcaagtag

SEQ ID NO: 43900 - protein, 182 aa, Panicum virgatum
  misc_feature: Ceres CLONE 2018679
  misc_feature (10)..(157): Pfam Name: Lipocalin_2 Pfam Description: Lipocalin-like domain
MAAMRVVRNLDLERYAERWYEIACFPSRFQPKTGTNTRATYTLNADGTVKVLNETWTDGRRGHIEGTAWLADPASDEAKLKVRFYVPPFLPVFPVTGDYWVLHVDADYQYALVGQPSRNYLWILCRQPHMDESVYNELVERAKEEGYDVSKLRKTAHPDPPPESEQSTRDGGMWWIKSIFGK

SEQ ID NO: 43901 - DNA, 703 bp, Panicum virgatum
  misc_feature: Ceres CLONE 2018686
  misc_feature: Encodes the peptide sequence at SEQ ID NO. 43902
atcgttcgactctcatttactgtgattaaccagcaagagtagcctccatttcaatcaccaccttgcaaccaatatggccacagttgatataccccgacagcaaaaagccgccgtcaaggttggtgaaggcgttgatgctaaagctcccgtccaacaggtcgatgttcaatctcctggaccaactgaagtcctcgtcaaaatcaactggactggcctctgtgcttccgacaaatctctaatacacgatgaatgggcagccttcggggtggccatgcaacctgccaccaaaggcatcgctggccacgagggtgccggtgttgttgtcgctgtaggggacgatatgcatcataaatggaaagtgggcgaccgtgccggtatcaaatgggtatggggtacttgtggcgaatgcgagttttgcacgaacggcagcgatgagctccattgtccaaagcagaagaactcagggttcactgcagcaggcactttccagcaatatgctgtcagtgatggcagatacaccacccgtatccccgaaggtgtttccgatgaggaagccggtcctatcatgtgtggtggcgtgacagcatacgttgcttgcaagaggagctctgttcgccctggccaatggattgttcttcccggtgcaggaggcgggcttggccattttgctgttcaatatgccaaggctatgggcatgcgaatc

SEQ ID NO: 43902 - protein, 209 aa, Panicum virgatum
  misc_feature: Ceres CLONE 2018686
  misc_feature (36)..(152): Pfam Name: ADH_N Pfam Description: Alcohol dehydrogenase GroES-like domain
  misc_feature: SWISSPROT Homolog: EC 1.1.1.1 Alcohol dehydrogenase
MATVDIPRQQKAAVKVGEGVDAKAPVQQVDVQSPGPTEVLVKINWTGLCASDKSLIHDEWAAFGVAMQPATKGIAGHEGAGVVVAVGDDMHHKWKVGDRAGIKWVWGTCGECEFCTNGSDELHCPKQKNSGFTAAGTFQQYAVSDGRYTTRIPEGVSDEEAGPIMCGGVTAYVACKRSSVRPGQWIVLPGAGGGLGHFAVQYAKAMGMR

SEQ ID NO: 43903 - DNA, 693 bp, Panicum virgatum
  misc_feature: Ceres CLONE 2018689
  misc_feature: Encodes the peptide sequence at SEQ ID NO. 43904
gaaagggtcgtgcgactcttgttgttgtcgttcaagctgcgtcgattcacgcacctccgcacctcagggtcccgctactgtagctcctaccctaccctcctacgtcccccgtcgtcgacgttccaatcgacagccccagcctctttccatagcctctttagctcttcatcgagtcgatttctcgtaattcgatcgatacagcaacacaacaacagcagcctcgcaaactacacaaccatggaaagcgctcagaagccgacggtgatcttcgtgctgggtgggcccgggtcgggcaagggcaccaactgcgctcgcatcgtggaggactttggattcgtccatctgtccgccggcgacctgctgcgtgaggagcaggccagcggctcgcagcatggcgagatgatcaagaccatgatcaaggagggcaagatcgtgccgtcggaggtcaccgtgaccctcctcgagaacgccatggagaggagccccaccaagaagttcctcatcgacgggttccccaggaatgaggagaacaaccagtcgtgggagcgccaggtggcacccaaggtcaactttgagttcgtgctcgtgctcgactgccccgagcaggtcctcgaggagcgtctcctcaagcgaggccaggcctctggtcgtgctgacgacaacctggagagcatcaggaagcgcttccacacg

SEQ ID NO: 43904 - protein, 151 aa, Panicum virgatum
  misc_feature: Ceres CLONE 2018689
  misc_feature (12)..(151): Pfam Name: ADK Pfam Description: Adenylate kinase
  misc_feature: SWISSPROT Homolog: EC 2.7.4.14 Cytidylate kinase
MESAQKPTVIFVLGGPGSGKGTNCARIVEDFGFVHLSAGDLLREEQASGSQHGEMIKTMIKEGKIVPSEVTVTLLENAMERSPTKKFLIDGFPRNEENNQSWERQVAPKVNFEFVLVLDCPEQVLEERLLKRGQASGRADDNLESIRKRFH

SEQ ID NO: 43905 - DNA, 758 bp, Panicum virgatum
  misc_feature: Ceres CLONE 2018710
  misc_feature: Encodes the peptide sequence at SEQ ID NO. 43906
aggaccgtgaagctaagccaaagtcatcaaagggcggtgcacgtcacgcagttggtgatactatagtttactggtacgctactgacaactcctagctaggtggctaccagatagagtgttcgagaatgagccaggagcagccgaggaggccgtccggccagcaggcggcgggcggcggcggcggcgagcagggcgccgtccgctacggcgacgtctttccggcggtgagcggcggcctcgcggagaagcccatcgcgccgcaggacgcggccacgatgcagtcggcggagaacctcgtgttcgggcagacgctcaggggcgggcccgccgccgccatgcagtccgcggccaccaccaacgagcggatgggcgtcgtcgggcacgaccaggccacggacgccaccgccgtgcagggcgtcaccgtctccgagacccgcgtcccgggcggacgcatcgtcaccgagttcgtcgccgggcaggctgttggccagtacctcgcgagggacgatgatgccacggccggtggcggcgccggagccggggcgggaggtgcagcgccaggacgacgcgtcgccgccgctgctggcgtgtcggataacaggaaggtgacgatcggcgaggcgctggaggcgacggcgctcgccgcgggcgacgagccggtggagcgcagcgacgcggccgccatccaggcggcggaggcaagggccactgggctggacgcgaacgtccccggcggccttgccgcgcaggcgcagtcc

SEQ ID NO: 43906 - protein, 210 aa, Panicum virgatum
  misc_feature: Ceres CLONE 2018710
  misc_feature (24)..(83): Pfam Name: SMP Pfam Description: Seed maturation protein
  misc_feature (160)..(210): Pfam Name: SMP Pfam Description: Seed maturation protein
MSQEQPRRPSGQQAAGGGGGEQGAVRYGDVFPAVSGGLAEKPIAPQDAATMQSAENLVFGQTLRGGPAAAMQSAATTNERMGVVGHDQATDATAVQGVTVSETRVPGGRIVTEFVAGQAVGQYLARDDDATAGGGAGAGAGGAAPGRRVAAAAGVSDNRKVTIGEALEATALAAGDEPVERSDAAAIQAAEARATGLDANVPGGLAAQAQ

SEQ ID NO: 43907 - DNA, 654 bp, Panicum virgatum
  misc_feature: Ceres CLONE 2018713
  misc_feature: Encodes the peptide sequence at SEQ ID NO. 43908
atgccagtgccacgcgcgcaccatcatcccgatcccctgacagcctgaccccatcttccttctccggccggaaagcaactactccgcgtcccggccgctacccttttccccgcaccgcacggcggagaccacgatccccgccggccgacgaagtagggatcgcgagttgcgacgaggaaggagaggaggctcctcgatcccgctgcagttatctattcatttcgatcgggggtcgcggtgatttggtaggagccttcgggagcagcggcgatgtcgggcgtgttcggcagggtgttcgggaagtccaagcagcagagccaggccaccgcgctggcctctctggacaagctcaacgagacacttgaaatgttggaaaagaaggaaaatttgctagtgaaaaaggcgaatcttgaagtagagaaggccaagaatttcaccaaagccaagaataagagagccgcaatacagtgcttgaagaggaagaggttatatgagcaacaaattgagcagcttggaaatttccagctaaggatacatgatcagatgattatgctagaagccgcaaaagctacaacagagactgtggatgcattgagaactggagcatccgcaatgaaagctatgcacaaatcaacaaatattgatgatgttgac

SEQ ID NO: 43908 - protein, 127 aa, Panicum virgatum
  misc_feature: Ceres CLONE 2018713
  misc_feature (22)..(127): Pfam Name: Snf7 Pfam Description: Snf7
  misc_feature: Functional homolog of the protein sequence given in SEQ ID NO 50916
  misc_feature: Useful for making plants with modulated nitrogen use efficiency
MSGVFGRVFGKSKQQSQATALASLDKLNETLEMLEKKENLLVKKANLEVEKAKNFTKAKNKRAAIQCLKRKRLYEQQIEQLGNFQLRIHDQMIMLEAAKATTETVDALRTGASAMKAMHKSTNIDDV

SEQ ID NO: 43909 - DNA, 655 bp, Panicum virgatum
  misc_feature: Ceres CLONE 2018720
  misc_feature: Encodes the peptide sequence at SEQ ID NO. 43910
caccgcgccgatggaatcagacgccgaggaggaggccgcggcgaccccggcggcggcggcggggccggccgcggggcgactgaagggaagcccggagctgactgtggacgcggacatgcaagagatggctaaggcggccgcgtggagcgtcagctcctacaaggccggcaacggcgtcgcggccctccgcgacgacaacctagacacctactggcagtcggacggcgcgcagccacacctggtgaacatccagttccagaagaaggtgcagctgcagcttgttgtgctctacgtggacttcaagctcgacgagagctacacgccgagcaagatctccatccgggccggggatggcttccacaacctcaaggaaattaaaactgtggagcttgcaaagccagttggttgggtccatatatcattatctggggctgatccacgagaaacattcattcatacatttatgctccaaattgcgattttgtccaatcacctaaacgggcgggacactcatatccgacagatcaagatctatgggccaagaccgaatcctgttccccaccagccatttcattttacttccagggagttcatcacatactccaccattagatgacaatcaacaaaccaagtcgtcaggagtcctccatgctgg

SEQ ID NO: 43910 - protein, 201 aa, Panicum virgatum
  misc_feature: Ceres CLONE 2018720
  misc_feature (7)..(200): Pfam Name: APC10 Pfam Description: Anaphase-promoting complex, subunit 10 (APC10)
MESDAEEEAAATPAAAAGPAAGRLKGSPELTVDADMQEMAKAAAWSVSSYKAGNGVAALRDDNLDTYWQSDGAQPHLVNIQFQKKVQLQLVVLYVDFKLDESYTPSKISIRAGDGFHNLKEIKTVELAKPVGWVHISLSGADPRETFIHTFMLQIAILSNHLNGRDTHIRQIKIYGPRPNPVPHQPFHFTSREFITYSTIR

SEQ ID NO: 43911 - DNA, 640 bp, Panicum virgatum
  misc_feature: Ceres CLONE 2018723
  misc_feature: Encodes the peptide sequence at SEQ ID NO. 43912
agcaactcccgcgccacaagctttcgctgccatggcactcgtctcggcctcctcctcctcctccaccaccgccgtcgcggcgctccccaggaatgggcagcgggcgccgtccttcctcggcggcaagacgctgctgaggcaggccgaggcggcgcggccatcgttcgccgtgcgcgccgcggcggaccccgacaggcccatctggttccccggcagcaccccgccgccgtggctcgacggcagcctccccggcgacttcggctttgatccctggggcctcggatctgacccggagagcttgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggccgacatcatcaagcccgggagcgtcaacaccgaccccatcttccccaacaacaagctcaccggcaccgacgtcgggtaccctggtggcctgtggtttgacccgctcggctggggcagcggctcgccggag

SEQ ID NO: 43912 - protein, 202 aa, Panicum virgatum
  misc_feature: Ceres CLONE 2018723
  misc_feature (63)..(200): Pfam Name: Chloroa_b-bind Pfam Description: Chlorophyll A-B binding protein
  misc_feature: Functional homolog of the protein sequence given in SEQ ID NO 50113
  misc_feature: Useful for making plants with modulated oxidative stress sensitivity
  misc_feature: Functional homolog of the protein sequence given in SEQ ID NO 50109
  misc_feature: Useful for making plants with modulated nitrogen use efficiency
MALVSASSSSSTTAVAALPRNGQRAPSFLGGKTLLRQAEAARPSFAVRAAADPDRPIWFPGSTPPPWLDGSLPGDFGFDPWGLGSDPESLRWNVQAELVHCRWAMLGAAGIFIPEFLTKIGILNTPFWYTAGEQQYFTDTTTLFIIELILIGWAEGRRWADIIKPGSVNTDPIFPNNKLTGTDVGYPGGLWFDPLGWGSGSP

SEQ ID NO: 43913 - DNA, 643 bp, Panicum virgatum
  misc_feature: Ceres CLONE 2018725
  misc_feature: Encodes the peptide sequence at SEQ ID NO. 43914
ctcgatccgtgacacacacgaagccgcaaatcacagcctgattccgaccgatccgtagcagatcagctcgtcgacgccaatgtattacggcgagatcccggaccaccgccatcgcctcatccactccgttggcgatggcttcatacttggtggagcgtacggctgcgtcgtccccttcatcaggggcttccgcggctcgcccagcggcgcccgactggccgccggagcccaggaagttctcaggaacgctcctcgccacgccggctggatggccgccttctcggccgtgctgttctccgtggacacggccatgtcgctcgcgcgacggagggaggaccccttgaaccccatcgccggcggcgccgtcgccttggccttactccgtatgcaccgaggcgcccgcgctgcagcgctgtccgctcccgtcggcgccgcggccgtcgcggtgctcttgggcgtcgattggtacatgtccgagttgctaagccgcctcatgtctcgcactgataccctggcgtatctcaatccccgaccgggggctgcatgggttttcccagacgaaccatcgaaacaactggaagagaaaaaaaaagctgtgcagaactactactacaattatgtactccctctgtctccaataagt

SEQ ID NO: 43914 - protein, 187 aa, Panicum virgatum
  misc_feature: Ceres CLONE 2018725
  misc_feature (4)..(131): Pfam Name: Tim17 Pfam Description: Tim17/Tim22/Tim23 family
MYYGEIPDHRHRLIHSVGDGFILGGAYGCVVPFIRGFRGSPSGARLAAGAQEVLRNAPRHAGWMAAFSAVLFSVDTAMSLARRREDPLNPIAGGAVALALLRMHRGARAAALSAPVGAAAVAVLLGVDWYMSELLSRLMSRTDTLAYLNPRPGAAWVFPDEPSKQLEEKKKAVQNYYYNYVLPLSPI

SEQ ID NO: 43915 - DNA, 678 bp, Panicum virgatum
  misc_feature: Ceres CLONE 2018731
  misc_feature: Encodes the peptide sequence at SEQ ID NO. 43916
ctctcgcagtctcgctcgctcgtccccccttcttccaagcggcgacgacaggggagtggcgacgcccttgccttgcgagttcttcgtcgggcacttcgccggccgacaagttcaagcaggctgatggctacatcagagccagtacaagaaagtttgatgctggactacccacaacgtagtaagcctcgggtccttcttgctgcttcaggaagtgtagctgctataaaatttgagagcctttgtcgtagtttctctgagtgggcggatgtccgagctgtggccaccaaatcatccttgcactttgttgatagatcatctctacctagtggcattgccctttacactgatgatgatgaatggtctacctggaagaagataggagatgaggttttacacatcgagttgcggaaatgggctgatattttggtgattgcaccgttgtcagcaaataccctggctaagattgccggtggcctatgtgacaacctcttgacatgcattgtgagagcatgggactacagcaaaccactctttgttgccccagctatgaacacattaatgtggaacaacccattcacggaacgtcatcttcagacgatcaaccaactgggcataatcttgatccccccagttaccaaaaggttggcttgcggtgattacggaaatggtgcgatggct

SEQ ID NO: 43916 - protein, 184 aa, Panicum virgatum
  misc_feature: Ceres CLONE 2018731
  misc_feature (21)..(141): Pfam Name: Flavoprotein Pfam Description: Flavoprotein
  misc_feature: SWISSPROT Homolog: EC 4.1.1.36 Phosphopantothenoylcysteine decarboxylase
  misc_feature: Functional homolog of the protein sequence given in SEQ ID NO 51681
  misc_feature: Useful for making plants with modulated flowering time
MATSEPVQESLMLDYPQRSKPRVLLAASGSVAAIKFESLCRSFSEWADVRAVATKSSLHFVDRSSLPSGIALYTDDDEWSTWKKIGDEVLHIELRKWADILVIAPLSANTLAKIAGGLCDNLLTCIVRAWDYSKPLFVAPAMNTLMWNNPFTERHLQTINQLGIILIPPVTKRLACGDYGNGAM

SEQ ID NO: 43917 - DNA, 653 bp, Panicum virgatum
  misc_feature: Ceres CLONE 2018735
  misc_feature: Encodes the peptide sequence at SEQ ID NO. 43918
gtgccctctcctcctcactcgccgcaggacaggcagaatccgagcaaagggaaaggctttgctagctctgcccctccggccagcgtacgatcgagctacctgccgcgggcctgcccgcccaaatatctccaaggaaacacctaagaacagcgccccttcgaggcaagaatcagcagcaagctcccggccggcgagctgagcttttcgtattgcgctagctagctaagctaagctagctaccaatggaggcggcgccgctgggctggggacggcaggaggtggacgggtggaggaagggcccgtggaccagccaggaggacacgctcctcgtcgagcacgtccggcagcacggcgaggggcggtggaactccgtctccaagctcacaggtctgaagaggagtggcaagagctgcaggctccggtgggttaactacctgagaccagatctgaagcgaggcaagatcacgccccaggaggagagcatcatagtccagctccacgctttgtggggaaacaggtggtcgacgatcgcgcgcagcctgccgggcaggacggacaacgagatcaagaactactggaggacgcacttcaagaaggggaagccggccaagaacatcgagcgcgcgagggcgcggttcctcaagcagcggcag

SEQ ID NO: 43918 - protein, 136 aa, Panicum virgatum
  misc_feature: Ceres CLONE 2018735
  misc_feature (18)..(65): Pfam Name: Myb_DNA-binding Pfam Description: Myb-like DNA-binding domain
  misc_feature (71)..(116): Pfam Name: Myb_DNA-binding Pfam Description: Myb-like DNA-binding domain
  misc_feature: The sequence is a functional homolog of SEQ ID NO 1572 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 126 in the 10/412,699 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 36 in US patent 7193132
  misc_feature: The sequence is a functional homolog of SEQ ID NO 1566 in the 10/374,780 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: Functional homolog of the protein sequence given in SEQ ID NO 50239
  misc_feature: Useful for making plants with modulated biomass
  misc_feature: Useful for making plants with modulated flowering time
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1564 in the 10/374,780 US patent application
  misc_feature: The sequence is a functional homolog of SEQ ID NO 1563 in the 10/374,780 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1565 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 2178 in the 10/374,780 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 186 in the 10/412,699 US patent application
  misc_feature: The sequence is a functional homolog of SEQ ID NO 824 in the 10/412,699 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: Functional homolog of the protein sequence given in SEQ ID NO 50478
  misc_feature: Useful for making plants with altered lignin content
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Functional homolog of the protein sequence given in SEQ ID NO 50784
  misc_feature: Useful for making plants with altered alkaloid content
  misc_feature: Useful for making plants with modulated nitrogen use efficiency
  misc_feature: The sequence is a functional homolog of SEQ ID NO 296 in the 11/479,226 US patent application
  misc_feature: The sequence is a functional homolog of SEQ ID NO 569 in the 10/374,780 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1004 in the 11/435,388 US patent application
  misc_feature: The sequence is a functional homolog of SEQ ID NO 1002 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 271 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1010 in the 11/435,388 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1073 in the 10/374,780 US patent application
  misc_feature: The sequence is a functional homolog of SEQ ID NO 796 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 794 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: Functional homolog of the protein sequence given in SEQ ID NO 51682
  misc_feature: Useful for biocontainment applications
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 726 in the 11/435,388 US patent application
  misc_feature: The sequence is a functional homolog of SEQ ID NO 822 in the 10/412,699 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 743 in the 10/666,642 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 790 in the 11/435,388 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1681 in the 10/374,780 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 442 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 446 in the 10/412,699 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1917 in the 10/374,780 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 58 in the 10/666,642 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1692 in the 11/479,226 US patent application
  misc_feature: The sequence is a functional homolog of SEQ ID NO 836 in the 10/412,699 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
MEAAPLGWGRQEVDGWRKGPWTSQEDTLLVEHVRQHGEGRWNSVSKLTGLKRSGKSCRLRWVNYLRPDLKRGKITPQEESIIVQLHALWGNRWSTIARSLPGRTDNEIKNYWRTHFKKGKPAKNIERARARFLKQR

SEQ ID NO: 43919 - DNA, 724 bp, Panicum virgatum
  misc_feature: Ceres CLONE 2018739
  misc_feature: Encodes the peptide sequence at SEQ ID NO. 43920
ggcatttttagaaacttgactaacctgtcaattactggaaacaatgaactttgtggtggaatgcctcagcttcatttagctccatgccaagtgaacactgtgaaaaagaatagaaaagggtggttaaagtccctaataatagctctgacaactattggtgcaatctttttcttaactttggttatagtttccgttcatatcatctgtatgaagcttagacgaaaacagcatggcccattccaaccaccaatagttgatgaacagtatgaaagagtttcttatcaagaaatagcaaatggaaccaatggattttcagaagccaatttgctaggtaagggaagctttggcatggtctataaatgcaattttcaagatgatggacctattgctgcagtgaaggtttttaaccttgagcaatccggatctactagaagttttgttgctgaatgtgaagcgctgagaagggtgcgtcaccgttgtctcataaaaatcattacatgctgctcaagcatcaatcaccaaggccaagagttcaaggctctggttttcgagtttatgccaaatggtagcttaagtgattggcttcatccaaaatctagaatgcccacagtgaccaatactctcagcctagcacaaaggctcgatatatctgttgatatcatggatgccttggattatcttcataatcactgtcagccatcaatcattcattgcgatctcaagc

SEQ ID NO: 43920 - protein, 241 aa, Panicum virgatum
  misc_feature: Ceres CLONE 2018739
  misc_feature (104)..(240): Pfam Name: Pkinase_Tyr Pfam Description: Protein tyrosine kinase
  misc_feature: SWISSPROT Homolog: EC 2.7.11.1 Non-specific serine/threonine protein kinase
GIFRNLTNLSITGNNELCGGMPQLHLAPCQVNTVKKNRKGWLKSLIIALTTIGAIFFLTLVIVSVHIICMKLRRKQHGPFQPPIVDEQYERVSYQEIANGTNGFSEANLLGKGSFGMVYKCNFQDDGPIAAVKVFNLEQSGSTRSFVAECEALRRVRHRCLIKIITCCSSINHQGQEFKALVFEFMPNGSLSDWLHPKSRMPTVTNTLSLAQRLDISVDIMDALDYLHNHCQPSIIHCDLK

SEQ ID NO: 43921 - DNA, 657 bp, Panicum virgatum
  misc_feature: Ceres CLONE 2018754
  misc_feature: Encodes the peptide sequence at SEQ ID NO. 43922
atatagtcgtgttcccgaggtccccaggagcgcagcacccactccccaaatcttccggcgaccacccccgactacggcgagatcttccgggggccggcgagatgagccgcggcacaggcgcgggctacgaccgccacatcaccatcttctcccccgagggccgcctctaccaagtcgagtacgcgttcaaggcggtcaagtcggtgggggtcacgtcgatcggcgtccgcggcgaggactccgtatgcgtcgtcacccagaagaaagtgccggataagttgctggatcagacgagcgtgacgcacctgttcccaatcaccaagttcgtcggattgcttgccactggccttacagctgatgcaaggtcgttggttgcccaagcaaggaatgaagcagctgagtttcgcttcaaatggggttatgagatgcctgtagatgtgttagcgaaatggatcgctgacaaagcgcaagtttacacgcagcatgcctacatgagaccccttggcgtagttgctatggtcttgggctatgacgaagagaaaaatgctcaactcttcaagtgtgaccctgctggtcacttctttggacacaaggcaactagtgccgggcttaaggagcaagaagcaataattttcttgagaagaaaatgaaggatga

SEQ ID NO: 43922 - protein, 182 aa, Panicum virgatum
  misc_feature: Ceres CLONE 2018754
  misc_feature (33)..(177): Pfam Name: Proteasome Pfam Description: Proteasome A-type and B-type
  misc_feature: SWISSPROT Homolog: EC 3.4.25.1 Proteasome endopeptidase complex
MSRGTGAGYDRHITIFSPEGRLYQVEYAFKAVKSVGVTSIGVRGEDSVCVVTQKKVPDKLLDQTSVTHLFPITKFVGLLATGLTADARSLVAQARNEAAEFRFKWGYEMPVDVLAKWIADKAQVYTQHAYMRPLGVVAMVLGYDEEKNAQLFKCDPAGHFFGHKATSAGLKEQEAIIFLRRK

SEQ ID NO: 43923 - DNA, 660 bp, Panicum virgatum
  misc_feature: Ceres CLONE 2018758
  misc_feature: Encodes the peptide sequence at SEQ ID NO. 43924
gtttattaatggccagcatttcagaagataacaacgaagaaactcctttgcaggtacggttgaatggagtagcaacattcataggtatcgtagggctttctgttgctgctatggtccttgtagtcctctttgcaaggtatttttcaggacataccacaaattcagatggctctgttcagtttgtcaaggggcgcacaagtgtgaaatctgcaatatttggatcaataaagatactgactgttgcagtgaccattgttgttgttgctgtacctgagggcctaccactggctgtcacactaactctggcttattccatgaggaaaatgatggctgacaaagcactggtgcggaggctttctgcctgtgaaacaatgggttcagctactactatttgtagtgacaagactggtacattaacattaaatcagatgaccgttgtgcaatcaattgttggcgaagtgaagcagcaagctcctgctaatattgataacctgtcacctagtgtagtctcacttctacttgaaggaattgcacagaatacttcaggaagtgtgtttgaggcacaggatggtagcatcgagataaccggctcaccaacggaaaaggctatccttgcttggggtcttgaacttcggatgaaatttacggaggagagatcac

SEQ ID NO: 43924 - protein, 219 aa, Panicum virgatum
  misc_feature: Ceres CLONE 2018758
  misc_feature: SWISSPROT Homolog: EC 3.6.3.8 Calcium-transporting ATPase
LLMASISEDNNEETPLQVRLNGVATFIGIVGLSVAAMVLVVLFARYFSGHTTNSDGSVQFVKGRTSVKSAIFGSIKILTVAVTIVVVAVPEGLPLAVTLTLAYSMRKMMADKALVRRLSACETMGSATTICSDKTGTLTLNQMTVVQSIVGEVKQQAPANIDNLSPSVVSLLLEGIAQNTSGSVFEAQDGSIEITGSPTEKAILAWGLELRMKFTEERS

SEQ ID NO: 43925 - DNA, 488 bp, Panicum virgatum
  misc_feature: Ceres CLONE 2018769
  misc_feature: Encodes the peptide sequence at SEQ ID NO. 43926
  misc_feature (414)..(414): n is a, c, t, g, unknown, or other
attccgaactcccgcttccaacccctccccagatcgccgcttctccactagagccgagccgatcgatggatcacgagcagcggcgccgccagcgcagtcccaggggcaatgctcccggaagcgggagcgggagcggcggcgcgtcgtcggggaagcacaagggtggaggcggcaagggcgggggcaagaagcagatcaaggtggtgtacatctccaaccccatgcgcgtcaagaccagcgccgcgggcttccgcgccctcgtgcaggagctcaccggccgcgacgccgacccctccaagtacagccccgacgagctcggcggcgcgggcgccgccgacgccaccgcggccgccgacctcgactgcggccccgcgcatgggctcatgctcagccccggggggcgcggcggcgtgnggcgagtccggcgtcgcgagccccggccctgccgcggcggactaccatcccgccgccgccgccgccgccgcgcc

SEQ ID NO: 43926 - protein, 140 aa, Panicum virgatum
  misc_feature: Ceres CLONE 2018769
  misc_feature (48)..(78): Pfam Name: VQ Pfam Description: VQ motif
  misc_feature (117)..(117): Xaa is any aa, unknown, or other
MDHEQRRRQRSPRGNAPGSGSGSGGASSGKHKGGGGKGGGKKQIKVVYISNPMRVKTSAAGFRALVQELTGRDADPSKYSPDELGGAGAADATAAADLDCGPAHGLMLSPGGRGGVXRVRRREPRPCRGGLPSRRRRRRR

SEQ ID NO: 43927 - DNA, 660 bp, Panicum virgatum
  misc_feature: Ceres CLONE 2018772
  misc_feature: Encodes the peptide sequence at SEQ ID NO. 43928
acctcaaacagcgatctctcgaatccgcatcccccaattccccaaccgcccaaacaccgccgcgccgcgagccccaaagcagccgcagcaccaccgatggcgcccaaggcggagaagaagccggcggcgaagaagcccgcggaggaggagctcgcggccgagaaggccccggcggggaagaagcccaaggcggagaagcgcctccccgcgggcaagtccggcgccggcaaggacggcgagggcaagaagggcaagaagaaggccaagaagagcgtcgagacctacaagatctacatcttcaaggtgctcaagcaggtgcacccggacatcggcatctcctccaaggccatgtccatcatgaactccttcatcaacgacatcttcgagaagctcgccgccgaggccgccaagctcgcccgctacaacaagaagcccaccatcacctcccgcgagatccagacctccgtccgcctcgtcctccccggggagctcgccaagcacgccgtctctgagggcaccaaggccgtcaccaagttcacatcgtcctagttaggtttgccgcgtctggtggtgccagtactggttcgtagggtgccgctgctagtcctggtttcctcggtttattttatctggtagcagtagtattgtcatcagcactgt

SEQ ID NO: 43928 - protein, 150 aa, Panicum virgatum
  misc_feature: Ceres CLONE 2018772
  misc_feature (57)..(127): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAAKKPAEEELAAEKAPAGKKPKAEKRLPAGKSGAGKDGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 43929 - DNA, 755 bp, Panicum virgatum
  misc_feature: Ceres CLONE 2018781
  misc_feature: Encodes the peptide sequence at SEQ ID NO. 43930
accgccatcgcagcatcatagccagcgctcaacttgacggtaattagccgcgtcgccatctcggtctgtttacgagatcaacccggaataatcacccctaaccttacctcattctccgtttccacccttcaacaccgccaacatgggcataggaggatctaagatgtggggatggctctccctgctcatgaagcagaaggagatgcgtattctgatggttggtcttgatgctgccggaaagaccaccattttgtataagctcaagctgggcgaggtcgtcactaccatcccgaccattggctttaacgtcgaaaccgtcgagtaccggaacatccagttcaccgtgtgggatgtcggtggccaggacaagatccgtcctctgtggagacattacttccagaacacccagggtatcattttcgtcgtcgacagtaacgatcgtgatcgtgtgcccgaggctcgcgaagagctgcagcgcatgctgaacgaggacgagctgagggacgcccttctcttggttttcgccaacaagcaggatctgccgaatgccatgagcgttgccgagatcacagacaagctcggtctccacagcctgcggcaacgcacctggtacatccaatccacttgcgccacctcgggtgacggtctcttcgagggtctcgactggcttgcccaggaaatcaagtcgagaaactaaggcgcccttgagacgccgggggaccggctttcttcgcccctcagacaagcgtggctcg

SEQ ID NO: 43930 - protein, 184 aa, Panicum virgatum
  misc_feature: Ceres CLONE 2018781
  misc_feature (5)..(180): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
MGIGGSKMWGWLSLLMKQKEMRILMVGLDAAGKTTILYKLKLGEVVTTIPTIGFNVETVEYRNIQFTVWDVGGQDKIRPLWRHYFQNTQGIIFVVDSNDRDRVPEAREELQRMLNEDELRDALLLVFANKQDLPNAMSVAEITDKLGLHSLRQRTWYIQSTCATSGDGLFEGLDWLAQEIKSRN

SEQ ID NO: 43931 - DNA, 685 bp, Panicum virgatum
  misc_feature: Ceres CLONE 2018790
  misc_feature: Encodes the peptide sequence at SEQ ID NO. 43932
aaaaaagaggccccgcttcgcttcccgcccagctgccgcgctgcgcctgcgcctctccctcgcccgtcttcctcagctcgacctctctcgccgccccgactccgtccgatgccgccgccgctcgaggcgcgcaaagagaggatcgcaaagatgaagaaaggtgtaattgttgtgaataatgctcgaggagcaatcatggatactcaggcagttgcagacgcttgttccagtggtcacattgctgggtatggtggtgatgtgtggttcccccagccagcaccaaaggatcacccatggcgctacatgcctaaccatgccatgaccccccacatctctgggactacaattgatgctcagctgcggtatgccgagggtgtgcgggacatgctggacaggtacttcaagggtgaggacttccccgtgcaaaactacatcgtcaaggaaggccagctcgcaagccaataccagtgatcgcgcacaccataggccagagctgtatccttttctttcctctggtgagaattgcgaggagaaactgttgttccatcgctgtatgtgtagaagaagttctcacggagacctgtcggccaccggaaataaacaagatatgcctttgctggcattgcatcgtggaaataaactagactttgtggttggtctcgtgggatcgtcgttaaccctgcca

SEQ ID NO: 43932 - protein, 120 aa, Panicum virgatum
  misc_feature: Ceres CLONE 2018790
  misc_feature (2)..(76): Pfam Name: 2-Hacid_dh_C Pfam Description: D-isomer specific 2-hydroxyacid dehydrogenase, NAD binding domain
  misc_feature: SWISSPROT Homolog: EC 1.2.1.2 Formate dehydrogenase
MPPPLEARKERIAKMKKGVIVVNNARGAIMDTQAVADACSSGHIAGYGGDVWFPQPAPKDHPWRYMPNHAMTPHISGTTIDAQLRYAEGVRDMLDRYFKGEDFPVQNYIVKEGQLASQYQ

SEQ ID NO: 43933 - DNA, 766 bp, Panicum virgatum
  misc_feature: Ceres CLONE 2018796
  misc_feature: Encodes the peptide sequence at SEQ ID NO. 43934
atggctcggcaccggaacttgataaagatactgaacgtctgctccaaccttgagtttaaagcactggtgcttcagtacatgcccagtggcagcttagatatgctcttacactctgaagacagagagcacttgggattcctcaagaggctggacatcttgctagatgtgtcgatggcaattgagtatctgcaccatgagcatcatgaggtggtgctgcattgtgacttgaagcctagcaacgtgctatttgatgccgacatggtggtgcatgtagcagactttggaatcgcaaagctcctatcaggcgttgacaactctgtgatcactgcaagcatgcctggaacacttgggtacatggcaccagagtatggatcttatggaaaggcctcacgcaagagcgatgttttcagttacggaatcgtgctccttgaactcttaactggaaaaagacccacggatcctatgttcgttggagatttgagcattaggaagtgggttcgtcaggcatttccaactgagcttgactctgtcgtggaccatcagctactactaggcgcctcttcctcagcctgcaacgtccacgacttcctttcaccaatatttgaggtctgtttgctctgctcaagtgactcacatgaccaaaggttgtcaatgaaagatgtcacggggggcactcaagaagatcagaaaggactatacccaatcgacatcagcaactgagcagagtgccgttcgttccctcccttggagaactgcaccacccatc

SEQ ID NO: 43934 - protein, 239 aa, Panicum virgatum
  misc_feature: Ceres CLONE 2018796
  misc_feature (1)..(232): Pfam Name: Pkinase_Tyr Pfam Description: Protein tyrosine kinase
  misc_feature: SWISSPROT Homolog: EC 2.7.11.1 Non-specific serine/threonine protein kinase
MARHRNLIKILNVCSNLEFKALVLQYMPSGSLDMLLHSEDREHLGFLKRLDILLDVSMAIEYLHHEHHEVVLHCDLKPSNVLFDADMVVHVADFGIAKLLSGVDNSVITASMPGTLGYMAPEYGSYGKASRKSDVFSYGIVLLELLTGKRPTDPMFVGDLSIRKWVRQAFPTELDSVVDHQLLLGASSSACNVHDFLSPIFEVCLLCSSDSHDQRLSMKDVTGGTQEDQKGLYPIDISN

SEQ ID NO: 43935 - DNA, 1058 bp, Panicum virgatum
  misc_feature: Ceres CLONE 2018800
  misc_feature: Encodes the peptide sequence at SEQ ID NO. 43936
aaactaccgtatggccatggcgtccgcccttgggctcctcctcgcgccccggcccgtctccgcgaggcccgcctcgcctcatctccactcccgccgcctcgctcttcctcctccccgacccgccaccctctccgcccaagccgccacccacccgcgcaaggccggggccgggcgcctccatcagctccgtgccgcctcctgctgcagcaattccgctccggccgcaggaaccagtggaggaagcgctaccggcgcgaaggattggcggttcttcttggcatggtatttgatgtcacttgataagaatccaattgcaactaaggcggtcacttctgctgtgctgactctagccggggacctcatctgccagcttgtgattgatcgagttccagagcttgatttaaggagaacatttgtgttcacatttttggggcttgcccttgtggggccaactttacatatctggtacctttatttgagtaaattagtgacaatcagcggagcatcaggtgccattgctcgccttatacttgatcagttcattttctctcccattttcatcggcatttttatgagcttactggtcaccttggagggaaagccctctcttgtagtgccaaagcttaagcaggagtggttatcgtcagtgttggcaaattggcaattatggataccgttccagtttctaaatttttactttgttcctcagaagtttcaggtgcttgctgctaattttgtagcccttgcatggaatgtgattttgtcatttaaggctcataaggaggttattgcgaaataggtttcactgtgagtgcagcagcccaccagagcaattgtttcttgcgggagtggtgatgtaaattatcgtgcaggggtgcgtggttctgatcaaagttgaaagcggctgtatcatggtgatgtataatatgctggagaatcatggagttgtaggttttccggtgtgcattatgttgatctataatacctcttgtttttagcatgaacatgtgcgttattctgctatgatggaccaatgaatgggcagtgttgcctccttt

SEQ ID NO: 43936 - protein, 262 aa, Panicum virgatum
  misc_feature: Ceres CLONE 2018800
  misc_feature (188)..(260): Pfam Name: Mpv17_PMP22 Pfam Description: Mpv17 / PMP22 family
MAMASALGLLLAPRPVSARPASPHLHSRRLALPPPRPATLSAQAATHPRKAGAGRLHQLRAASCCSNSAPAAGTSGGSATGAKDWRFFLAWYLMSLDKNPIATKAVTSAVLTLAGDLICQLVIDRVPELDLRRTFVFTFLGLALVGPTLHIWYLYLSKLVTISGASGAIARLILDQFIFSPIFIGIFMSLLVTLEGKPSLVVPKLKQEWLSSVLANWQLWIPFQFLNFYFVPQKFQVLAANFVALAWNVILSFKAHKEVIAK

SEQ ID NO: 43937 - DNA, 697 bp, Panicum virgatum
  misc_feature: Ceres CLONE 2018806
  misc_feature: Encodes the peptide sequence at SEQ ID NO. 43938
aggccagccgtctgcaaaacccaaacggccaaacctgaggtggagatcgcacgcggggcaccccatctctcgtaccgccgtttgttccgctcgcgctcgccaccaccaccacccacatcccaatctctcggccacgagcagcagccgccgccgcaccggcagcgtcagggtcttcgccgtcgcctccacgccctccaccgtctccaccaaggttgaggttaagaagtcatttgctcctccaagggaggtacatgtccaggttacacattcaatgccaccccagaagattgaaatattcaagtctcttgatgactgggctagagataacatcttgactcatctcaagccagtcgagaagtgttggcagccacaggatttcctccctgacccagcatctgaaggatttcatgatgaagttaaggagctcagagaacgtgccaaggaaatccctgatgattacttagtttgtttggtcggagacatgattactgaggaagctcttccaacataccagactatgcttaacaccctcgatggtgtcagggatgagacaggtgcaagccccaccggctgggcagtttggacaagggcatggactgctgaggagaaccggcatggtgacctcctaaacaaatatctgtacctcactgggagggtggatatgaggcaaattgagaagacaattcagtatcttatt

SEQ ID NO: 43938 - protein, 231 aa, Panicum virgatum
  misc_feature: Ceres CLONE 2018806
  misc_feature (92)..(231): Pfam Name: FA_desaturase_2 Pfam Description: Fatty acid desaturase
  misc_feature: SWISSPROT Homolog: EC 1.14.19.2 Acyl-[acyl-carrier-protein] desaturase
GQPSAKPKRPNLRWRSHAGHPISRTAVCSARARHHHHPHPNLSATSSSRRRTGSVRVFAVASTPSTVSTKVEVKKSFAPPREVHVQVTHSMPPQKIEIFKSLDDWARDNILTHLKPVEKCWQPQDFLPDPASEGFHDEVKELRERAKEIPDDYLVCLVGDMITEEALPTYQTMLNTLDGVRDETGASPTGWAVWTRAWTAEENRHGDLLNKYLYLTGRVDMRQIEKTIQYL

SEQ ID NO: 43939 - DNA, 671 bp, Panicum virgatum
  misc_feature: Ceres CLONE 2018824
  misc_feature: Encodes the peptide sequence at SEQ ID NO. 43940
attattttccaaccatgatagcgctgctcagttccgagagagagagagagagagagagagcgagcggtgctgattgctgagggggcgcggtggccggtggatggcgatggccggcggcgggggactgaaccggtcgtcgtcgagggggcagctgccgccacaagagcttctcgacgatctctgcagccgcttcctgctgaacgtgcccaaggaggagctcgagtcgttcgagcggatcctgttccttctggagcaggcgcactggttctacgaggacaactccgtcgagcacaaccccaacctcaaatccctctccttcaaggacttcacctccctcatgttcaagagctgcactgctctcaggccctacatcgcgcacctggatgatatctacaaggacttcaacaactacaagttccgcgtccctgtgtccggcgccatcatcctggatgacacctatgagaggtgcttgcttgttaagggatggaaagctggggccagctggagctttcctcgtggaaagaggaataaagatgaggaagatcacacctgtgctgttagagaagttctggaggaaactgggtgtgatgtttctacactattaaatttggatgattacattgaagtttcaattgggcaacaaaaagttcggctctatatcataactggcg

SEQ ID NO: 43940 - protein, 190 aa, Panicum virgatum
  misc_feature: Ceres CLONE 2018824
  misc_feature (21)..(105): Pfam Name: DCP2 Pfam Description: Dcp2, box A domain
MAMAGGGGLNRSSSRGQLPPQELLDDLCSRFLLNVPKEELESFERILFLLEQAHWFYEDNSVEHNPNLKSLSFKDFTSLMFKSCTALRPYIAHLDDIYKDFNNYKFRVPVSGAIILDDTYERCLLVKGWKAGASWSFPRGKRNKDEEDHTCAVREVLEETGCDVSTLLNLDDYIEVSIGQQKVRLYIITG

SEQ ID NO: 43941 - DNA, 948 bp, Panicum virgatum
  misc_feature: Ceres CLONE 2018825
  misc_feature: Encodes the peptide sequence at SEQ ID NO. 43942
acaagcaaccagagccagcccatttcgatacgcgcgaggtgaaccagctttcctgcgatcccgcacgcgagcgatgcaggcggccgcgaggaggtggtcggcgccggcggccgcggaggccagcagcccttacgcgatgccctcgccggtgcagccggcgtcgccgtccaagggcaccacggaggcggtgaagagtgcgctgtcgcggtgggggcgcaaggtcggggaggcgaccaggaaggcggaggacctgtcgcgcaacacatggcagcacctgaggacggcgcctagcatcgcggaggcggcggtggggaggatcgcgcaggggaccaaggtcctggcggagggcggccacgacaggatattccggcgggccttcagcgccccgccggacgagcagctccgcaagtcctacgcgtgctacctctccacggccgccggcccggtggtgggcgtcctctacctctccacggccagggtcgccttctgcagcgacggccccctgtcctacgaggccggcggaggcggcggcggcggcggcgacggcgacggcgaccggacggagtggagctactacaaggtggcgatccccctgcaccggctgagggcggccagcgcatcggcgagcaagctcaaccccgcggagaagttcatccagctggtgtcggtggacaggcaccagttctggttcatggggttcgtcaactacgacggcgcggtggcgcacctgcaggaggcgctgagcggcttccacaacctgcaggcgtgagggggatcggatggctctgtactctgttctcggcttgtcgctctgtggcttgtgtgccgccgacccctagctgcattgtttttgcagcgtgctgtttagctgcgcttactacagtgtacccgtatccggatttcatggcatgctttgatacagttggtcagcaaagagaacaattgggc

SEQ ID NO: 43942 - protein, 231 aa, Panicum virgatum
  misc_feature: Ceres CLONE 2018825
  misc_feature (96)..(184): Pfam Name: GRAM Pfam Description: GRAM domain
MQAAARRWSAPAAAEASSPYAMPSPVQPASPSKGTTEAVKSALSRWGRKVGEATRKAEDLSRNTWQHLRTAPSIAEAAVGRIAQGTKVLAEGGHDRIFRRAFSAPPDEQLRKSYACYLSTAAGPVVGVLYLSTARVAFCSDGPLSYEAGGGGGGGGDGDGDRTEWSYYKVAIPLHRLRAASASASKLNPAEKFIQLVSVDRHQFWFMGFVNYDGAVAHLQEALSGFHNLQA

SEQ ID NO: 43943 - DNA, 895 bp, Panicum virgatum
  misc_feature: Ceres CLONE 2018836
  misc_feature: Encodes the peptide sequence at SEQ ID NO. 43944
agccatggcggacatcgatttgtagcatcggaggtgcggagcagcgcggattcgcggcgaattcaaggtatcccttcccatactgagtcctccgcccctcgaccggatccaccccgcgccatgtcttcccggctgccgacgcatctgtccaaccggagtccacggcgattccccacagtctgctgtctcctagtcctcaccctcgctctcctcttcacctccgctgccgccaagtcctctcgccgcccaatctccgacaacgagatccggcagcagaaggaggcatgctacaccgacgtcgagaacgggctatgggggtgggcgtgcaggtcctcgccaacggagaaggagaactgcgtgctgcgctgcctctcccctgagtgctacaacctcatctacggcggcgacccccttgaagaaggggaactggattatgtccgcagccaggagtacaagtactgcatgcgcaaatcatcccttggagaaagcttggatggtgtgaagggatccttcagttattcatgaaggaaaccaaaaggaaaaagtgacagtatcgttttcgttgcgtcctcatccatgccgaggattgatcaatcgacaatatttttggatggttacggtggtggatcttaccgtggttgatcccatgatctcagcgcaatgactggcccaagacctattccatagtcggtaaagtaggcatgattggcattgttaggtttggattctagaaaattaagctatctagaaaattaagctatcgaattgcaaagccatgtatttaaccctgcttcagcatgtattctgtgcaggatacttatcctcttgcactgcaaaacctgctgtattctgcgcggcattactagaacaactagcctgtgcgactttgttatgg

SEQ ID NO: 43944 - protein, 134 aa, Panicum virgatum
  misc_feature: Ceres CLONE 2018836
  misc_feature: Functional homolog of the protein sequence given in SEQ ID NO 51618
  misc_feature: Useful for biocontainment applications
MSSRLPTHLSNRSPRRFPTVCCLLVLTLALLFTSAAAKSSRRPISDNEIRQQKEACYTDVENGLWGWACRSSPTEKENCVLRCLSPECYNLIYGGDPLEEGELDYVRSQEYKYCMRKSSLGESLDGVKGSFSYS

SEQ ID NO: 43945 - DNA, 722 bp, Panicum virgatum
  misc_feature: Ceres CLONE 2018839
  misc_feature: Encodes the peptide sequence at SEQ ID NO. 43946
tctgtgatgtgattcccccaagctgtattcaaatgcgtaatgttattcttagtgcctttccacgcaatatgagacttccagatccctccactcctaacttaaagattgatctgctagcggagatttcaatagctcctcgaatcatgactgatgtggatggtgctttgaaggcaaagcaaatgaaggctcaggttgatgaatacctaaagagaccagaaggatccctctttttaactgatctaaagcagaagttgttgctaccacaaaatgaggcaaatgtcgcagggactcgttacaatgttcctctagttaattcacttgtcctttacgttggtatgcaggctgtgcaacagttgcagcaaaacaaggcgaatgcatcggcatcagcccaaattaaccaaagtcctcaaatggatatattccagattgaaacagctactgagctgttcagaaaccttgtaatgactatggacacagaaggtcgctaccttattctcaatgcgatttctaaccagcttcgctatccaaatagccatacccactacttttccttcatcattctgtacttgtttgctgaagcaacccaggaaattgtccaggagcaaataactagagttcttttggaaaggttaattgtcaaccgtcctcatccttggggattacttattactttcattgagctgataaagaacccacgctacagcttttggactagatccttt

SEQ ID NO: 43946 - protein, 239 aa, Panicum virgatum
  misc_feature: Ceres CLONE 2018839
  misc_feature (1)..(239): Pfam Name: Not1 Pfam Description: CCR4-Not complex component, Not1
CDVIPPSCIQMRNVILSAFPRNMRLPDPSTPNLKIDLLAEISIAPRIMTDVDGALKAKQMKAQVDEYLKRPEGSLFLTDLKQKLLLPQNEANVAGTRYNVPLVNSLVLYVGMQAVQQLQQNKANASASAQINQSPQMDIFQIETATELFRNLVMTMDTEGRYLILNAISNQLRYPNSHTHYFSFIILYLFAEATQEIVQEQITRVLLERLIVNRPHPWGLLITFIELIKNPRYSFWTRS

SEQ ID NO: 43947 - DNA, 827 bp, Panicum virgatum
  misc_feature: Ceres CLONE 2018849
  misc_feature: Encodes the peptide sequence at SEQ ID NO. 43948
gtctcctccccccctccccctcgcagtcctcgtcgccaactcgccatcgtctagggagaggccaggcaggcgggagagaggcaccgcgaaacgcagcgatggggttcatctcgttcgtcgggcgggtgctcttcgcctccctcttcctcctatcggcctaccaagagttccttgaatttggaaacgatggtggaccagcaggaaaggccttgaagccaaaattcaatctctttgttaagcaagtgtcaaagaatacgggattggtgcttcctcaaattgatataaaaactgtcatagctgctacaatgtttcttaaaggctttggtggtcttttgttcatccttagcagctcatttggggcattcctactgctgatttacttggcgtttataacccctattgtgtatgacttctacaactacgaaatggagtcaactcaatttgtgcagctgtttttcaagttctctcagaacttggcattcatcggcgcactgcttttcttcctgggaatgaagaactctattccaagaaggcggtcgaagggaaggacaacaaagaccaagacaaactgaagtcgtaaatccgtaggagggtcggcaacttggcattcatgctcaatatgtttgcatattatacaacagtagatgttccacttttgctcgtgtggtatcggtagaaatatgaaattggcgaccggcagaacttagtacgtaggaacagaaatttaagttgccccacatgattctattttccatacattggtgttgtgttttctgcatctcatgatctgttttgctacaagaactgattatgtcaatgaaagatcg

SEQ ID NO: 43948 - protein, 157 aa, Panicum virgatum
  misc_feature: Ceres CLONE 2018849
  misc_feature (1)..(138): Pfam Name: HR_lesion Pfam Description: HR-like lesion-inducing
  misc_feature: Functional homolog of the protein sequence given in SEQ ID NO 51445
  misc_feature: Useful for making plants with modulated nitrogen use efficiency
MGFISFVGRVLFASLFLLSAYQEFLEFGNDGGPAGKALKPKFNLFVKQVSKNTGLVLPQIDIKTVIAATMFLKGFGGLLFILSSSFGAFLLLIYLAFITPIVYDFYNYEMESTQFVQLFFKFSQNLAFIGALLFFLGMKNSIPRRRSKGRTTKTKTN

SEQ ID NO: 43949 - DNA, 722 bp, Panicum virgatum
  misc_feature: Ceres CLONE 2018854
  misc_feature: Encodes the peptide sequence at SEQ ID NO. 43950
ctggtgcttctgaaaaacggaaagtcgtcatactctccattgctgcccctcccgaagaaggctggtaagatcctggttgcgggtagccacgccgacaacttgggaaaccagtgtggaggatggacaatcgagtggcaaggagagagcggcaacaacatcactgctggcacgacgatcctggaaggcatcaaggccaccattgatccaagcacgcaggtggtctactctgagagcccggacagcaccgtcctcgccgacaagtacgactacgcggtcgtggtgatcggcgagccaccctacgccgagacgttcggcgacaacctgaacctgacgatcccagctccggggccgagcgtgatccagtcggtgtgcaaggtcaccaagtgcgtggtcgtcctcatctccggcaggccgctggtggtggagtcgtacctgagcgacatggacgcgttcgtggcggcgtggctccccggctccgagggccagggcgtcgccgacgtgctgttcggcgactacgggttcaccgggaagctgtcgcggacgtggttcaagtcggtggatcagctgccgatgaacgtgggcgacgcacactacgacccgctgttcccgttcggcttcgggctcaccaccaagggcacgaaatgaggacgggtgggttgagagggtttcgaattggtttgggttgagttcggtcctggggggggtgtggaccgccgccacag

SEQ ID NO: 43950 - protein, 214 aa, Panicum virgatum
  misc_feature: Ceres CLONE 2018854
  misc_feature (1)..(212): Pfam Name: Glyco_hydro_3_C Pfam Description: Glycosyl hydrolase family 3 C terminal domain
  misc_feature: SWISSPROT Homolog: EC 3.2.1.21 Beta-glucosidase
LVLLKNGKSSYSPLLPLPKKAGKILVAGSHADNLGNQCGGWTIEWQGESGNNITAGTTILEGIKATIDPSTQVVYSESPDSTVLADKYDYAVVVIGEPPYAETFGDNLNLTIPAPGPSVIQSVCKVTKCVVVLISGRPLVVESYLSDMDAFVAAWLPGSEGQGVADVLFGDYGFTGKLSRTWFKSVDQLPMNVGDAHYDPLFPFGFGLTTKGTK

SEQ ID NO: 43951 - DNA, 650 bp, Panicum virgatum
  misc_feature: Ceres CLONE 2018857
  misc_feature: Encodes the peptide sequence at SEQ ID NO. 43952
ggagggggaacgactgaacgagcaagccccacggcgcagtgaggcggaggcgcaggctagcatctcggcctccgccacccacggccggacggccccgcccccgccgcattgccccgcgccgctgggccggcatccgccgtcccgacgcgagagggaagaggcctcagagcagcgggggccctggctcggggcagcctgcgcctcgccgcgggatcggaggagggaggaagaggcggaggcggccgggcgcgcgggcatgtgcgatctggtggcccgcacgggccggcacctgcagcgctacgaggacggccgtcgccttgtggccgggtgcataccatttagatatagagacattaaagatgaacaaaagaaacttgttgaagttctcatgatcaactcccaaagtggaccaggtcttctatttccaaagggaggatgggagaatgatgaaactgttgaagaggcagctgcacgagaagctatcgaagaagctggagttcgaggagatttagtgaaactgttgggcttctatgatttcaagaccaagcaacctgaaggtatgtgcagagctgctgtctttgcgctgcatgtgaaggaagagctggcctcctggcctgaacagagcacccggcagaggagttggctcacag

SEQ ID NO: 43952 - protein, 131 aa, Panicum virgatum
  misc_feature: Ceres CLONE 2018857
  misc_feature (19)..(130): Pfam Name: NUDIX Pfam Description: NUDIX domain
  misc_feature: SWISSPROT Homolog: EC 3.6.1.52 Diphosphoinositol-polyphosphate diphosphatase
MCDLVARTGRHLQRYEDGRRLVAGCIPFRYRDIKDEQKKLVEVLMINSQSGPGLLFPKGGWENDETVEEAAAREAIEEAGVRGDLVKLLGFYDFKTKQPEGMCRAAVFALHVKEELASWPEQSTRQRSWLT

SEQ ID NO: 43953 - DNA, 667 bp, Panicum virgatum
  misc_feature: Ceres CLONE 2018863
  misc_feature: Encodes the peptide sequence at SEQ ID NO. 43954
ggactggtctagcacccttccgtggcttcttgcaggagaggctagctcaaaaagaatctggaaccgagcttggtcaatctgtgttcttctttggatgcagaaataacaagatggacttcatatatgaggatgagctgaacaatttccttgagcaaggagcactgtctgagctggttcttgccttctcacgtcagggccctaccaaggaatatgtgcaacacaaaatggcgcagaaagcatctgaaatctgggacatgatctcccaaggtgcttatatctatgtctgcggtgatgccaaaggcatggccagagatgtacataaagttctccacaccatcgttctggagcagggttcacttgacagttccaaagccgagagctttgtgaagaatcttgtaacggagggcagatatctgagggatgtgtggtaagcgctggacatggaaaatcccgatattcattggggggacaacattccttcatgttatacaaatgtacaactattgccggaagagtagtgacaacggactaagatcagatgtttctagtgggtctgcatttttttttctttttctctcttatttcttttttttttctgagatattctcaagaggtttctgcacatgtgtagtacaaattctttatatatataagatgaggacaattt

SEQ ID NO: 43954 - protein, 142 aa, Panicum virgatum
  misc_feature: Ceres CLONE 2018863
  misc_feature (1)..(107): Pfam Name: NAD_binding_1 Pfam Description: Oxidoreductase NAD-binding domain
  misc_feature: SWISSPROT Homolog: EC 1.6.2.4 NADPH--hemoprotein reductase
TGLAPFRGFLQERLAQKESGTELGQSVFFFGCRNNKMDFIYEDELNNFLEQGALSELVLAFSRQGPTKEYVQHKMAQKASEIWDMISQGAYIYVCGDAKGMARDVHKVLHTIVLEQGSLDSSKAESFVKNLVTEGRYLRDVW

SEQ ID NO: 43955 - DNA, 673 bp, Panicum virgatum
  misc_feature: Ceres CLONE 2018873
  misc_feature: Encodes the peptide sequence at SEQ ID NO. 43956
aattctcggatctttagcacgatccaccgaattaagtttgtgcacgtacgcgccgcaacactactacccgtgtagtaagctcggctctagtactacacatcccgccaatccgccaccgccatggcctccctcgctgccgtctccgtgcagccggttgccgtgaagggcctcggcggcagctccatctccggcaggaggctcgccgttcgaccgtcgccccgcgccgcctgccgctcctccactcgcaggccccgcgccgccgtggtcgccaagtacggcgacaagagcgtctacttcgacctcgaggacatcgccaacaccaccgggcagtgggacctctacggctccgacgcgccctcgccctacaacccacttcagagcaagttcttcgagaccttcgcggggccgttcaccaagaggggcctgctgctcaagttcctgctgctgggcggtggctccctgctggcctacgtcagcgcgtcggcgtcgccggacctcctgccgatcaagaaggggccgcagcagccgccgcagccaggcccacgcggcaagatctaagttcggcttctcctcgatccatttgtctactagcttgcttgtactgctagctgatccggtcgccatggatccctgcctgttatgctgttgatatgacgacattcgatccttgtct

SEQ ID NO: 43956 - protein, 145 aa, Panicum virgatum
  misc_feature: Ceres CLONE 2018873
  misc_feature (5)..(145): Pfam Name: PSI_PsaH Pfam Description: Photosystem I reaction centre subunit VI
MASLAAVSVQPVAVKGLGGSSISGRRLAVRPSPRAACRSSTRRPRAAVVAKYGDKSVYFDLEDIANTTGQWDLYGSDAPSPYNPLQSKFFETFAGPFTKRGLLLKFLLLGGGSLLAYVSASASPDLLPIKKGPQQPPQPGPRGKI

SEQ ID NO: 43957 - DNA, 637 bp, Panicum virgatum
  misc_feature: Ceres CLONE 2018875
  misc_feature: Encodes the peptide sequence at SEQ ID NO. 43958
acctcaaggcgcagccgcggcggctctctctctctctctctctctctctctctctctctctccagtccggcagcaggaaataaagagttggctgaaagagcgcgatcggcaggcagtgatggtgagccgtgagcacagccacagctacgaggacctcgtgctcgacccggcggcgctggagatcatcccgccgcagctcctcgccgcgctgggggagtacctctccgctggccgcggcggggacggggacgccgccgaggccgaggcggaggcggaggcggacgacgagttcatgatgtacgagttcaaggtgcggcggtgcgcgcgcgcgcggagccacgactggacggcgtgcccctacgcgcacccgggcgaggccgcgcgccgccgggacccgcgccgcgtcgcctacgcgggggagccctgcccggacttccggcgccgcccgggcgccgcgtgcccgcgcgggagcgcctgccccttcgcgcacggcaccttcgagctgtggctccacccgtcccggtaccgcacccgcccctgccgcgcgggcgccgcctgcaggcgccgcgtcttgcttcttcgcccacgccggcggccgagcttcgccgccgcgcccaaggacgactcgctctcgctc

SEQ ID NO: 43958 - protein, 172 aa, Panicum virgatum
  misc_feature: Ceres CLONE 2018875
  misc_feature (98)..(126): Pfam Name: zf-CCCH Pfam Description: Zinc finger C-x8-C-x5-C-x3-H type (and similar)
  misc_feature: Functional homolog of the protein sequence given in SEQ ID NO 51683
  misc_feature: Useful for making plants with modulated flowering time
  misc_feature: Functional homolog of the protein sequence given in SEQ ID NO 51684
  misc_feature: Useful for making plants with modulated nitrogen use efficiency
  misc_feature: The sequence is a functional homolog of SEQ ID NO 102 in the 10/225,066 US patent application
  misc_feature: The sequence is a functional homolog of SEQ ID NO 2294 in the 10/374,780 US patent application
MVSREHSHSYEDLVLDPAALEIIPPQLLAALGEYLSAGRGGDGDAAEAEAEAEADDEFMMYEFKVRRCARARSHDWTACPYAHPGEAARRRDPRRVAYAGEPCPDFRRRPGAACPRGSACPFAHGTFELWLHPSRYRTRPCRAGAACRRRVLLLRPRRRPSFAAAPKDDSLS

SEQ ID NO: 43959 - DNA, 695 bp, Panicum virgatum
  misc_feature: Ceres CLONE 2018885
  misc_feature: Encodes the peptide sequence at SEQ ID NO. 43960
atcgcatctccagcgccagatgctcacctcgcctcgccgcaaataattccggcacacgaatttcttcggttcctcctcctcgcgcttctccccttccccgagtaaccagcagcagcggcggcgccatggccaccgcctcctccctcttcctcgcctcgtcccccatctccaccgcgccgcgaacccgcaccggccccgcggcgtcctgccctcccgccgcccggccgtccctgcgcctccggcagaggccgtccccggccgtcgcggccgccgtgcaggccgagcaccagcccgccgtggccgcagcgccgaagccgcccgcgctcccgttccgcgtcggacacgggtttgacctccaccgcctcgaaccgaacctcccgctcatcatcggcggcatcaacatcccccacgaccgtggctgcgaggcccactccgacggggacgtgctgctgcactgcgtggtggacgcgattctcggcgcgctggggctgccagacatcgggcagatcttcccagactcggacctacggtggaagggtgccgattcttccgtgttcatgagggaagctgtgaaattgatgcatgaagcgggctatgagctgggcaaccttgatgctacactgatcttgcaaaaaccaaaactcaatccattcaaggagacaatccgatccaacttgtgtgacttacttggggca

SEQ ID NO: 43960 - protein, 189 aa, Panicum virgatum
  misc_feature: Ceres CLONE 2018885
  misc_feature (69)..(189): Pfam Name: YgbB Pfam Description: YgbB family
  misc_feature: SWISSPROT Homolog: EC 4.6.1.12 2-C-methyl-D-erythritol 2,4-cyclodiphosphate synthase
MATASSLFLASSPISTAPRTRTGPAASCPPAARPSLRLRQRPSPAVAAAVQAEHQPAVAAAPKPPALPFRVGHGFDLHRLEPNLPLIIGGINIPHDRGCEAHSDGDVLLHCVVDAILGALGLPDIGQIFPDSDLRWKGADSSVFMREAVKLMHEAGYELGNLDATLILQKPKLNPFKETIRSNLCDLLG

SEQ ID NO: 43961 - DNA, 671 bp, Panicum virgatum
  misc_feature: Ceres CLONE 2018891
  misc_feature: Encodes the peptide sequence at SEQ ID NO. 43962
acgcaccgccgcctgctcatctgcgcggcgcgaggctcgagcagcccaaaaagatagcccaggccaagcaacagatagatttttttttcctaccaagcttgtactcccgggtagcttgcattggcagctagcagctctgcgctaccatggcagtgcgagtgcttcctcctccagtgctcctgctagctctgctgctggcgctggttgcttcggtcgcccatggcggcgacggcaagctcaaggttgggttctacaaggattcgtgcccggacgccgaggcgatcgtccgcaggatcgtcgccaaggccgtccgcaaggatcccacggccaacgcgccgctgctgaggctccacttccacgactgcttcgtcaggggctgcgaggggtcggtgctcctcaactccaccaaggggaacgcggcggagaaggacgccaagcccaaccacacgctggacgctttcgacgtcatcgacgacatcaaggcggcgctggagaaggagtgccccggcaaagtttcctgcgccgacatcctcgccatcgccgccagggacgccgtctcgctggctacgaaggtggtgaccaagggggagtggagcaaggacggcaacctgtacgaggtggagaccggcaggcaggacggccgcgtctccagcgccaaggaggccgtcaag

SEQ ID NO: 43962 - protein, 174 aa, Panicum virgatum
  misc_feature: Ceres CLONE 2018891
  misc_feature (47)..(174): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51685
  misc_feature: Useful for making plants with altered carbohydrate content
  misc_feature: Functional homolog of the protein sequence given in SEQ ID NO 51044
  misc_feature: Useful for making plants with altered cell wall content and/or composition
  misc_feature: Functional homolog of the protein sequence given in SEQ ID NO 50230
  misc_feature: Useful for making plants with modulated nitrogen use efficiency
  misc_feature: Functional homolog of the protein sequence given in SEQ ID NO 51417
  misc_feature: Useful for making plants with modulated oxidative stress sensitivity
MAVRVLPPPVLLLALLLALVASVAHGGDGKLKVGFYKDSCPDAEAIVRRIVAKAVRKDPTANAPLLRLHFHDCFVRGCEGSVLLNSTKGNAAEKDAKPNHTLDAFDVIDDIKAALEKECPGKVSCADILAIAARDAVSLATKVVTKGEWSKDGNLYEVETGRQDGRVSSAKEAV

SEQ ID NO: 43963 - DNA, 668 bp, Panicum virgatum
  misc_feature: Ceres CLONE 2018905
  misc_feature: Encodes the peptide sequence at SEQ ID NO. 43964
gaatcctcctctcgctccccgtcttctccggccgattcctcctgcccctgccttcaccccaccaccccactgccggccccgccccgaaccccggagaagaatcgaggcggcgtcaacctctcgaccctccccgtcgacatggagcacgccctgtggtcgagcggggccagcgacaagaacaagtccatggtcgagcagctgcggaggtacgggatcatccggtccagcaaggtcgccgaggtgatggaggctgtcgacagggggctcttcgtgccaccaggcggctcgccctactttgacagccccatgctgatcgggtacaacgccacgatatcggcgccgcacatgcacgcggcctgcctggagctcctggagaagaatcttcagccggggatgcgggctctcgatgttggatcaggcactggatacctaactgcttgctttgcactgatggttggatcggaagggcgagcagttggcgttgaacatattccagagttggttgatacttctattgaaaatatcaagaaaagtgcagcagctccacagctaaatgatggagctcttagcatacacgttgctgatggcagggaagggtggccagagctggcaccctatgatgccatccatgtaggagctgcagcgccgcagatcccagaggcgctggt

SEQ ID NO: 43964 - protein, 176 aa, Panicum virgatum
  misc_feature: Ceres CLONE 2018905
  misc_feature (11)..(176): Pfam Name: PCMT Pfam Description: Protein-L-isoaspartate(D-aspartate) O-methyltransferase (PCMT)
  misc_feature: SWISSPROT Homolog: EC 2.1.1.77 Protein-L-isoaspartate(D-aspartate) O-methyltransferase
MEHALWSSGASDKNKSMVEQLRRYGIIRSSKVAEVMEAVDRGLFVPPGGSPYFDSPMLIGYNATISAPHMHAACLELLEKNLQPGMRALDVGSGTGYLTACFALMVGSEGRAVGVEHIPELVDTSIENIKKSAAAPQLNDGALSIHVADGREGWPELAPYDAIHVGAAAPQIPEAL

SEQ ID NO: 43965 - DNA, 721 bp, Panicum virgatum
  misc_feature: Ceres CLONE 2018929
  misc_feature: Encodes the peptide sequence at SEQ ID NO. 43966
gtcacgtcaaacaattatacgataacagatgtcccacccacaaaatcttgctgaacttagagaacatctcaaaaatagaccaccacataaagttgctgatctgaccaaggctgcctggggacgtaaagaaattatcattgctgaaactgaaatgcctggattgatggctctcagagcaaaattcggtgcttcccaaccactgaaaggtgctcttattggaggcagtcttcatatgacaatccaaactgctgttttgattgaaactttgactgctctcggtgccaaagtcgcttggtcaagctgtaacgtcttctcaacccaagacgaagctgctgcagctatcgctgtcaccggtgttccagtctacgcatggaaaggagagactccagctgaatatgactggtgcctcgaacaaaccttgtttattggagacgaaccaatcaacatgattcttgatgatggaggagatctcaccaatctcgttcatgacaaatacccatttttgttagaaggaattaaaggaatcactgaggaaaccacaactggagttcatgcattatacaagagagttagagaaaacactttgaaatgcccagcaatcaacgtcaatgactctgttactaaatccaaattcgacaatctctatggatgccgtgaatccctccttgatggaatcaaaagagcaactgatgtcatgattgcaagaaaagtcgcagtcgtg

SEQ ID NO: 43966 - protein, 230 aa, Panicum virgatum
  misc_feature: Ceres CLONE 2018929
  misc_feature (18)..(218): Pfam Name: AdoHcyase Pfam Description: S-adenosyl-L-homocysteine hydrolase
  misc_feature: SWISSPROT Homolog: EC 3.3.1.1 Adenosylhomocysteinase
MSHPQNLAELREHLKNRPPHKVADLTKAAWGRKEIIIAETEMPGLMALRAKFGASQPLKGALIGGSLHMTIQTAVLIETLTALGAKVAWSSCNVFSTQDEAAAAIAVTGVPVYAWKGETPAEYDWCLEQTLFIGDEPINMILDDGGDLTNLVHDKYPFLLEGIKGITEETTTGVHALYKRVRENTLKCPAINVNDSVTKSKFDNLYGCRESLLDGIKRATDVMIARKVAV

SEQ ID NO: 43967 - DNA, 287 bp, Panicum virgatum
  misc_feature: Ceres CLONE 2018933
  misc_feature: Encodes the peptide sequence at SEQ ID NO. 43968
attgttgccatcacctgccgctagctggccgggcgcctgcccgcagcaggagtcatcaagaaactgatcgctcagctcgctcgtcccggccaagggcactacggtcgggccggcgcctgaggcaggataaaagacgtcgccgactcactccacccgccgatccatatggggcgcaaggcggcggcagcagggaggaccccgctgcggacgagcctctggtcgcccgaagaggacaacaagctctacaaccacatcatccaggaccgcgtcggctgctggacctcact

SEQ ID NO: 43968 - protein, 40 aa, Panicum virgatum
  misc_feature: Ceres CLONE 2018933
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50610
  misc_feature: Useful for making plants with altered cell wall content and/or composition
  misc_feature: Useful for making plants with altered lignin content
MGRKAAAAGRTPLRTSLWSPEEDNKLYNHIIQDRVGCWTS

SEQ ID NO: 43969 - DNA, 757 bp, Panicum virgatum
  misc_feature: Ceres CLONE 2018944
  misc_feature: Encodes the peptide sequence at SEQ ID NO. 43970
  misc_feature (668)..(668): n is a, c, t, g, unknown, or other
gcgtgcgtcagcaccccgcgggctcctccgcggcttttcccttctttcctcgggtgggggataagatcggggcgtcattgccgcccgccaccacccacccggccccccgccctcccggcctcgcgccacgccgcgtcgagggctgctgccaccgccaccagcgtcgccctgctctcttcctccgcctgtcccgcctgtcccctgctgatcgctcgctatttgtaagaaaggcaaaagcggccatgtcgtccgacgcggtggcagcggcggccaggaagggccggctcaagcagcgctacgacaacgagttccgcctcgtcgcgggggtcgtgccgtaccgggtgaagaaggacgacgagggcaacccgtgcagcagcctcggcggcggcgacacggcggaggtggaggtgctcatgatctccacgcccaaccgggctgacatggtcttccccaagggcgggtgggaggacgacgaggacgtgtaccaggcggcgtcccgcgaggccatggaggaggccggcgtcaagggcgtcatcaacaaagctgcactgggacactgggtgttcaagagcaagagcagccagaacagcaccagccccagggtggcctgcaagggctgcatcttcgccatggaggtcaccgaggagctcgagtcatggccggagcangaaacccacgaccggcgatgggtctcccccgccgaagcctaccagctctgccagtacgactggatgcgggaggcgctcaccgcgctgct

SEQ ID NO: 43970 - protein, 171 aa, Panicum virgatum
  misc_feature: Ceres CLONE 2018944
  misc_feature (23)..(171): Pfam Name: NUDIX Pfam Description: NUDIX domain
  misc_feature: SWISSPROT Homolog: EC 3.6.1.52 Diphosphoinositol-polyphosphate diphosphatase
  misc_feature (142)..(142): Xaa is any aa, unknown, or other
MSSDAVAAAARKGRLKQRYDNEFRLVAGVVPYRVKKDDEGNPCSSLGGGDTAEVEVLMISTPNRADMVFPKGGWEDDEDVYQAASREAMEEAGVKGVINKAALGHWVFKSKSSQNSTSPRVACKGCIFAMEVTEELESWPEXETHDRRWVSPAEAYQLCQYDWMREALTAL

SEQ ID NO: 43971 - DNA, 622 bp, Panicum virgatum
  misc_feature: Ceres CLONE 2018945
  misc_feature: Encodes the peptide sequence at SEQ ID NO. 43972
agccgcaggacacgatcacctcccaatccccagtccgcgacacccccccccccccccccacccacagcatcagcatcagcgcgagctagaagcaagcatggcgcgcgggagcagccgcctgctcgttgtctccgccgccgcgctggcggtgctcgccgtggccgcggccgctctggcggtgccgccgacgtgcgagcgcatcgagtgcccggcgtacgaggtggtggacagcgccaacgggttcgagatccggcggtacacggacgccatgtgggtctccaccgcccccatcgaggacatatccttcgtcgccgccacgcgcaccggcttcctccagctgttcaagtacatccagggcaagaacgcgtacaacgagacgatcgagatgacggcgccggtgctgacggaggtgtcgccgagcgacgggcccttctgcgcctcctctttcgtcgtcagcttctacgtgccggccaagaaccagcccgacccgccgccggccgacggcctgcgcgtgcggacgtgggccggggaccggtacgccgccgtgcgccgcttcgggggcttcgtgtccgacgccgacgtcggcgagcaggccgcccgcctcgacgccagcctgcagggg

SEQ ID NO: 43972 - protein, 174 aa, Panicum virgatum
  misc_feature: Ceres CLONE 2018945
  misc_feature (34)..(174): Pfam Name: SOUL Pfam Description: SOUL heme-binding protein
MARGSSRLLVVSAAALAVLAVAAAALAVPPTCERIECPAYEVVDSANGFEIRRYTDAMWVSTAPIEDISFVAATRTGFLQLFKYIQGKNAYNETIEMTAPVLTEVSPSDGPFCASSFVVSFYVPAKNQPDPPPADGLRVRTWAGDRYAAVRRFGGFVSDADVGEQAARLDASLQ

SEQ ID NO: 43973 - DNA, 679 bp, Panicum virgatum
  misc_feature: Ceres CLONE 2018948
  misc_feature: Encodes the peptide sequence at SEQ ID NO. 43974
atccacacatccatccatacatacacacacccattggcatttagctgttcttgtttgggcagcggaacacctgtgcatactgcacatctcctgctctgaagaacaattttcagtttgtcttgcttggttagttggtttcgctctagcagctcagaaggagaaggtttcgcaagagagcgaagaggttattgagagatggaggatgtggtcaagttcatctttggaatttctggaaatgtcattgctctgtttctcttcctatccccagtgcctacgttctggaggatcatcaggaggagatcaacggaggacttctcaggagtgccgtacaacatgacgctcctcaactgccttctatcagcttggtatgggctgccgttcgtgtccccgaacaacatccttgtgtcgacgatcaacggcgcgggcgcggcgatcgaggtggtgtacgtggtgatcttcctggtgttcgcgtcgagccggcggacgcggctgcggatgctgggcctcgcgtccgcggtggccgccgtgttcgccgccgtggcgctggtgtccgtgctggcgctgcacggggagggacgcaagctcctgtgcggcgtcgcagccaccgtctgctccatctgcatgtacggctcgccgctctccatcatgaggctagtggtgaagacgaagagcgtggagt

SEQ ID NO: 43974 - protein, 161 aa, Panicum virgatum
  misc_feature: Ceres CLONE 2018948
  misc_feature (7)..(96): Pfam Name: MtN3_slv Pfam Description: MtN3/saliva family
MEDVVKFIFGISGNVIALFLFLSPVPTFWRIIRRRSTEDFSGVPYNMTLLNCLLSAWYGLPFVSPNNILVSTINGAGAAIEVVYVVIFLVFASSRRTRLRMLGLASAVAAVFAAVALVSVLALHGEGRKLLCGVAATVCSICMYGSPLSIMRLVVKTKSVE

SEQ ID NO: 43975 - DNA, 700 bp, Panicum virgatum
  misc_feature: Ceres CLONE 2018951
  misc_feature: Encodes the peptide sequence at SEQ ID NO. 43976
ctcggtctctccgccgcccaccacctcgctccccacctctccctttatacgcctccgcggctccgcctccgccatctccccgacctcttcctcgttcacggcattgtccccctcgccaggagacagcggagaggagagagatggcggccgcgtccttcaccgccgccaagttcctggcgccggtggccgcgagatccggcggcgagagggcgcccccgctccccgccggcgcctcgtcctcccccttcgccagggcgctgcgccgcggcggggcgcaccacccgcgcctgcgcaccgctctcgccgtctcctccgacgtgctcgctgggaacaaggccgcgcccgcgcatccggatgtgacacgggaagaggccctggagttgtacgaggacatggttcttggccgtgtttttgaggacatgtgtgcgcaaatgtactaccgtggcaagatgtttggtttcgtccacctttacaatggccaggaggctgtttccactggctttatcaagcttctaaaccaggctgattgtgttgttagcacatatcgtgatcatgtccatgcgctatccaagggtgtcccagcccgctctgttatggctgagctctttggcaaggccaccggctgctgccgtggacagggtggttccatgcacatgttctctgccccccataacgtccttggaggctttgccttcatcgg

SEQ ID NO: 43976 - protein, 186 aa, Panicum virgatum
  misc_feature: Ceres CLONE 2018951
  misc_feature: SWISSPROT Homolog: EC 1.2.4.1 Pyruvate dehydrogenase (acetyl-transferring)
MAAASFTAAKFLAPVAARSGGERAPPLPAGASSSPFARALRRGGAHHPRLRTALAVSSDVLAGNKAAPAHPDVTREEALELYEDMVLGRVFEDMCAQMYYRGKMFGFVHLYNGQEAVSTGFIKLLNQADCVVSTYRDHVHALSKGVPARSVMAELFGKATGCCRGQGGSMHMFSAPHNVLGGFAFI

SEQ ID NO: 43977 - DNA, 717 bp, Panicum virgatum
  misc_feature: Ceres CLONE 2018957
  misc_feature: Encodes the peptide sequence at SEQ ID NO. 43978
attccattccggccaccagagaagagaaacccaacaaagagccaccaccacccttcatcacttctcctccaccaaggcaccaaccagtccgggagccatgagcaaggactgcggcaaccacggcgacgacgacctccgccgctcgtgccggcgcctgctcggcctcctcctaggcctggccctcatcgtcgccatcatcgcgctcatcgtctacctggtcctccgccccacgcacccgcgcttcttcctgcaggacgcctcgctccgccagctcgacctcgccaacggctcctccaacctcctctccaccacgctccaggtcaccgtcgcctcccgcaaccccaacgaccgcgtcggcgtctactacgaccgcctcgacgtctacgcctcctacaagtaccagcagatcaccgtcgccgcctcgctcccgccggtctaccagggccacggcgacgtcgacgtctggtcgcccgtcctcgccggccccaacgtccccttcgccccctacctcgccgacgcgctccagcaggactgccaggccggctacctcatcctccaggtcaagatcgacggccgcgtcaggtggaaggtcggcagctggatctccggccactaccacctcttcgtcacctgcccggccttcctcgtcaccaacggcggcaacggcgcgccgggggccagcggattcaagttccagaccaccacctcctgccgcgt

SEQ ID NO: 43978 - protein, 206 aa, Panicum virgatum
  misc_feature: Ceres CLONE 2018957
  misc_feature (39)..(179): Pfam Name: Hin1 Pfam Description: Harpin-induced protein 1 (Hin1)
MSKDCGNHGDDDLRRSCRRLLGLLLGLALIVAIIALIVYLVLRPTHPRFFLQDASLRQLDLANGSSNLLSTTLQVTVASRNPNDRVGVYYDRLDVYASYKYQQITVAASLPPVYQGHGDVDVWSPVLAGPNVPFAPYLADALQQDCQAGYLILQVKIDGRVRWKVGSWISGHYHLFVTCPAFLVTNGGNGAPGASGFKFQTTTSCR

SEQ ID NO: 43979 - DNA, 724 bp, Panicum virgatum
  misc_feature: Ceres CLONE 2018963
  misc_feature: Encodes the peptide sequence at SEQ ID NO. 43980
aactatccctactcggctactcctacgcacactgcaacacctcccagtccgcaacagaagcggtgcaggaaatggacagcgcgagcagcctcgtggtggacgacaccagcagcggcggcgcgtgcacggacaagctcaaggccctggccgccgcggccgccgagggggccacgctggagcgcatgggcagcggcgccagcgcggtcgtggacgcggccgagccgggcgccgaggcggactcgggccacgtcggcgcgggcgtgggcgtgggcgggaagctgccgtcgtccaggtacaagggcgtggtgccgcagcccaacgggcggtggggcgcgcagatctacgagcgccaccagcgcgtgtggctcggcaccttcgcggagaaggccgacgccgcgcgcgcctacgacgtcgccgcgcagcgcttccgcggccgcgacgccgtcaccaacttccgcccgctctcggacgccgacccggacgccgccgccgagctccgcttcctcgcctcgcgctccaaggccgaggtcgtcgacatgctccgcaagcacacctacttcgacgagctcgcccagaacaagcgcgccttcgccgccgccgccgcgccgacgacctcgtcgcccgccggcgcccgctccccctcctccgcgccccgctctcccgccgccgcgcgggagcacctgttcgacaagacggtcacccccagcgacgtggggcagctgaa

SEQ ID NO: 43980 - protein, 217 aa, Panicum virgatum
  misc_feature: Ceres CLONE 2018963
  misc_feature (73)..(122): Pfam Name: AP2 Pfam Description: AP2 domain
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 50 in the 10/838,616 US patent application
  misc_feature: The sequence is a functional homolog of SEQ ID NO 48 in the 10/838,616 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: Functional homolog of the protein sequence given in SEQ ID NO 50662
  misc_feature: Useful for making plants with altered alkaloid content
  misc_feature: Useful for making plants with altered lignin content
  misc_feature: Functional homolog of the protein sequence given in SEQ ID NO 50663
  misc_feature: Useful for making plants with modulated water use efficiency
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: The sequence is a functional homolog of SEQ ID NO 46 in the 10/838,616 US patent application
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: The sequence is a functional homolog of SEQ ID NO 44 in the 10/838,616 US patent application
  misc_feature: The sequence is a functional homolog of SEQ ID NO 42 in the 10/838,616 US patent application
  misc_feature: The sequence is a functional homolog of SEQ ID NO 20 in the 10/838,616 US patent application
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
MDSASSLVVDDTSSGGACTDKLKALAAAAAEGATLERMGSGASAVVDAAEPGAEADSGHVGAGVGVGGKLPSSRYKGVVPQPNGRWGAQIYERHQRVWLGTFAEKADAARAYDVAAQRFRGRDAVTNFRPLSDADPDAAAELRFLASRSKAEVVDMLRKHTYFDELAQNKRAFAAAAAPTTSSPAGARSPSSAPRSPAAAREHLFDKTVTPSDVGQL

SEQ ID NO: 43981 - DNA, 579 bp, Panicum virgatum
  misc_feature: Ceres CLONE 2018969
  misc_feature: Encodes the peptide sequence at SEQ ID NO. 43982
atagcacacaaagagagaaaagatcggctcgacggcttacctctccttcgactaccgcctcgcgcccgagcaccgcctccccgcggcgcaggaggacggcgccgaggccatggcctggctccgcgcgcacgccacccacgacccctggctcgccgacgccgcggacttcgcgcgcgtcttcgtcgccggcgcctcggccggcggcaacatcgcgcaccatgtcgtggccaggttcggcaaggccggcctgggcccacctgtccggatccgcgggtgcgtcctcctgacgccggccatggccggcgccgcccggacgcgcgccgaggcggcggcgccgcccgacccgaacgcggtcctcaccaccgacatgatcgaccggtacgcgcgcctcttcctgccgccgggcgcgaccagggaccacccggcgatcaacctgtccgggccggaggcgccggcgctgggggccgtggcgacttctcccctgctcgtggtcgcggcgggacgcgaccgtgctccgggaccggcacgcgcagtacgcgcggcggatcaaggaggagtggggcaaggaggtggagtacg

SEQ ID NO: 43982 - protein, 156 aa, Panicum virgatum
  misc_feature: Ceres CLONE 2018969
  misc_feature (1)..(155): Pfam Name: Abhydrolase_3 Pfam Description: alpha/beta hydrolase fold
MAWLRAHATHDPWLADAADFARVFVAGASAGGNIAHHVVARFGKAGLGPPVRIRGCVLLTPAMAGAARTRAEAAAPPDPNAVLTTDMIDRYARLFLPPGATRDHPAINLSGPEAPALGAVATSPLLVVAAGRDRAPGPARAVRAADQGGVGQGGGV

SEQ ID NO: 43983 - DNA, 680 bp, Panicum virgatum
  misc_feature: Ceres CLONE 2018979
  misc_feature: Encodes the peptide sequence at SEQ ID NO. 43984
gcactagacccaaccgcgccgcaccgccatgcggcggccgccctgtccctaaccgccaccgccgccgcagcagcagccatgcccgcggaccccaagccccgcgcacggcggcgcccctgcccgcgcgcccgctcctcctcgcgctccccttcctctccctgctcctcctcctctacgtctactccaccgcctcctcctcctcctcgccctccgtcgacgtcgccaccgcctccgcgggcggtggcggcgtcccactcgccccgtccccgccgtcgccgcacatccgcatgcgccgcgcccggttccgctcctacgacgactacctccggcaccagctcaacaagacgctcgacccgcgcctccgccgcgtgtgggccacccgcgactggcgccgcgagggcctcctccgcaacgcctcccgcgcgctctgcgtcggtgcgcgcctcggccaggaggtggccgcgctgcgcgaggtcggggtcgccgccaccctcggcattgacctcgccccggcgccgccgctcgtcatccggggggacttccacgcgcagcccttccccgacgccaccttcgacttcgagttctcccacgtcttcgaccacgcgctctacccgggccgcttcgccgccaagatccagcgcaccctgcgccccggcggcatcgccgtgctccacgtcgcc

SEQ ID NO: 43984 - protein, 225 aa, Panicum virgatum
  misc_feature: Ceres CLONE 2018979
  misc_feature (142)..(223): Pfam Name: Methyltransf_11 Pfam Description: Methyltransferase domain
TRPNRAAPPCGGRPVPNRHRRRSSSHARGPQAPRTAAPLPARPLLLALPFLSLLLLLYVYSTASSSSSPSVDVATASAGGGGVPLAPSPPSPHIRMRRARFRSYDDYLRHQLNKTLDPRLRRVWATRDWRREGLLRNASRALCVGARLGQEVAALREVGVAATLGIDLAPAPPLVIRGDFHAQPFPDATFDFEFSHVFDHALYPGRFAAKIQRTLRPGGIAVLHV

SEQ ID NO: 43985 - DNA, 713 bp, Panicum virgatum
  misc_feature: Ceres CLONE 2018981
  misc_feature: Encodes the peptide sequence at SEQ ID NO. 43986
agctcacgtcgagcaccagttgtataggaccccgcgcgcacgaataaccgagcatattttcatatccaaatttcgaacctcatatatatacaagcaaaatttatttatttattgccatactgaacattatcaagcagtaagtacagaggaaaacaaacattgtgagtaaccccttccgctctctttgaactacagggctgtgacgccgccgtcctgatatcgtccaagaagaacgacgccgagaaggacgccgaggacaacgactccctcgccggcgacggcttcgacacgatcaaccgagtcaagaccgccgtcgagaggagttgccccggcgtggtctcctgcgccgacatcatacaactggccgccagagatgtcgtcttcctgtcgaaaggcccctactggtccgtcgagcttggccggcgcgacggcctcgtctccagggccagcgacgtcaagggcaagctgcccgacccaaagatgcacgtcaaggagctctccccgttgtttcagaggagcggcttctccccggatgacatggtcgcgctctcgggcgcgcacaccgtcggcttcgcgcactgcacccgcttcctcaaccggctgtacaactacagcagcagcacgccgacggacccctccttcaaccccgactacgcgcagcagctcaagcaggcgtgcccgcccaacgtcggcgagaccatcgccgtcaacat

SEQ ID NO: 43986 - protein, 77 aa, Panicum virgatum
  misc_feature: Ceres CLONE 2018981
  misc_feature: SWISSPROT Homolog: EC 1.11.1.7 Peroxidase
  misc_feature: Functional homolog of the protein sequence given in SEQ ID NO 51399
  misc_feature: Useful for making plants with altered carbohydrate content
  misc_feature: Functional homolog of the protein sequence given in SEQ ID NO 51637
  misc_feature: Useful for making plants with altered cell wall content and/or composition
MHVKELSPLFQRSGFSPDDMVALSGAHTVGFAHCTRFLNRLYNYSSSTPTDPSFNPDYAQQLKQACPPNVGETIAVN

SEQ ID NO: 43987 - DNA, 691 bp, Panicum virgatum
  misc_feature: Ceres CLONE 2018988
  misc_feature: Encodes the peptide sequence at SEQ ID NO. 43988
atcttgacaggccaccgaaacaaaattctctctctaggcgggagagagagagagagcggtcgcagccgccggccatggcggaggcggcgggagcccaagccccggcgcatggccccgaggaggcgcccctcgacgcgggcgccatcaggagtttcagggatggcggtggcaatgcagcggggggatcgtgggtcggggaggacggtcgcgtgtggcactcccacgacggcctcgcgccgcactcccacgagcccatctactcccccggcgacttcaccaagcgcgcgccgccgctcgcctcgcgtgccttcaccgaccgcgccttcaccgtcggaattggcggccccgtcggcacggggaaaactgccctgatgttagcactgtgcagattcctacgtgataaatatagtcttgctgcggtcacaaacgacattttcacaaaagaagatggggaattcttagtcaagcatggagcactcccagaagagcgcatacgtgcagtggaaactggagggtgccctcatgcagctatacgtgaagacatcagtataaatcttggtcctctagaggagctatcgaacttgtacaaagctgatttgctactctgtgaatctggaggagataacttggctgctaactttagccgagaattggcagactacataatctacataattgatgtctctggtgg

SEQ ID NO: 43988 - protein, 205 aa, Panicum virgatum
  misc_feature: Ceres CLONE 2018988
  misc_feature (84)..(204): Pfam Name: cobW Pfam Description: CobW/HypB/UreG, nucleotide-binding domain
MAEAAGAQAPAHGPEEAPLDAGAIRSFRDGGGNAAGGSWVGEDGRVWHSHDGLAPHSHEPIYSPGDFTKRAPPLASRAFTDRAFTVGIGGPVGTGKTALMLALCRFLRDKYSLAAVTNDIFTKEDGEFLVKHGALPEERIRAVETGGCPHAAIREDISINLGPLEELSNLYKADLLLCESGGDNLAANFSRELADYIIYIIDVSG

SEQ ID NO: 43989 - DNA, 717 bp, Panicum virgatum
  misc_feature: Ceres CLONE 2018992
  misc_feature: Encodes the peptide sequence at SEQ ID NO. 43990
gcatcagataagccagccgtctcctctgaataagcagcccaagggctcctctactactgtcagagagaaccagagaagcaggggaaaagatggtgaagcttgcatttggaagcttgggcgactctttcagcgcggcgtccctcaaggcctatgtcgccgaattcattgccacgctcctcttcgtgttcgccggcgtcggctccgccattgcctactcgcaattgacaaagggcggcgcgctggaccccgccggcctggtggccatcgccatcgcccatgcgttcgcgctcttcgtcggtgtctccatggccgccaacatctccggcgggcacctgaaccccgccgtcaccttcggcctcgccatcggcggccacatcaccatcctcaccggcatcttctactgggtcgcccagctgctcggcgcctccgtggcgtgccttctcctgaagttcgtcacccacggaaaggccatcccgacgcacggcgtgtccggcatcagcgagatcgagggcgtggtgatggagatcgtgatcaccttcgcgctggtgtacaccgtgtacgccaccgcggcggacccgaagaagggctccctgggcaccatcgcccccatggccatcggcttcatcgtgggcgccaacatcctggccgcggggcccttcagcggcggctccatgaacccggcccgctccttcggccccgccgtggcggccggcaact

SEQ ID NO: 43990 - protein, 209 aa, Panicum virgatum
  misc_feature: Ceres CLONE 2018992
  misc_feature (11)..(209): Pfam Name: MIP Pfam Description: Major intrinsic protein
MVKLAFGSLGDSFSAASLKAYVAEFIATLLFVFAGVGSAIAYSQLTKGGALDPAGLVAIAIAHAFALFVGVSMAANISGGHLNPAVTFGLAIGGHITILTGIFYWVAQLLGASVACLLLKFVTHGKAIPTHGVSGISEIEGVVMEIVITFALVYTVYATAADPKKGSLGTIAPMAIGFIVGANILAAGPFSGGSMNPARSFGPAVAAGN

SEQ ID NO: 43991 - DNA, 686 bp, Panicum virgatum
  misc_feature: Ceres CLONE 2018994
  misc_feature: Encodes the peptide sequence at SEQ ID NO. 43992
aacgctaaaaaagtaacagtttctgtactttattggaggaacgacaaaaaggaatgcccgccaaggctgtccctgcccctgagagcgccatcaagcgtgccgcccacaaggtccagcagtcggagaacttccgcaaggccgtcgccgccaacaaggctgagaagaagaagctcacggccaccgcgtacctccgcggcctcaagtactctcgccagtaccgcgcccagcaggccaagcttgtgaccctgcgccgccaggccaagagccacggcaacttcttcgccgaggagaagcccaagatcgccgtcgtcgtgcgcatccgcggtatcgcgaaggtcgcccccaagcagcgcaaggtgctccagctgctccgcctccgccagatcttcaactgcgtgcttgtcaagatcaacaagcccatggagaacctgctgcgcctcgtcgagccctacatcgcgtacggttacccgtccctcaagactgttcgcgccctcgtgtacaagcgtggtcacctgaagatcaacggccagcgcgtcaagatctagtcgaacaagctcatcaaggacaagttcaacaacgacgacatcgtctgcgctgaggacgtggtgaaccagatctacactgccggcaagcacttccgcaccgtgaccaacggcctgtggcccttcaagctgtcgccccccaag

SEQ ID NO: 43992 - protein, 163 aa, Panicum virgatum
  misc_feature: Ceres CLONE 2018994
  misc_feature (83)..(134): Pfam Name: Ribosomal_L30 Pfam Description: Ribosomal protein L30p/L7e
  misc_feature (11)..(81): Pfam Name: Ribosomal_L30_N Pfam Description: Ribosomal L30 N-terminal domain
MPAKAVPAPESAIKRAAHKVQQSENFRKAVAANKAEKKKLTATAYLRGLKYSRQYRAQQAKLVTLRRQAKSHGNFFAEEKPKIAVVVRIRGIAKVAPKQRKVLQLLRLRQIFNCVLVKINKPMENLLRLVEPYIAYGYPSLKTVRALVYKRGHLKINGQRVKI

SEQ ID NO: 43993 - DNA, 674 bp, Panicum virgatum
  misc_feature: Ceres CLONE 2019016
  misc_feature: Encodes the peptide sequence at SEQ ID NO. 43994
ctgctagactaattagccggggtgcttctggcaggtcaattgtgaagaaggaggtgtcccagacggtggtggtgaagccggggtggaagaaagggaagcaggtcgtgttcgaaggcatgggcgacgagcggccgggctgcctgcccgccgacgcgatcttcaccgtgtcggagaagaagcacccgatgttcaagcgcgtgggcaacgacctggtgctcaaggccgaggtgccgctggtgagcgcgctcacgggctggtccctgtcgttccggctcctgagcggcaagaaggtgagcctggcgttccaggacgaggtcatccgccccgggctcgagaaggtgatcaggggcgaaggcatgcccatccccgagcacaagggcggcgcgcggggcgacctcagggtgaagctcgaggtcgtcttccccaaggagctcaccggcgagcagcgcgccgggctcgccgagatcctcaaagggtcctgctgctgatccggatcggtcgatcgaccgagcttgtggtggtgccgccgtgccggcgccgggaccgacgaccgtatcgagttttcttggccgtatgtctgagcaactccaacggattgatctttctctttcctctttctcattatatagagaatttttttttctcaattttaacatatattgaagaagtgctcc

SEQ ID NO: 43994 - protein, 161 aa, Panicum virgatum
  misc_feature: Ceres CLONE 2019016
  misc_feature (32)..(156): Pfam Name: DnaJ_C Pfam Description: DnaJ C terminal region
ARLISRGASGRSIVKKEVSQTVVVKPGWKKGKQVVFEGMGDERPGCLPADAIFTVSEKKHPMFKRVGNDLVLKAEVPLVSALTGWSLSFRLLSGKKVSLAFQDEVIRPGLEKVIRGEGMPIPEHKGGARGDLRVKLEVVFPKELTGEQRAGLAEILKGSCC

SEQ ID NO: 43995 - DNA, 650 bp, Panicum virgatum
  misc_feature: Ceres CLONE 2019023
  misc_feature: Encodes the peptide sequence at SEQ ID NO. 43996
gcgctgcgctcccatcagcccacagtcccacacacacttgcatcgcacgagcgctcgccggagaggagaaagggtggccggaggacgaaaccctagcttgcggcagcgtcggcggcggtagaaggagaagatgatctacgacgtgaactcgcccctcttccgctccttcctcagccagaagggaggcgccgacaagaggaaaatggaggagcataaaccaaaggagcagaggcccaaggccagcgagaacaagcctgtgatgaacgaatgaacatctctggaagcggcattcattagccctgtggcgaacctcaatgtccacctcctctgtttagcttaaaaccaacgcttcctatagtcttagccatgtcctagtttccccttatagtcttaatcgctctggctgaacatggcgacagtgcaacggacgtgaagcttgaactacctataggattattatcaatttgagacgcccatgattgacaacttttcagcagccctcctgttactgccgttgtggttggtacaaattcgtggggcgccaccatgttcatgcctgcttttccacctccccagcagccctgcctgtaccttcaactttatatagtatctagaggcagaatggtgtaaagtggttcttagggcggatc

SEQ ID NO: 43996 - protein, 46 aa, Panicum virgatum
  misc_feature: Ceres CLONE 2019023
  misc_feature (1)..(46): Pfam Name: Wound_ind Pfam Description: Wound-inducible basic protein family
  misc_feature: Functional homolog of the protein sequence given in SEQ ID NO 50132
  misc_feature: Useful for making plants with modulated biomass
MIYDVNSPLFRSFLSQKGGADKRKMEEHKPKEQRPKASENKPVMNE

SEQ ID NO: 43997 - DNA, 715 bp, Panicum virgatum
  misc_feature: Ceres CLONE 2019036
  misc_feature: Encodes the peptide sequence at SEQ ID NO. 43998
atcaccagcgcatcgcattccaatcccatttcccccttgagcaaaaaagaggcagccagagagagcatcaccatgtcgggcatcatccacaagatcgaggagaccctccacatggggggcgaccacaagaaggcggaggcgcacaagaaggccgaggagcaccacaagaaggacggggagcacaaggagggcatcgtcgagaagatcaaggacaagatcaccggcgagcacggcgacaagtccggcgagcacaaggacgacaaggaccacaaggagaagaaggacaagaagaagaagaaggagaagaagcacggcgagggccaccacgacggccacagcagcagcagcagcgacagcgactgatcgcctcgccgcgcgccgtgcttgccggtgaaaaaggtgcttggagaggactatctaccggaagctgtgtgatgtaatgtttcatgagtgccatgcgtgtgtgtgtgtgtgctaatcaagggagaaatgcaaaaaaaaatcctttatgttggtgaatgtactcctaatgatggctccatggtgctagcttgtaataaaatgttaatgcagaaattggtctgctagcttgtgtctttaaaacaagcgaagcagagcacacaagagcagcgctccaccttcttcagccgcgctacctgctttcttcctcgctcgtgatcaccgagaggatatgtcttgctgcggcggcaactgg

SEQ ID NO: 43998 - protein, 96 aa, Panicum virgatum
  misc_feature: Ceres CLONE 2019036
  misc_feature (2)..(96): Pfam Name: Dehydrin Pfam Description: Dehydrin
MSGIIHKIEETLHMGGDHKKAEAHKKAEEHHKKDGEHKEGIVEKIKDKITGEHGDKSGEHKDDKDHKEKKDKKKKKEKKHGEGHHDGHSSSSSDSD

SEQ ID NO: 43999 - DNA, 645 bp, Panicum virgatum
  misc_feature: Ceres CLONE 2019046
  misc_feature: Encodes the peptide sequence at SEQ ID NO. 44000
  misc_feature (392)..(392): n is a, c, t, g, unknown, or other
  misc_feature (400)..(400): n is a, c, t, g, unknown, or other
atcccagtatcccacgcactcgcccttatcatccatccaccctccgtcctccctcccctccctcgcccatcccccaccacgccggcccaccgcccacgccatcccactccgttcccccctcagtttccccactcggttgcagttgctgcgagcagtcaccaccaccgccgctgccgcgcacacaaaccagcggcaataaacacctcccccgcccccctcgcctcgctcccaacctccgattcgagggcgccgcgatcgcgatcgcgatcggacccgtccgcggctggaatcgtcgaggagccgagagggatcggattggtggggggggagagagagagagagagagagagagagagagagagagagagagagagagagagagggggggcggngatggggnggctgttcctgacgcacctggacggcaacgtctacagctgcaagcactgcaagacccacctcggccttgccagcgacatcatctccaaggccttccacagcaagaacgggaaggcctacctcttccataaggttgtcaatgtgactcctggagtaaaagaagaccgcatgatgataacaggaatgcatactgtttctgatatcttctgtggttgctgtggatccatggttggatggaaatatgaa

SEQ ID NO: 44000 - protein, 83 aa, Panicum virgatum
  misc_feature: Ceres CLONE 2019046
  misc_feature (1)..(83): Pfam Name: Yippee Pfam Description: Yippee putative zinc-binding protein
  misc_feature (3)..(3): Xaa is any aa, unknown, or other
MGXLFLTHLDGNVYSCKHCKTHLGLASDIISKAFHSKNGKAYLFHKVVNVTPGVKEDRMMITGMHTVSDIFCGCCGSMVGWKY

SEQ ID NO: 44001 - DNA, 686 bp, Panicum virgatum
  misc_feature: Ceres CLONE 2019053
  misc_feature: Encodes the peptide sequence at SEQ ID NO. 44002
agaggaggctgtaccgcacttaaatgcgagcgtaaccaactaaggtctccccgtaccggcgaggaacaacagggaggaggcgaagcggaaatggggctccgccaccgcgcctcctcgctcctgctgctatccctggctctcgggctcgccgtcgcgctcgtctcagtgtcggcgcagcagaagttcgggatcaactacgggcagatcgccaacgacctgccggacccgacgcgggtggcggggctcctccagtcgatgaacgtgaacaaggtgaagctctacgccgcgctcggcgacctgggccttggcagccaggtcaccgtgtcgtcggcgcactccgtgaacgtgctcgctaccagcttcccgccgtcgtcgggcgcgttccgggaggacctcgccgagtacatccagccgatcctcgacttccacggccagacgggctcgccgttcctcatcaacgcctacccgttcttcgcctacaaggccaaccccggcagcgtgtcgctgccgtacgtgctgttcgagcccaacccgggcatgcgcgaccccaacaccaacctcagctacgacaacatgctctacgcccagatcgacgccgtgtacgcggcgatgaaggccatggggcacacggacgtgggcgtcaggatctccgagacggggtggccgtccaagggcgacgaggacga

SEQ ID NO: 44002 - protein, 198 aa, Panicum virgatum
  misc_feature: Ceres CLONE 2019053
  misc_feature (32)..(198): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Functional homolog of the protein sequence given in SEQ ID NO 51686
  misc_feature: Useful for making plants with altered carbohydrate content
  misc_feature: Functional homolog of the protein sequence given in SEQ ID NO 50921
  misc_feature: Useful for making plants with altered cell wall content and/or composition
MGLRHRASSLLLLSLALGLAVALVSVSAQQKFGINYGQIANDLPDPTRVAGLLQSMNVNKVKLYAALGDLGLGSQVTVSSAHSVNVLATSFPPSSGAFREDLAEYIQPILDFHGQTGSPFLINAYPFFAYKANPGSVSLPYVLFEPNPGMRDPNTNLSYDNMLYAQIDAVYAAMKAMGHTDVGVRISETGWPSKGDED

SEQ ID NO: 44003 - DNA, 676 bp, Panicum virgatum
  misc_feature: Ceres CLONE 2019054
  misc_feature: Encodes the peptide sequence at SEQ ID NO. 44004
gagtgccgacaaagaaaggggccggccgtcctcctcggcggcgccggcgtctttggatcctccggccgccggacccgccttatttccctctccacctgctccgcgtcctgccctgccagccggctgccgccctgctgcattgcgcacactcgcaggtttcagactcccaagacctctgccaatcagtatcgagtattgacactacatagtttgggagcaatataagtagtgttttagaaatatgaatccgtatttctttggtttccttctcccctttgtcgcatctctactgctcaccaagaggaaatctgagaagaagaggggagtaccggtcgatgtgggtggagagcccggctgcgctgtccgtaaccacggatttgaaaggcccatcgaaacgcactgggaaggggtttccacgcttgctgagctatttgagcagtcatgcgagcagttcgcctacatgcccctgtatggcaccaggaagctcattgcgagggagttggaagtggctcctgatggaagatcctttgagaagctccatttggggaactatgtgtggaaaagctatgctgatgcgttcaagactgtgtgcaacttctcgtctggcctattgagacttgggcacctcaaggctgagcatgttgctatttttgctaatactcgggctgagtggcag

SEQ ID NO: 44004 - protein, 144 aa, Panicum virgatum
  misc_feature: Ceres CLONE 2019054
  misc_feature: SWISSPROT Homolog: EC 6.2.1.3 Long-chain-fatty-acid--CoA ligase
MNPYFFGFLLPFVASLLLTKRKSEKKRGVPVDVGGEPGCAVRNHGFERPIETHWEGVSTLAELFEQSCEQFAYMPLYGTRKLIARELEVAPDGRSFEKLHLGNYVWKSYADAFKTVCNFSSGLLRLGHLKAEHVAIFANTRAEW

SEQ ID NO: 44005 - DNA, 640 bp, Panicum virgatum
  misc_feature: Ceres CLONE 2019070
  misc_feature: Encodes the peptide sequence at SEQ ID NO. 44006
cttcttgaattcgaaacagcagttgatgcagctactgcaaaagtctttattaggagccaagctcctgcagatgtttgttccagggataagaatacatctggtcatcaactattggtgcaaaatatagacaactcagtccctgacatggagttaatcaatgccttctcctgttttggtgaggtcattaggtggcaattcaatagatctgatgggacctgctttatagtttataggtcacaagatgctgctgcctgtgcgaaatcacacttgcatggtgcacgatttgggctgaagtcaattattgttgaatcaaggacaagcagtgcaggatctgttcatgataaaacactgttgcctgttgctccactgttaggccagggttttcctgacaacagcatccaccaagatatcagaaatccaagagtttcaggatatcatgcaggctatgcagcaccaggggatcgacctatttatggcccacctcctccaaatacaaacagagctccacaaggaattattccttgccctcctgtttccacacaccgtggttctgtaataccaccaccacctattcaaacctcctttgttcatcctgtatatcatggtccagggagtccttgggagaacactacccccaatc

SEQ ID NO: 44006 - protein, 213 aa, Panicum virgatum
  misc_feature: Ceres CLONE 2019070
  misc_feature (37)..(102): Pfam Name: RRM_1 Pfam Description: RNA recognition motif. (a.k.a. RRM, RBD, or RNP domain)
LLEFETAVDAATAKVFIRSQAPADVCSRDKNTSGHQLLVQNIDNSVPDMELINAFSCFGEVIRWQFNRSDGTCFIVYRSQDAAACAKSHLHGARFGLKSIIVESRTSSAGSVHDKTLLPVAPLLGQGFPDNSIHQDIRNPRVSGYHAGYAAPGDRPIYGPPPPNTNRAPQGIIPCPPVSTHRGSVIPPPPIQTSFVHPVYHGPGSPWENTTPN

SEQ ID NO: 44007 - DNA, 637 bp, Panicum virgatum
  misc_feature: Ceres CLONE 2019074
  misc_feature: Encodes the peptide sequence at SEQ ID NO. 44008
atccaaccgctcgtccgggcaggcgacgacgcgtcaatcgattccttcctcctccacctcctccttccccggcgacgccttgtcccctcctccgacccgcacccccgagagatcgagcgatcgatcgccgatcgatccgttccccaagcaccccgatcccctatccaccctgcaaccgaccgaccggccgccggcgcgcgcgcgcgcgcaagattcagatttgccccggcgcgggggaggaggagcggcgagcgaggatgggcgcgtggatgtcgcgcgtgtggttcctgatgttcccggcgcgggagtacaagctcgtcgtggtggggctcgacaacgctggcaagaccaccacgctctacaagctccacctcggcgaggccgtcaccgccgcgcccaccatcggcagcaacgtcgaggaggtcgtcttcaagaacctgcgcttcgaggtcagccagcttccctccctctcccccctctcctcccttgctcccccgtccgggccgcggagcacggatattaggctggattcgctgccgcggctagcttgctccgcgccacggtcgacgccggatcgagcgacgcggtagagccggaggcgcgtttgtccgttaggcttaagatctatgctctagag

SEQ ID NO: 44008 - protein, 110 aa, Panicum virgatum
  misc_feature: Ceres CLONE 2019074
  misc_feature (5)..(104): Pfam Name: Arf Pfam Description: ADP-ribosylation factor family
  misc_feature: Functional homolog of the protein sequence given in SEQ ID NO 51466
  misc_feature: Useful for making plants with altered lignin content
MGAWMSRVWFLMFPAREYKLVVVGLDNAGKTTTLYKLHLGEAVTAAPTIGSNVEEVVFKNLRFEVSQLPSLSPLSSLAPPSGPRSTDIRLDSLPRLACSAPRSTPDRATR

SEQ ID NO: 44009 - DNA, 561 bp, Panicum virgatum
  misc_feature: Ceres CLONE 2019075
  misc_feature: Encodes the peptide sequence at SEQ ID NO. 44010
ttagcggagctgtcgatgtgagcttagcggagctggcctccctcgaaaaccctagaagcccttcaccctcccctgcggcggccgccttctcctcgcggaatccttctcgcctcgcgaaaatgagccaggaggcagtgaacccgaaggcgtacccgctggcggacgcgcagctgacgattagtatcctcgagatcatccagcaggccgccaactacaagcagctcaagaagggcgccaacgaagcgacgaagaccctaaacaggggaatatcggagttcgtggtgatggcggctgacaccgagccgctcgagatccttctccacctccccttgctagctgaggataagaatgtgccatatgtatttgttccatcgaagcaagctcttggacgcgcttgtggtgtgacaagaccggttattgcttgctcagtgaccagcaacgagggtagccagctgaaacagccgattcagagtctcaaggactctatcgagaagcttctcatctgatttaccaaagacctttcagtgtgatggggctcagagggacacatttttcagaggg

SEQ ID NO: 44010 - protein, 128 aa, Panicum virgatum; identical to SEQ ID NO: 12946
  misc_feature: Ceres CLONE 2019075
  misc_feature (20)..(114): Pfam Name: Ribosomal_L7Ae Pfam Description: Ribosomal protein L7Ae/L30e/S12e/Gadd45 family

SEQ ID NO: 44011 - DNA, 668 bp, Panicum virgatum
  misc_feature: Ceres CLONE 2019081
  misc_feature: Encodes the peptide sequence at SEQ ID NO. 44012
ctgccaacccatttctcccgagagccccgacgcgcgctgcctgcaccctcgccgccgccgccgccgccgcctcctctccagctcggacccccatggcttccctcgccggatccgccctctccctcgcgatgcccgtcaaggcaattaacattaagtccgtctctttctctggtttaaggaaggataatgtaaccttccgtctgcagccagtgccacaaagatttgcagtctgctgtccggctaaaaaggagacagtggaccaggtttgtgatattgtcaagaagcagcttgcacttgctgaaggcactgaagtttgtggctcctccaagttccaagatcttggtgctgattcattggacactgttgagattgttatgggccttgaggaggcttttgggatcagtgtggaggagtcaagcgcgcagtcaattgcaaccgtggaagatgctgctaatctcattgatgaccttgttgctgcaaaatcgtcctaaactcggatctatattacttatcctggccctgaaccaaggcatctcttgccccatgctccttccctgctagattttaccctggagagccatttctttgttattactgtcattgtggatccagtaatattattacattgaagcttttgtgcttgtttgcgactatatattggaagcgat

SEQ ID NO: 44012 - protein, 132 aa, Panicum virgatum
  misc_feature: Ceres CLONE 2019081
  misc_feature (56)..(123): Pfam Name: PP-binding Pfam Description: Phosphopantetheine attachment site
MASLAGSALSLAMPVKAINIKSVSFSGLRKDNVTFRLQPVPQRFAVCCPAKKETVDQVCDIVKKQLALAEGTEVCGSSKFQDLGADSLDTVEIVMGLEEAFGISVEESSAQSIATVEDAANLIDDLVAAKSS

SEQ ID NO: 44013 - DNA, 697 bp, Panicum virgatum
  misc_feature: Ceres CLONE 2019091
  misc_feature: Encodes the peptide sequence at SEQ ID NO. 44014
actagtgtgatctgactcttggccttggcaagctcccagctcccagctccagcttggtgccggtgcctgctctgaagcatagcaagatgggcaggggagctcagccatctgcgccgctcctgctcttctctctggggctggtgcttctctacttcaccgcaggcagcaccgtccgtcttgcggaggcacagaagacgtggtgcatcgcgaaaccgtcggcgtcgaacgagatcctggcgcagaacctggactacgcgtgctcccaggtgagctgcgccgtgatccagaagggcgggccgtgctactacccggacagcctggtgtcccgcgccgccgtcgccatgaacctctactacgcctacagcggccgccacgcctggaactgctacttcaacaactccgcgctcgtcgtccagtccgaccccagttacggatcctgcacgtactactgatggtgagtggcgccggttgtggagtggagggacgccgtgcgagctcaactgcaaactgctgatgcagctgagacaactcagattgtcggggaacggcagaggctactctctgattgttgtgtggtggattgtgatgtgtctagtgaactgtgatgcagttgacctttggagatgttgtcgcttcgaacatagatctgttcggtttgtcgacttatttattctcgtagaacactattgaatcagcc

SEQ ID NO: 44014 - protein, 121 aa, Panicum virgatum; identical to SEQ ID NO: 16446
  misc_feature: Ceres CLONE 2019091
  misc_feature (37)..(120): Pfam Name: X8 Pfam Description: X8 domain
  misc_feature: SWISSPROT Homolog: EC 3.2.1.39 Glucan endo-1,3-beta-D-glucosidase

SEQ ID NO: 44015 - DNA, 706 bp, Panicum virgatum
  misc_feature: Ceres CLONE 2019098
  misc_feature: Encodes the peptide sequence at SEQ ID NO. 44016
gttctgcagcagtcgccgtcctcggcctccccttcctcaccttggcgcctagcgaggaccaggagattcatccggacctcgattgcttccttctgctgccggtccgaagtccgatgggaagcagggacggcagcggcgtcagcacaggaggccaggattatgccgctgacatcgattccatcagggaggcgcaggcccgcattacgccgcacgtgcacaggacgcccgttctgtcctcgacatcaatcgatgccgtagcggggaagcagctgttcttcaagtgcgagtgcttccagaaggctggcgcattcaagatccgtggtgcttcgaattcgatatttgcgcttgatgatgagcaggcatcaaagggtgtggtgacacatagcagtgggaaccatgccgctgccgtggctttagctgcaaagctgcgtggcatacctgcacacattgtcataccaaagaatgcaccagcatgtaaggtcgacaacgttaggcggtatggtggtaatattatctggagtgatgtcagcattgagtcgcgagaatctgtttgtaaaagagtccaggaggagactggtgctgttctagttcatcccttcaataataagtacactatcagtggtcagggtacagtatctcttgagcttctagagcaagtccctgaaattgacacaataattgttcccattagtggtggtggtttaat

SEQ ID NO: 44016 - protein, 197 aa, Panicum virgatum
  misc_feature: Ceres CLONE 2019098
  misc_feature (30)..(197): Pfam Name: PALP Pfam Description: Pyridoxal-phosphate dependent enzyme
  misc_feature: SWISSPROT Homolog: EC 5.1.1.18
MGSRDGSGVSTGGQDYAADIDSIREAQARITPHVHRTPVLSSTSIDAVAGKQLFFKCECFQKAGAFKIRGASNSIFALDDEQASKGVVTHSSGNHAAAVALAAKLRGIPAHIVIPKNAPACKVDNVRRYGGNIIWSDVSIESRESVCKRVQEETGAVLVHPFNNKYTISGQGTVSLELLEQVPEIDTIIVPISGGGL

SEQ ID NO: 44017 - DNA, 676 bp, Panicum virgatum
  misc_feature: Ceres CLONE 2019100
  misc_feature: Encodes the peptide sequence at SEQ ID NO. 44018
aaatatatctaatatataattaaagcagcgaagctaaatgcctccaaagaagttcaagtccactaagagcaccaaggctgccaaggccaacagaaaccccctcttcgagaagagacccagaaacttcagaattggtggtgatattcagcccactagagatttgaccagattcgttcgttggcccaagtatattctcctccaaagacaaaagagagtcttgctccaaagacttaaggtcccaccagcactcaaccaattctctcagaccatcgatagaaaccaagctaccactcttttgaagctcctcagaaagtaccaacccgaatctgaacaaaagagaaaggagagaagattggaagctgccaagcttaaggctgaaaacaagaagcctgctgacactaagccaccaattgcccttaagtacggtctcaacaacgtcactggccttattgaggataagaaagctagattggtcatcatcgccaacgacgttgacccaattgaaaccatcgtttggcttcctcaactctgcagaaagcaagaagttcctttctgcttcatcagaggtaaggcaagactcggcaagcttgttggcttgaagactgccagttgtgtcgctttgactggtatcagaaaagaggatcaagctgaattcgacaacttggtttagactttc

SEQ ID NO: 44018 - protein, 210 aa, Panicum virgatum
  misc_feature: Ceres CLONE 2019100
  misc_feature (112)..(207): Pfam Name: Ribosomal_L7Ae Pfam Description: Ribosomal protein L7Ae/L30e/S12e/Gadd45 family
MPPKKFKSTKSTKAAKANRNPLFEKRPRNFRIGGDIQPTRDLTRFVRWPKYILLQRQKRVLLQRLKVPPALNQFSQTIDRNQATTLLKLLRKYQPESEQKRKERRLEAAKLKAENKKPADTKPPIALKYGLNNVTGLIEDKKARLVIIANDVDPIETIVWLPQLCRKQEVPFCFIRGKARLGKLVGLKTASCVALTGIRKEDQAEFDNLV

SEQ ID NO: 44019 - DNA, 742 bp, Panicum virgatum
  misc_feature: Ceres CLONE 2019118
  misc_feature: Encodes the peptide sequence at SEQ ID NO. 44020
aacaagaaccattcccaaacagccacacacacacacacacacccagctcacagcctgctccaccagcacatcacccagcccgtcagccatgagcaaggactgcggcaaccacggcgacgatgacttcaagcagagcctccggcgcctgctgggcgtcctcctggtgctcgccctcctcgtcggcctcatcgcgctcatcgtctacctggtcctgcgccccacgcacccgcgcttcatcctccaggacgccgcgctccgccagctcgacctctccaacggctcggcgccgctgctctccacggcggtccaggtcaccgtcgcctcccgcaaccccaacggccgcgtcggcgtgcactacgaccgcctcgacgtctacgcctcctacaagtaccagcaggtcacgctcgcgtccaggctcccgccgctgtaccagggccacggcgacgtcgacgtctggtcgccggtgctgaccggcccgaacgtgcccttcgcgccgttcctcgccgacgccatgaggaaggacatcgccaccgggtacctcatcatggaggtcaggatcgacggccgcgtccggtggaaggtcggcagctggacgtccggccactaccacatcttcgtcacctgcccggcctacttcatcggcagcggcacatccagcgtcgtcggtgcgcatgggctcaggttccagacggccacctactgccgcgtcgaggtctagcctgcctctgctctgctcctctgc

SEQ ID NO: 44020 - protein, 209 aa, Panicum virgatum
  misc_feature: Ceres CLONE 2019118
  misc_feature (39)..(179): Pfam Name: Hin1 Pfam Description: Harpin-induced protein 1 (Hin1)
MSKDCGNHGDDDFKQSLRRLLGVLLVLALLVGLIALIVYLVLRPTHPRFILQDAALRQLDLSNGSAPLLSTAVQVTVASRNPNGRVGVHYDRLDVYASYKYQQVTLASRLPPLYQGHGDVDVWSPVLTGPNVPFAPFLADAMRKDIATGYLIMEVRIDGRVRWKVGSWTSGHYHIFVTCPAYFIGSGTSSVVGAHGLRFQTATYCRVEV

SEQ ID NO: 44021 - DNA, 731 bp, Panicum virgatum
  misc_feature: Ceres CLONE 2019121
  misc_feature: Encodes the peptide sequence at SEQ ID NO. 44022
gcgacggcacggtgtccctcaagcaggaggcgctggacaatatccccgggcccaccatgaacttcacccagctcctccagtccttccagaacaagagcctcagcctcgctgacctcgtctggctctcaggggctcacaccatcggcatcgggcactgcaacaccttcagcgagcgcctctacaacttcaccggccgcggcggccccggcgacgccgacccgtcgctggacccggcgtacgcggacaacctgcggcggaccaagtgcaagacgctgacggacaacaccaccatcgtcgagatggaccccggcagcttccggaccttcgacctgagctactaccggggcgtgctcaagcgccggggcctgttccagtcggacgcggcgctgctcaccgacccggcggccaaggccgacatcctcagcgcggtgaactcgccgcccgagttcttcttccaggtgttcgcggcgtccatggtgaagctgggcgccgtcgaggtcaagacaggctccgagggcgagatcaggaagcactgcgccgtcgtcaactagcactaggcgccattgcccattgggggacccggaaggaaaaaacggttccatttcttcagagatccttgggatactggtggtggatggatacctggattgtggtgtctctacgtttgtttttttgttgttgctgtattcttttgttacctttgtgctgatcatgggggtggtccttttttt

SEQ ID NO: 44022 - protein, 182 aa, Panicum virgatum
  misc_feature: Ceres CLONE 2019121
  misc_feature (1)..(145): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50563
  misc_feature: Useful for making plants with altered carbohydrate content
  misc_feature: Functional homolog of the protein sequence given in SEQ ID NO 50564
  misc_feature: Useful for making plants with altered cell wall content and/or composition
  misc_feature: Useful for making plants with modulated phosphate use efficiency
  misc_feature: Functional homolog of the protein sequence given in SEQ ID NO 50230
  misc_feature: Useful for making plants with modulated nitrogen use efficiency
DGTVSLKQEALDNIPGPTMNFTQLLQSFQNKSLSLADLVWLSGAHTIGIGHCNTFSERLYNFTGRGGPGDADPSLDPAYADNLRRTKCKTLTDNTTIVEMDPGSFRTFDLSYYRGVLKRRGLFQSDAALLTDPAAKADILSAVNSPPEFFFQVFAASMVKLGAVEVKTGSEGEIRKHCAVVN

SEQ ID NO: 44023 - DNA, 745 bp, Panicum virgatum
  misc_feature: Ceres CLONE 2019124
  misc_feature: Encodes the peptide sequence at SEQ ID NO. 44024
ctcacggagcaccagaccatctcagctttgcttctcagctagctagctttaggctccggttgcagcgagaagcaggcaggcaggcatggaggggaaggaggaggacgtccgcctgggcgccgctcttcgagcccggggagctcaagtcctggtccttctaccgcgccggcatcgccgagttcgtcgccaccttcctcttcctctacatcagcatcctcaccgtcatgggcgtcagcaattcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatcgtcatgcagtgcctgggcgccatctgcggcgccggcgtcgtcaagggcttccagaagggactgtacatgggcaacggcggcggcgccaacgtcgtcgcccccggctacaccaagggcgacggcctcggcgctgagatcgtcggcaccttcatcctcgtctacaccgtcttctccgcccacgacgccaagaggaacgccagggactcccacgtcccgatccttgctcccctcccaattgggttcgccgtgttcctggtccacctggccaccatccccatcaccggcacgggcatcaaccccggcaaggagccttggcgctgccatcatct

SEQ ID NO: 44024 - protein, 247 aa, Panicum virgatum
  misc_feature: Ceres CLONE 2019124
  misc_feature (46)..(247): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50196
  misc_feature: Useful for making plants with modulated drought sensitivity
HGAPDHLSFASQLASFRLRLQREAGRQAWRGRRRTSAWAPLFEPGELKSWSFYRAGIAEFVATFLFLYISILTVMGVSNSQSKCATVGIQGIAWSFGGMIFALVYCTAGISGGHINPAVTFGLFLARKLSLTRAIFYIVMQCLGAICGAGVVKGFQKGLYMGNGGGANVVAPGYTKGDGLGAEIVGTFILVYTVFSAHDAKRNARDSHVPILAPLPIGFAVFLVHLATIPITGTGINPGKEPWRCHH

SEQ ID NO: 44025 - DNA, 572 bp, Panicum virgatum
  misc_feature: Ceres CLONE 2019128
  misc_feature: Encodes the peptide sequence at SEQ ID NO. 44026
accgtctcccccaacacgctcccctcgctgcggctctcatttcggctcaaccgcacccgctccactccgctccgagctgatcgagaagtggtgtggtggacatgggccagatccagtactccgagaagtacttcgatgacacctacgagtacaggcacgtcgtcctcccgcccgaggtcgccaagctcctgcccaagaaccgcctcctctccgagaacgagtggcgtgcgatcggcgttcagcagagccgcgggtgggtgcactacgcgatccaccgaccggagccgcacatcatgctgttccgccgcccgctcaactaccagcagcagcaggaggcggctgcagcggcggcggcgcagatgctgcccaagtgagccctccggcgagggcggcggccaccgtgggtttgctgcatttaaaaccccaatccccttttgaactcaaaaaggggtgtcgctgtgcttcgattaatctctccgcctgttggctggaatcaagtgactggtgttggcggcgtccgccttgtgttcgtggtaatgccctgcgaaggaactggctggggttaggctgtg

SEQ ID NO: 44026 - protein, 90 aa, Panicum virgatum
  misc_feature: Ceres CLONE 2019128
  misc_feature (1)..(72): Pfam Name: CKS Pfam Description: Cyclin-dependent kinase regulatory subunit
  misc_feature: Functional homolog of the protein sequence given in SEQ ID NO 51687
  misc_feature: Useful for making plants with altered oil content
MGQIQYSEKYFDDTYEYRHVVLPPEVAKLLPKNRLLSENEWRAIGVQQSRGWVHYAIHRPEPHIMLFRRPLNYQQQQEAAAAAAAQMLPK

SEQ ID NO: 44027 - DNA, 567 bp, Panicum virgatum
  misc_feature: Ceres CLONE 2019130
  misc_feature: Encodes the peptide sequence at SEQ ID NO. 44028
gcactcaccaagcgaatacaacataattatctttcttttatttgctaacacttggtctctttcggtgaaagcaagatgcagattttcgtaaaaacccttactggtaagacaattaccttggaggttgagtcatcggacaccatcgagaacgtcaagcagaagattcaggataaggaaggcatccctcctgatcaacaacgcttgatttttgctggaaagcaactcgaggatggtagaacactttcggactacaacatccaaaaagagtccactctgcaccttgtattgagacttcgtggaggaggtaaaaagagaaagaagaaggtctacaccaaacccaagaagatcagacacaagaagaagaaagtcaaattggccgttctcaaattctacaaagtagacgagagtggaaaaatcactcgtctaagaagagaatgccccgccgccgaatgtggagcaggaaccttcatggccagtcactttgatcgtcagtactgtggaaaatgcggtttgacctacgtattcaacaaaccaaagggagaaggaaaggacgaagagtagtaggac

SEQ ID NO: 44028 - protein, 161 aa, Panicum virgatum
  misc_feature: Ceres CLONE 2019130
  misc_feature (6)..(74): Pfam Name: ubiquitin Pfam Description: Ubiquitin family
  misc_feature (101)..(147): Pfam Name: Ribosomal_S27 Pfam Description: Ribosomal protein S27a
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIENVKQKIQDKEGIPPDQQRLIFAGKQLEDGRTLSDYNIQKESTLHLVLRLRGGGKKRKKKVYTKPKKIRHKKKKVKLAVLKFYKVDESGKITRLRRECPAAECGAGTFMASHFDRQYCGKCGLTYVFNKPKGEGKDEE

SEQ ID NO: 44029 - DNA, 706 bp, Panicum virgatum
  misc_feature: Ceres CLONE 2019143
  misc_feature: Encodes the peptide sequence at SEQ ID NO. 44030
agacccttgcccgtctccctccttccctgccatctccggcttcgacttcgaccccgcgacgcctttagcagcaagtggggcggcggccgtcgccgagatgagcacctccccgatcaccggtgccgatctctcgcgaaacctccccctccccgtgctctggtagacagagatccgggctctcctcggtttgttttgtgagggcatcatgtggagttttgcatcaaatgccatagctggaagcttaaagaaaaaggcgcagccttcaaaatgcagcacatccaatccagactgttctgatgatgaggtttcttcatgtacaagcagagaggaaggccttgattgtccaatatgctgggaatccttcaaccttgtggagaatgttccctatgtcttgtggtgtggccacacaatgtgcaagaactgtatccttggtcttcactgggctgttgtcaagtttccttcccttcctatccagctgccactgttcatctcatgcccctggtgcaatctgttgtctttccggctggtgtacaaaggcaacctcaggttcccacgcaagaattactttctgctctggatggttgagagcatgaatggtgagagagcaaaattccattccactaatcacaatgaatatcattcctcatggcattccagtgctggcccaagttccagtcatcaccaccaaagaaatgctgttatccga

SEQ ID NO: 44030 - protein, 166 aa, Panicum virgatum
  misc_feature: Ceres CLONE 2019143
  misc_feature: Functional homolog of the protein sequence given in SEQ ID NO 50848
  misc_feature: Useful for making plants with altered protein content
  misc_feature: Functional homolog of the protein sequence given in SEQ ID NO 50849
  misc_feature: Useful for biocontainment applications
  misc_feature: Useful for making plants with altered alkaloid content
MWSFASNAIAGSLKKKAQPSKCSTSNPDCSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGERAKFHSTNHNEYHSSWHSSAGPSSSHHHQRNAVI

SEQ ID NO: 44031 - DNA, 618 bp, Panicum virgatum
  misc_feature: Ceres CLONE 2019172
  misc_feature: Encodes the peptide sequence at SEQ ID NO. 44032
gggcccgcgtggccaaagttatcctgtgctttctactgttacccgagttatcctgtgtcatgatctacctgtgtttggtgtctgtttcgtgttcgttgttgcccatctgtgtttttgatcgcaagctccgtcgtgctgttgtctgtcagagctatcttgatctccatcccatgaacttgggtgttgggattggaagctgttatcttgctgtaacttgttaccgtttcagttaatcaaatggaaaaaaaaggtgctacttggtgctgcaaaaaaaagtgctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcaccatcaccgt

SEQ ID NO: 44032 - protein, 80 aa, Panicum virgatum
  misc_feature: Ceres CLONE 2019172
  misc_feature (10)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSPYGEVLESKIILDRETQRSRGFGFVTFSSEQAMRDAIEGMNGKELDGRTIT

SEQ ID NO: 44033 - DNA, 725 bp, Panicum virgatum
  misc_feature: Ceres CLONE 2019173
  misc_feature: Encodes the peptide sequence at SEQ ID NO. 44034
atccctgataacgagctcgagctgacgaagttagcatcgaccatgtccaagccgaggttggacggcaaggtggccatcgtcaccggcggcgcgagcggcatcggcgaggcggcggcgcggctgttcgcgtcgagcggcgccacggtggtgatcgcggacatccaggacgcgctgggcgaggcggtggccgcgtcggccgggtgcacgtacatgccgtgcgacatcccggacgaggcgcaggtggaggcgacggtgggcgacgtggtggccgcgcacgggcggctggacgtcatgctcagcaacgccggcgtgctgctcccgacggggtccgtgatggacatggacctggcggagctggaccgcgtgatggccgtcaacttccgcggcgccgcggcgtgcgtgaagcacgcggcgcgtgccatggtgtcgccgaacggcgcccgtggcggcgccatcgtgtgcacggcgagcgtggcgtcgctccagggcgggtttgggccggcgtcgtacacggcgtccaagcacgcggtgctgggcctggtgcgcgccgcggcgggggagctcgggcgccacggcgtgcgcgtcaactgcgtgtcccccagcggcggggccacgcccatgagctgcgcgctcatgggcatcggggcagaggagctggaggccatgacggtgccgggcaacgtgctgcaagggaaggtgctgcgggcggaggacgtggcggaggc

SEQ ID NO: 44034 - protein, 227 aa, Panicum virgatum
  misc_feature: Ceres CLONE 2019173
  misc_feature (9)..(175): Pfam Name: adh_short Pfam Description: short chain dehydrogenase
  misc_feature: SWISSPROT Homolog: EC 1.1.1.288 Xanthoxin dehydrogenase
  misc_feature: Functional homolog of the protein sequence given in SEQ ID NO 50917
  misc_feature: Useful for making plants with modulated biomass
MSKPRLDGKVAIVTGGASGIGEAAARLFASSGATVVIADIQDALGEAVAASAGCTYMPCDIPDEAQVEATVGDVVAAHGRLDVMLSNAGVLLPTGSVMDMDLAELDRVMAVNFRGAAACVKHAARAMVSPNGARGGAIVCTASVASLQGGFGPASYTASKHAVLGLVRAAAGELGRHGVRVNCVSPSGGATPMSCALMGIGAEELEAMTVPGNVLQGKVLRAEDVAE

SEQ ID NO: 44035 - DNA, 713 bp, Panicum virgatum
  misc_feature: Ceres CLONE 2019175
  misc_feature: Encodes the peptide sequence at SEQ ID NO. 44036
gccatctgacccgacgttccactgcaaaagcggaaccaccaccgcctcctctccatcactttccacttccctccccccagagcagagcacacactcgcagcatccactctcaggctgccatccgatccaacaatgggctccgcctcaggtgacgatggtgctctccgggagcacctgctgctggacgtggacggcgcggcggcgcccaagatacgggtgcgcgggctgcgccgcctggcggacggggcggcgggcgacgagatcctgcggggcgtcgacctggacgtcccgcgcggcgtcgtcatgggcgtcatcgggcccagcggcagcggcaagtccacgctcctccgcgcgctcaaccgcctctgggagcccgcccccggcgccgtgctcctcgacggcgccgacatccgcggcgtcgacgtcctcgcgctccgacgcaaggtcggcatgctcttccagctccccgccatgttcgaaggaaccgtggccgacaacgtgcgctacgggccgcagctgcgcgggaagaagctcacagaagctgaagtgaagagtctgctgagcatggcggacctggaccctgctctgtcctccaagccggcctccgagctgtccgtcggccaggcgcagcgcgtcgccttggcacgcatcctcgccaacgaccccgaggtgctcctgctggacgagccgacgagcgcactggaccccatctc

SEQ ID NO: 44036 - protein, 193 aa, Panicum virgatum
  misc_feature: Ceres CLONE 2019175
  misc_feature (55)..(193): Pfam Name: ABC_tran Pfam Description: ABC transporter
  misc_feature: SWISSPROT Homolog: EC 3.6.3.27 Phosphate-transporting ATPase
MGSASGDDGALREHLLLDVDGAAAPKIRVRGLRRLADGAAGDEILRGVDLDVPRGVVMGVIGPSGSGKSTLLRALNRLWEPAPGAVLLDGADIRGVDVLALRRKVGMLFQLPAMFEGTVADNVRYGPQLRGKKLTEAEVKSLLSMADLDPALSSKPASELSVGQAQRVALARILANDPEVLLLDEPTSALDPI

SEQ ID NO: 44037 - DNA, 661 bp, Panicum virgatum
  misc_feature: Ceres CLONE 2019187
  misc_feature: Encodes the peptide sequence at SEQ ID NO. 44038
ctgtttccatctcgcaccaagttctcactctcaacaagctctctctctttcacgagcagcagtctcgagatccagcaggagatcggccacctctgcagtgagggtgcacggcggctgctgctagtgtccgcggcgtgatgggcgacgacggcgcgacgaaggcggcggcggcgacgggcctgaagcagatcgcgcggctgcgggagctgctgcacaggtggcagcaggccatggcgctggggggcagcaagccgccgcgggacggggaggagggccacgacggcggcggggcgccggacgatcaggagctggtggcgtcggcgatcccgccgttcgtgctgcagcggctgcggcggacggagacggtggactcgctgctgtcggacgacgagagctgccacagcccggagccgccgccggacgtgccccgcgggtactgccccgtgtacgtggggcccgagcaacggcggttcgtgatcccgaccggctacctggcgcaccccgtgttccggctcctgctggacaaggccgaggaggagttcgggttccggcacgagggcgcgctcgccatcccctgcgagaccgaggctttcaagtacatcctccagtgcgtcgagcgccacgataatggcctcgccgccgacgcccaagttgcagaagc

SEQ ID NO: 44038 - protein, 174 aa, Panicum virgatum
  misc_feature: Ceres CLONE 2019187
  misc_feature (67)..(160): Pfam Name: Auxin_inducible Pfam Description: Auxin responsive protein
MGDDGATKAAAATGLKQIARLRELLHRWQQAMALGGSKPPRDGEEGHDGGGAPDDQELVASAIPPFVLQRLRRTETVDSLLSDDESCHSPEPPPDVPRGYCPVYVGPEQRRFVIPTGYLAHPVFRLLLDKAEEEFGFRHEGALAIPCETEAFKYILQCVERHDNGLAADAQVAE

SEQ ID NO: 44039 - DNA, 690 bp, Panicum virgatum
  misc_feature: Ceres CLONE 2019194
  misc_feature: Encodes the peptide sequence at SEQ ID NO. 44040
caacaatgactacttggagatctgccgttgctacaaggcaatctatgatattccagctataaaagaggatccagcaaagtggataccgattcttaggaaaatctgttggtatttagtgttggcacctcatgatcctatgcaatcgagccttctcaatgctactctagaggataaaaacctttctgagatcccaaatttcagattattgttgaagcagctggttaccatggaggtaatccagtggacaagtttatgggatttcttcaaagctgaatatgagaatgagaaaaatctccctggaggagctttgggtgacaaagctgcaggagatttgaagctgaggataattgaacataatatcttggttgtctccaagtattattcaaggattaccctcaagaggcttgcggatctcctttgcctaagtttgcaggaggcagagaagcatctttcagacatggtgaattcaaaatctctgattgcaaagatcgacaggccaatgggagttgtgagcttccgtacagctcaagacagcaatggggtactcaactcctgggccacaaaccttgagaagcttctcgaccttgttgagaaaagttgccatcaaatacacaaggagacaatgatccataaggccgttttgaaagcttagatttggctcgtggctctaggttcccttcatagtctccc

SEQ ID NO: 44040 - protein, 216 aa, Panicum virgatum
  misc_feature: Ceres CLONE 2019194
  misc_feature (64)..(174): Pfam Name: PCI Pfam Description: PCI domain
NNDYLEICRCYKAIYDIPAIKEDPAKWIPILRKICWYLVLAPHDPMQSSLLNATLEDKNLSEIPNFRLLLKQLVTMEVIQWTSLWDFFKAEYENEKNLPGGALGDKAAGDLKLRIIEHNILVVSKYYSRITLKRLADLLCLSLQEAEKHLSDMVNSKSLIAKIDRPMGVVSFRTAQDSNGVLNSWATNLEKLLDLVEKSCHQIHKETMIHKAVLKA

SEQ ID NO: 44041 - DNA, 660 bp, Panicum virgatum
  misc_feature: Ceres CLONE 2019198
  misc_feature: Encodes the peptide sequence at SEQ ID NO. 44042
gcagatcgatcgagcaccccaaacttgcacacaatcaccatcagttctagtagacaagacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgacaaacgtaccgcctgcatgctggatcaaagctgctagctagcgcctacaccctttgatgttccttcctgattgcccttactagtttagcttttagctaagctacaccagaaaagggaagacccagagatcaaataattgaagctcatcaaatagtatggggaatggagctagctgctgtctagaataaaactgatggaatgcatgaataaacaatgtattatgcatttgagtaaatgttcttctccatcttgat

SEQ ID NO: 44042 - protein, 71 aa, Panicum virgatum; identical to SEQ ID NO: 19463
  misc_feature: Ceres CLONE 2019198
  misc_feature (12)..(71): Pfam Name: potato_inhibit Pfam Description: Potato inhibitor I family

SEQ ID NO: 44043 - DNA, 667 bp, Panicum virgatum
  misc_feature: Ceres CLONE 2019208
  misc_feature: Encodes the peptide sequence at SEQ ID NO. 44044
taccaatttcttcaacactggtgactggtctaccaccgtggccactagcctttgcaggtgcagcccagtcctcccatggcgaccggcgactcgagtgttcaagtaggccccgtcccgttcaaggacgtcgaggacgacggcgacatggtcaccgccctgccggagagaccctcggaagagcacgtcggcctggtctccgccctgccatgctgtacggtcaccgggatgtccaacatgaagctccgctgctaccaggggttctggctgcgggagggcttggtcccggcggccgccgccctccagcgccgcttcgagccccgccccagcgacgtcatcgtggccagcctgcccaagtgcggcaccacgtggctcgtcgccctggcgttcgccacgctggcgcgccgcgcgtacccgcccggcgccgccgaccacccgctccgccgcctcaacccgcaccagtgcctcccgttcctggaggtgctgttcgccggcggccgggagggcaagctcgacgcgctcccgtccccgcgcctcatgaacacgcacatgccgctcgccatgatcccgggagccgtgccggccggcggcggctgcaaggtcgtgtacatctgcagggagcccaaggacatggtcgtctccctgtggcactacctccggcgagtgcacc

SEQ ID NO: 44044 - protein, 197 aa, Panicum virgatum
  misc_feature: Ceres CLONE 2019208
  misc_feature: SWISSPROT Homolog: EC 2.8.2.1 Aryl sulfotransferase
MATGDSSVQVGPVPFKDVEDDGDMVTALPERPSEEHVGLVSALPCCTVTGMSNMKLRCYQGFWLREGLVPAAAALQRRFEPRPSDVIVASLPKCGTTWLVALAFATLARRAYPPGAADHPLRRLNPHQCLPFLEVLFAGGREGKLDALPSPRLMNTHMPLAMIPGAVPAGGGCKVVYICREPKDMVVSLWHYLRRVH

SEQ ID NO: 44045 - DNA, 732 bp, Panicum virgatum
  misc_feature: Ceres CLONE 2019223
  misc_feature: Encodes the peptide sequence at SEQ ID NO. 44046
attgggaaggttacagaatctggtgaagattttagtgttaaactgatgcatactgagaaagggatggtagagaaggtagttctttcagcaaatgatgatgggatgaactttgcaactgttactctaagacagtctcgctcgccatgtgtcggagacaagtttgccagcatgcatgggcagaaaggagtggtaggccttttggattctcaggagaacttcccatttactcgccaagggatagttccggatattgtcataaacccacatggctttccaactcgtcaaactcctggtcagttgcttgaagctgctttggggaaggggattgccttgggtgggaaggtgagatacgcgacaccattcaccactccttctgtggatgtgatcactgaacagttacacaaggctggtttttcaaggtggggtggggagagcgtcctgaatgggcacactggtgagcggatgaagtcgctggtcttcatcggcccgactttctaccagcggctgacccacatgtccgaggacaaggtgaagttccgcaacacggggcctgtgcacccgctcacgcggcagccggtggaggacaagaagcggtttggtggcgtcaagttcggggagatggagcgagactgcctcctcggccacggcgctgcttccagcctccatgagcgcctgttcatgctaagcgatttctcgcagatgcacatctgccaggcctacgagcgcgtggcc

SEQ ID NO: 44046 - protein, 243 aa, Panicum virgatum
  misc_feature: Ceres CLONE 2019223
  misc_feature (2)..(198): Pfam Name: RNA_pol_Rpb2_6 Pfam Description: RNA polymerase Rpb2, domain 6
  misc_feature (200)..(243): Pfam Name: RNA_pol_Rpb2_7 Pfam Description: RNA polymerase Rpb2, domain 7
  misc_feature: SWISSPROT Homolog: EC 2.7.7.6 DNA-directed RNA polymerase
IGKVTESGEDFSVKLMHTEKGMVEKVVLSANDDGMNFATVTLRQSRSPCVGDKFASMHGQKGVVGLLDSQENFPFTRQGIVPDIVINPHGFPTRQTPGQLLEAALGKGIALGGKVRYATPFTTPSVDVITEQLHKAGFSRWGGESVLNGHTGERMKSLVFIGPTFYQRLTHMSEDKVKFRNTGPVHPLTRQPVEDKKRFGGVKFGEMERDCLLGHGAASSLHERLFMLSDFSQMHICQAYERV

SEQ ID NO: 44047 - DNA, 735 bp, Panicum virgatum
  misc_feature: Ceres CLONE 2019247
  misc_feature: Encodes the peptide sequence at SEQ ID NO. 44048
ctcatgcttgccttctaagcactactcctagttaattagctagtcgtatctctcatctcctcctcccttcttgaggctctgatctatacagtagtcaacagcagtataaactgtgtagtagactgttgtgtagaggtagctatagagcaatccaacagctagcccatctgagctgagcagtcaccattgtttatcgccatgatgagcgcgactagcagactgcctaatcttccagccgggttccggttccaccccacagatgaggagctcatcgttcactacctcatgaaccaagcttcctccatcccatgccctgtccccatcatcgccgaggtcaacatctaccagtgcaacccatgggatcttcctgccaaagctttgtttggagagaacgagtggttcttcttcagcccgagggatcgcaagtaccccaacggcgcccgcccaaaccgtgccgccggatccggctactggaaggccaccggcaccgacaaggctatcctgttgactccgacgagcgagaacatcggagtcaagaaggcccttgtgttctacggcggtaagcctcccaagggggtcaagacagactggatcatgcacgagtaccgcctcacaggagccaacaacaacaccaagcgtagaggatcctccatgagggtgggataaatttcccaatattcgttttctcaattacttgatatatatatatatatatatatatatatatatatatta

SEQ ID NO: 44048 - protein, 155 aa, Panicum virgatum
  misc_feature: Ceres CLONE 2019247
  misc_feature (11)..(139): Pfam Name: NAM Pfam Description: No apical meristem (NAM) protein
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 851 in the 10/374,780 US patent application
  misc_feature: The sequence is a functional homolog of SEQ ID NO 854 in the 10/374,780 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 1012 in the 11/435,388 US patent application
  misc_feature: The sequence is a functional homolog of SEQ ID NO 853 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 891 in the 10/374,780 US patent application
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50906
  misc_feature: Useful for making plants with modulated water use efficiency
  misc_feature: The sequence is a functional homolog of SEQ ID NO 852 in the 10/374,780 US patent application
  misc_feature: Functional homolog of the protein sequence given in SEQ ID NO 50324
  misc_feature: Useful for making plants with altered terpenoid content
  misc_feature: Functional homolog of the protein sequence given in SEQ ID NO 50326
  misc_feature: Useful for making plants with modulated light quality response
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 612 in the 11/435,388 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 476 in the 10/666,642 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: Functional homolog of the protein sequence given in SEQ ID NO 50732
  misc_feature: Useful for biocontainment applications
  misc_feature: Useful for making plants with modulated biomass
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 745 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
MMSATSRLPNLPAGFRFHPTDEELIVHYLMNQASSIPCPVPIIAEVNIYQCNPWDLPAKALFGENEWFFFSPRDRKYPNGARPNRAAGSGYWKATGTDKAILLTPTSENIGVKKALVFYGGKPPKGVKTDWIMHEYRLTGANNNTKRRGSSMRVG

SEQ ID NO: 44049 - DNA, 579 bp, Panicum virgatum
  misc_feature: Ceres CLONE 2019252
  misc_feature: Encodes the peptide sequence at SEQ ID NO. 44050
aatctttcttgctctcgacacgcgacgaccgccgcgtcgccggacgtgggaagaacgcggcgccggcgccggcgacgaattcaacgaatactaaaccatgggggtccggatccggctggcgcgcttcgggtgccggaaccggcctttctaccgcgtgatggccccccacggccgctccccgctcgacggcaagcacctccaggtcctcggctcctcccccccgctcccccggcacgatggtggtccgaggattggtctgatattcgaccagctgaggtcttgtgtctcacttggtgcccttccatctgatcctgttcagcatattctgtgttcttggctagacttcttcctccacctaccctgctcgcgctggctcgccaggatgggccccatgattggctccccatccttcccatgaacggcaaactcttggatcttgagggcgtcacagtacttgatgactccaatgctcctggatgcgatgctgaataacctgcgaatgaggtggcttcataactcttttgctttagcatgtgaagatgatgctagattttgtatctgagcctatgcgttgatgct

SEQ ID NO: 44050 - protein, 106 aa, Panicum virgatum
  misc_feature: Ceres CLONE 2019252
  misc_feature (9)..(70): Pfam Name: Ribosomal_S16 Pfam Description: Ribosomal protein S16
MGVRIRLARFGCRNRPFYRVMAPHGRSPLDGKHLQVLGSSPPLPRHDGGPRIGLIFDQLRSCVSLGALPSDPVQHILCSWLDFFLHLPCSRWLARMGPMIGSPSFP

SEQ ID NO: 44051 - DNA, 636 bp, Panicum virgatum
  misc_feature: Ceres CLONE 2019263
  misc_feature: Encodes the peptide sequence at SEQ ID NO. 44052
aatccctcttccccaatctctcgcgtctcgccctcctgcctcccctgtacgccgcagctagaaagctagggtttcgcctgcgatccgatccgtcgagttcaccctccccacccagatcgatggcggccgagggcgataagaagatgatcaccctcaagagctcggacggcgaggagttcgaggtggaggaggcggtcgccatggagtcgcagaccatccgtcacatgatcgaggacgactgcgccgacaacggcatcccgctccccaacgtcaactccaagatcctctccaaggtcatcgagtactgcaacaagcacgtccacgccgcggccgcagcggccgcggcgtccaaggccggctccgacgacgcgggggcagccgccgccaacagcaacgctgcctccggtgaagaccttaagaactgggacgccgacttcgtcaaggtcgatcaggccacgctgttcgacctcatcttggctgcaaactatctcaacatcaaggggctgctggacctgacgtgccagactgttgctgacatgatcaagggcaagactcctgaggagatccgcaagaccttcaacatcaagaacgacttcacccctgaggaggaagaggagatccgcagagagaaccagt

SEQ ID NO: 44052 - protein, 172 aa, Panicum virgatum
  misc_feature: Ceres CLONE 2019263
  misc_feature (99)..(171): Pfam Name: Skp1 Pfam Description: Skp1 family, dimerisation domain
  misc_feature (8)..(68): Pfam Name: Skp1_POZ Pfam Description: Skp1 family, tetramerisation domain
MAAEGDKKMITLKSSDGEEFEVEEAVAMESQTIRHMIEDDCADNGIPLPNVNSKILSKVIEYCNKHVHAAAAAAAASKAGSDDAGAAAANSNAASGEDLKNWDADFVKVDQATLFDLILAANYLNIKGLLDLTCQTVADMIKGKTPEEIRKTFNIKNDFTPEEEEEIRRENQ

SEQ ID NO: 44053 - DNA, 734 bp, Panicum virgatum
  misc_feature: Ceres CLONE 2019272
  misc_feature: Encodes the peptide sequence at SEQ ID NO. 44054
atccctgagctctagaggtcgctcgtcttcttcctcaatcctcctcgtgtggttaagagtgagagagcgagctagagcgccgcgaaaatgccgatcaacaggatcgccgtcgggagccaccaggaggtgacccacccgggtgccctcaaggcggcgttcgctgagttcatctccaccctcatcttcgtcttcgccggccagggctctggcatggccttcagcaagctgagcagcggcggcgcgacgactcccgccggcctgatctccgcggcgatagcgcacgccttcgccctattcgtggcggtgtccgtgggcgccaacatctccggcggccacgtgaacccggccgtgaccttcggcgcgttcgtgggcggcaacatcaccctgttccgtggcctcctctactggatcgcccagctgctggggtccaccgtggcgtgcttcctcctccgcttctccaccggcgggctcgccacgggcaccttcggtgtcaccggcgtctccgtgtgggaggcgctcgtgctcgagatcgtcatgaccttcggcctcgtctacaccgtgtacgccaccgccgtcgaccccaagaagggcagcttgggaaccattgctcccatcgccattggcttcattgttggagctaacatccttgttggtgggcccttctccggcgcctccatgaaccccgccgtggctttcggcccgtcgctcgtcagctgggtctggggttaccagtg

SEQ ID NO: 44054 - protein, 215 aa, Panicum virgatum
  misc_feature: Ceres CLONE 2019272
  misc_feature (13)..(214): Pfam Name: MIP Pfam Description: Major intrinsic protein
MPINRIAVGSHQEVTHPGALKAAFAEFISTLIFVFAGQGSGMAFSKLSSGGATTPAGLISAAIAHAFALFVAVSVGANISGGHVNPAVTFGAFVGGNITLFRGLLYWIAQLLGSTVACFLLRFSTGGLATGTFGVTGVSVWEALVLEIVMTFGLVYTVYATAVDPKKGSLGTIAPIAIGFIVGANILVGGPFSGASMNPAVAFGPSLVSWVWGYQ

SEQ ID NO: 44055 - DNA, 689 bp, Panicum virgatum
  misc_feature: Ceres CLONE 2019278
  misc_feature: Encodes the peptide sequence at SEQ ID NO. 44056
ggatttgttcgtcgctgactcgccggcgtccaagatgaggccggtgttcgtgggaaaccttgactatgacacccgccactcggagctcgaccacctcttctaccgctacggcaggatcgagcgcatcgacatgaagtcaggatttgctttcgtttactttgaggatgagcgtgatggtgatgatgccatacgggctcttgatggttatccctttggccctggcagacgcaggctttcagtggagtggtcaaggggtgatcgagctgctagacgtgatggtgataaaccagcagcaaacactaagcccactaagacgttgtttgtcatcaactttgacccaatcaacacaagagtcagtgatattgaaaggcactttgcaccatttgggaatatatcaaatgttcggataaggaggaactttgcttttgtccggtttggaacaatggaagaagccagaaaagctcttgaagctactcatgctaccacccttttggatagagtgatttctgtggagtatgcctttagggatgatggtgaaacaagtgatagatatgacagccctagaagagacggctatggtaggcgtggggatagcccatatcgccgttctattagcccagtgtaccggtcacgacctagtcctgactatggtcgcccaccaaggtcacgacctagtcctgactatggtc

SEQ ID NO: 44056 - protein, 218 aa, Panicum virgatum
  misc_feature: Ceres CLONE 2019278
  misc_feature (4)..(69): Pfam Name: RRM_1 Pfam Description: RNA recognition motif. (a.k.a. RRM, RBD, or RNP domain)
  misc_feature (95)..(159): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50813
  misc_feature: Useful for making plants with modulated biomass
MRPVFVGNLDYDTRHSELDHLFYRYGRIERIDMKSGFAFVYFEDERDGDDAIRALDGYPFGPGRRRLSVEWSRGDRAARRDGDKPAANTKPTKTLFVINFDPINTRVSDIERHFAPFGNISNVRIRRNFAFVRFGTMEEARKALEATHATTLLDRVISVEYAFRDDGETSDRYDSPRRDGYGRRGDSPYRRSISPVYRSRPSPDYGRPPRSRPSPDYG

SEQ ID NO: 44057 - DNA, 681 bp, Panicum virgatum
  misc_feature: Ceres CLONE 2019282
  misc_feature: Encodes the peptide sequence at SEQ ID NO. 44058
ggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggagtactaccagaccagagatcaccacagctcctgcagtcctgcatcggctccgctccgctcacctcaccggcctagggtttttgccgcggctcatctcgcccgctccgccatggccgccgctcacgagtgctccgccgccgccgccggcgaggccccgaccaccggggagcaccggatggggactaccatcgtcggggtctgctacgacggcggcgtcatcctcggcgccgactccaggaccagcactggaatgtatgtggcaaaccgtgcttcagacaagattactcaactgacggacaatgtgtatgtctgccgctctggatctgctgctgatacacaagtcatttcagactatgtacgttatttccttcaccaccaca

SEQ ID NO: 44058 - protein, 90 aa, Panicum virgatum
  misc_feature: Ceres CLONE 2019282
  misc_feature: SWISSPROT Homolog: EC 3.4.25.1 Proteasome endopeptidase complex
MAAAHECSAAAAGEAPTTGEHRMGTTIVGVCYDGGVILGADSRTSTGMYVANRASDKITQLTDNVYVCRSGSAADTQVISDYVRYFLHHH

SEQ ID NO: 44059 - DNA, 633 bp, Panicum virgatum
  misc_feature: Ceres CLONE 2019286
  misc_feature: Encodes the peptide sequence at SEQ ID NO. 44060
ctgggtcatctatgcttctcagctcactgccaagccaaggctgctggagccagtgtaccttgtggagatccaggctcctgagaatgctcttggtggtatctatggtgttctgaaccagaagagagggcacgtgtttgaggagatgcagaggccgggtaccccgctctacaacatcaaggcttacctccctgtcatcgagtcctttgggttctccagccaactgagggctgcaacctctggtcaggcgttccctcagtgtgtgtttgaccactgggacatgatgggctctgatcctttggaggctggctcccaggctgctcagctggtgttggacatccgcaagaggaagggtctcaaggaacagatgaccccgctttctgagtttgaggacaagctctaaattttttggccttctgtggtactgataccccctgctggtttaatggtccatctgtctactgtaatgggaactactttcgaatttcattttgtttagtggtcatatgcttctgtttccaaacatgattagtcaaatggtagtgtcgtgccaaagactattttggtatccgtcttgatggaacagatgaaacagttggtatctgtgtgtttaagtggtgatatttgcggtacgac

SEQ ID NO: 44060 - protein, 132 aa, Panicum virgatum
  misc_feature: Ceres CLONE 2019286
  misc_feature (13)..(101): Pfam Name: EFG_C Pfam Description: Elongation factor G C-terminus
WVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 44061 - DNA, 306 bp, Panicum virgatum
  misc_feature: Ceres CLONE 2019287
  misc_feature: Encodes the peptide sequence at SEQ ID NO. 44062
gagaccagaatgcggctgcctccggcactagagccttgagagcagaggagcgcgtcccttggagcgcgatggcgagaatggcgctggtggtggcgctggcggtggtggcggcggacggcgccctctccggcggcgcgcgtgcgcagctggttgtaggggttctactcactacgttgaccgcaggccgttaaaatcctcaaggagtgcctggtacagcacgtcctccatgtgctctccatcgatctccaccctcctccgcacccacttccacgactgcttcgtcacgtgatgcgacacgtcgctgct

SEQ ID NO: 44062 - protein, 40 aa, Panicum virgatum
  misc_feature: Ceres CLONE 2019287
  misc_feature: Functional homolog of the protein sequence given in SEQ ID NO 51688
  misc_feature: Useful for making plants with altered carbohydrate content
MARMALVVALAVVAADGALSGGARAQLVVGVLLTTLTAGR

SEQ ID NO: 44063 - DNA, 698 bp, Panicum virgatum
  misc_feature: Ceres CLONE 2019295
  misc_feature: Encodes the peptide sequence at SEQ ID NO. 44064
tcatcttgtctctcctctgtccatttgagtcaagctgtcgctgcggctgcggcggcggcggcggctctacccagatcggcggcggcagggccctcttgcaggtagatcgggcgggcggcggcaatggggcacccgtacgcgccggcggacctggagctgccgagcttcgtaccgctgcatctatcgcagggcccgatcctcgtgacctacatcggcgcctccctcttcgtcctcctcgccatctggctcatctccggaaaatgtggcagattatccaagaccgaccgtctgctcatgtgctggtgggcattcacagggttaacccacatactgatagagggtcccttcgtcttcacccctaacttcttcaagaaggagaaccccaatttctttgatgaactttggaaagagtacagcaagggggactctaggtacgttgctagggacaccgcaactgttacggttgaagggattactgcggtattggaaggccctgcatcactgcttgctgtctacgctattgcatcccagaagtcctacagccatattcttcagttcactgtctgcttgggtcagctctatggatgcttggtatacttcattactgcctacttggatggcttcaatttctgggccagtcccttctacttctgggcatacttcattggtgcgaatagttcgtgggttgtgataccaac

SEQ ID NO: 44064 - protein, 191 aa, Panicum virgatum
  misc_feature: Ceres CLONE 2019295
  misc_feature (17)..(191): Pfam Name: EBP Pfam Description: Emopamil binding protein
  misc_feature: SWISSPROT Homolog: EC 5.3.3.5 Cholestenol Delta-isomerase
  misc_feature: Functional homolog of the protein sequence given in SEQ ID NO 51237
  misc_feature: Useful for making plants with altered sterol content
  misc_feature: Useful for making plants with modulated nitrogen use efficiency
MGHPYAPADLELPSFVPLHLSQGPILVTYIGASLFVLLAIWLISGKCGRLSKTDRLLMCWWAFTGLTHILIEGPFVFTPNFFKKENPNFFDELWKEYSKGDSRYVARDTATVTVEGITAVLEGPASLLAVYAIASQKSYSHILQFTVCLGQLYGCLVYFITAYLDGFNFWASPFYFWAYFIGANSSWVVIP

SEQ ID NO: 44065 - DNA, 628 bp, Panicum virgatum
  misc_feature: Ceres CLONE 2019296
  misc_feature: Encodes the peptide sequence at SEQ ID NO. 44066
gacctccaggctcccaaagtttcgccgttctcttccttctctttttcctcagccgcctcgccctcgctccccctgtgtgcagcaaaaccttgccgcgaatcgccgacgcgaagccccaacccagaggagccgacgagctgggcgctaggcggccatgggtgacagccagtactccttctccctcaccaccttcagcccttcaggaaagttggtgcagatcgagcacgcgctcacggcggtcggatccggccagacctcgctcgggatcaaagctgccaatggtgtagtcatcgccactgagaagaaactgccttctatccaagtggatgaaacatctgtgcaaaagattcagtcactgacaccaaatattggagttgtttacagtggtatgggtccagatttccgtgttctggtgagaaaaagccgaaagcaggcgcaacagtattatcggttgtacaaggaacatatacctgttactcagcttgtacgtgagactgctgctgttatgcaggagttcacgcaatcaggtggtgttagaccatttggagtatccctgttgatcgctgggtatgatgacaatggcccgcagctgtatcaggttgacccctcaggatcatacttctcctgg

SEQ ID NO: 44066 - protein, 157 aa, Panicum virgatum
  misc_feature: Ceres CLONE 2019296
  misc_feature (29)..(156): Pfam Name: Proteasome Pfam Description: Proteasome A-type and B-type
  misc_feature: SWISSPROT Homolog: EC 3.4.25.1 Proteasome endopeptidase complex
MGDSQYSFSLTTFSPSGKLVQIEHALTAVGSGQTSLGIKAANGVVIATEKKLPSIQVDETSVQKIQSLTPNIGVVYSGMGPDFRVLVRKSRKQAQQYYRLYKEHIPVTQLVRETAAVMQEFTQSGGVRPFGVSLLIAGYDDNGPQLYQVDPSGSYFS

SEQ ID NO: 44067 - DNA, 691 bp, Panicum virgatum
  misc_feature: Ceres CLONE 2019298
  misc_feature: Encodes the peptide sequence at SEQ ID NO. 44068
ggggatgctgcgggtggtgggctcgtcgttgccccgctgcagacttcgtccgcttctcccacgcgcgatctctccaacgctctcgcgccgccgcgctctcctcctcctcctctcctcctcctccggcttcggggccccttcctgctgtcgcggctcttcccttgcgcactcctactcctccatgtccatggcggcgccgccggtggcgaagaaggtgccgcgtgagctcgtcgaccacggcgacgtccgcgtcgacaactactactggctccgcgacgactcccgatccgaccccgacgtcctcgcgcacctccgcgccgagaacgactacactaccgccgtcatgtccgatgtcaagcaactcgaggatgaaatatatgctgaaatcagaggaagaattaaggaggatgatatagatgcacctcttcgcaaagggcagtactactactatgaaaggacattggctggcaaggagtatgcacaacactgtaggcgccttgtaccacccgatgctccaattacagtccacgacgtgatgcccacaggacctgatgctcctgttgagcatattattctggatgagaatgtcaaggctgagggccatgattactacagcattggtgctttcaaggtcagtcccaacaataagctagtggcttatgcagaagacactaaaggcgatgaaatttac

SEQ ID NO: 44068 - protein, 169 aa, Panicum virgatum
  misc_feature: Ceres CLONE 2019298
  misc_feature: SWISSPROT Homolog: EC 3.4.21.83 Oligopeptidase B
MSMAAPPVAKKVPRELVDHGDVRVDNYYWLRDDSRSDPDVLAHLRAENDYTTAVMSDVKQLEDEIYAEIRGRIKEDDIDAPLRKGQYYYYERTLAGKEYAQHCRRLVPPDAPITVHDVMPTGPDAPVEHIILDENVKAEGHDYYSIGAFKVSPNNKLVAYAEDTKGDEI

SEQ ID NO: 44069 - DNA, 239 bp, Panicum virgatum
  misc_feature: Ceres CLONE 2019298-R
  misc_feature: Encodes the peptide sequence at SEQ ID NO. 44070
acctgctattggagagacaattggacaacttcagggaggtcggacgattgattttattgatccaacatatgctgtggaccctgaggagtcacagtttcattccactgttcttcgatttcattatagctcaatgaggaccccaccctctgtttacgactatgatatggattcaggggagtctgtgctgaagaagattaaacccgttttaggtggatatgatgcatcgaattttgtagggg

SEQ ID NO: 44070 - protein, 79 aa, Panicum virgatum
  misc_feature: Ceres CLONE 2019298-R
  misc_feature: SWISSPROT Homolog: EC 3.4.21.83 Oligopeptidase B
PAIGETIGQLQGGRTIDFIDPTYAVDPEESQFHSTVLRFHYSSMRTPPSVYDYDMDSGESVLKKIKPVLGGYDASNFVG

SEQ ID NO: 44071 - DNA, 707 bp, Panicum virgatum
  misc_feature: Ceres CLONE 2019301
  misc_feature: Encodes the peptide sequence at SEQ ID NO. 44072
acaatcccacggctccatctgtctcggcaggtagagatcaatcagtcacctggagcagagaaaatggcgtcgtgcggcgaagagcaggtggcggcactgcgcgtgatcggcgggtgggcgtgctactacgccatccgcgtgtacgtggcgctgaggctcaagggggtcgagtacgagttcctgcaggaggtggtcggcaacaagagcgagctgctgctcaggtccaacccagtgtacaagaagatccccgtgctcctccaccacggcaagcccatcgccgagtccgtgatcatactccagtacatcgacgaggtttgggcgtccgacggggcgccggccatccttccggcggatccgtacgcccgtgctgtccagcggttttgggcacagtacatggacgacaagattgcccctgcttctgttgtcttgagaggagcgaccaacggagacaaagacgaagcagcagcgcaggtgtctactgccctacagcatttggaggaggccttcgtgaagtgcagccaagggaagagctatttcggcggcgacaacatcggcttccttgacatcgttctcggatcacaactgggttggctcaaggcagcggagaagatcgctggcgtcaaagtcctcgacgagtccaagctccctgagctgacagcatgggcggagcgcttctgtgctcacacgccgtcagagacgtcatgcca

SEQ ID NO: 44072 - protein, 214 aa, Panicum virgatum
  misc_feature: Ceres CLONE 2019301
  misc_feature (10)..(83): Pfam Name: GST_N Pfam Description: Glutathione S-transferase, N-terminal domain
  misc_feature (106)..(208): Pfam Name: GST_C Pfam Description: Glutathione S-transferase, C-terminal domain
  misc_feature: SWISSPROT Homolog: EC 2.5.1.18 Glutathione transferase
  misc_feature: Functional homolog of the protein sequence given in SEQ ID NO 51078
  misc_feature: Useful for making plants with modulated biomass
MASCGEEQVAALRVIGGWACYYAIRVYVALRLKGVEYEFLQEVVGNKSELLLRSNPVYKKIPVLLHHGKPIAESVIILQYIDEVWASDGAPAILPADPYARAVQRFWAQYMDDKIAPASVVLRGATNGDKDEAAAQVSTALQHLEEAFVKCSQGKSYFGGDNIGFLDIVLGSQLGWLKAAEKIAGVKVLDESKLPELTAWAERFCAHTPSETSC

SEQ ID NO: 44073 - DNA, 684 bp, Panicum virgatum
  misc_feature: Ceres CLONE 2019320
  misc_feature: Encodes the peptide sequence at SEQ ID NO. 44074
accactatcatcccaatctttctcctcccgcatcgcacccacctcccctacccgaaaaacccccaaattgcaatcaggtcccaggcgggctcctccccaaatccgcaacccagctcgacgaaattggtgaattcctcgagggagcctgacggatcgggcggcgaggatgggcatctcgagcatgccgacgcccaaggacagcctgatggggttcgtgctgtacaacacggcggtgtcggtggcgatcctggcggggctggtgcgcgcggcgctggtgttcctgggcctggcggcgccgtcgccgtgggagggcctcgccgccgacgagcaccaccaccaccaccaccgccaggtggtgtcgtcgatctcgcccctggggccgagcctcgcggaccggttccggagccggttccgcccgtcgcggttcgggcgccggcgcggcggcgccggcgccggcgcggactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctccgcctccttccccccgccgccgacgacgactacgcggccgtggcagcgggcctggccgcccggttttaggagagatctccagg

SEQ ID NO: 44074 - protein, 167 aa, Panicum virgatum
  misc_feature: Ceres CLONE 2019320
  misc_feature (100)..(141): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MGISSMPTPKDSLMGFVLYNTAVSVAILAGLVRAALVFLGLAAPSPWEGLAADEHHHHHHRQVVSSISPLGPSLADRFRSRFRPSRFGRRRGGAGAGADCRVCLARFEPESVVNRLPCGHLFHRACLETWLDYDHATCPLCRLRLRLLPPAADDDYAAVAAGLAARF

SEQ ID NO: 44075 - DNA, 658 bp, Panicum virgatum
  misc_feature: Ceres CLONE 2019342
  misc_feature: Encodes the peptide sequence at SEQ ID NO. 44076
ctcaagagctctggctttatttccaacactttctataatctcgagcatgagtactgtgagagctacgcggaaagcggctatgtgaagcgaacctactgtgttggtccgctttcactacccttgccaccaccagcaagagcaggtactggccgctcagcttgcttggattggctggacacaaagcctgcccactccgttgtgtacttgtgcttcggcagcctgacaaacttttctgatgttcaacttaatgagctagccctcggactggaagcctctggtgtgccattcttgtgggttgttagggttaaaacatgggagccaccggtagggtgggaagaccgtgttggggatagaggcatggttgtcatgggttgggccccacaaaccgatatactccagcacccagcactgggggcatttgtgacccaatgcgggtggaactccatcctggagacaattgcggttggcgtgcctgtcttgacatggccaaaggtgtacgagcagttcatcactgagaggtttgtgacccatgtgttgcaaatcggggagcgcttgtggccggagggtgctgggcggcgtagcacgaggagtgcagagcatgaagtgatccctgctaaagaaattgcgcaatctgttgccaagttcatggaacatggag

SEQ ID NO: 44076 - protein, 219 aa, Panicum virgatum
  misc_feature: Ceres CLONE 2019342
  misc_feature: SWISSPROT Homolog: EC 2.4.1.238 Anthocyanin 3'-O-beta-glucosyltransferase
  misc_feature: Functional homolog of the protein sequence given in SEQ ID NO 51247
  misc_feature: Useful for making plants with altered carbohydrate content
LKSSGFISNTFYNLEHEYCESYAESGYVKRTYCVGPLSLPLPPPARAGTGRSACLDWLDTKPAHSVVYLCFGSLTNFSDVQLNELALGLEASGVPFLWVVRVKTWEPPVGWEDRVGDRGMVVMGWAPQTDILQHPALGAFVTQCGWNSILETIAVGVPVLTWPKVYEQFITERFVTHVLQIGERLWPEGAGRRSTRSAEHEVIPAKEIAQSVAKFMEHG

SEQ ID NO: 44077 - DNA, 957 bp, Panicum virgatum
  misc_feature: Ceres CLONE 2019344
  misc_feature: Encodes the peptide sequence at SEQ ID NO. 44078
ttcaaactctcttgcaaccttgcattggttagcaataacaacagagagatatggcaagagagatggtggagaaggcaaggaaggccacatcccctaataagagcactacgataaacaccggtaccaagagcccagtaaggaatggaggaggatctccaccccataagaagaacgctgctgagtcacgaggacggaaaaatgaagtgcaaagtgttcggaaaggaggccaagaccagatgtcacatgacgagggcaaacgccgttctccaactgcacaaacgtcacccaagaggtcaccaagacttgagcagccactgagctactttcggcttcacactgaagagagagccatcaggcgagccggattcaattatcaggtagcaagcaagataaacacacaggaaatcattaggaggttcgaagagaagttggcacaggtgatggaggaacgagagataaagatgatgaggaaggagatggttcccaaggcacaactgatgccagcgtttgacaagccattccacccacaaaggtcgacgaggcctctgacggtcccgaaggagcccagtttcctgaagctgaaatgctgcatcggtggggagttccatcggcatttttgctacaacggcaaggccatcaagtagcatgcacatcacatcgcatgcaaatatgcaatgcatatacacctgcgcctactaaaaggctacagccacgagatgaactgttttttttgccgttcagttacttcgcataatgaatgaaccctacatgcagaatagagatgattgcctctgtaaatttcttttattttgctttctcttctttttgttgttttttttttcctccttttttgccctgatgaaagaagactaggtaggaaaccaggtaaagagctcatcaggatgcatgcatctgccatgtatgtccgatggcagcagtattaataaaagcttgcat

SEQ ID NO: 44078 - protein, 197 aa, Panicum virgatum
  misc_feature: Ceres CLONE 2019344
  misc_feature (94)..(150): Pfam Name: TPX2 Pfam Description: Targeting protein for Xklp2 (TPX2)
MAREMVEKARKATSPNKSTTINTGTKSPVRNGGGSPPHKKNAAESRGRKNEVQSVRKGGQDQMSHDEGKRRSPTAQTSPKRSPRLEQPLSYFRLHTEERAIRRAGFNYQVASKINTQEIIRRFEEKLAQVMEEREIKMMRKEMVPKAQLMPAFDKPFHPQRSTRPLTVPKEPSFLKLKCCIGGEFHRHFCYNGKAIK

SEQ ID NO: 44079 - DNA, 640 bp, Panicum virgatum
  misc_feature: Ceres CLONE 2019346
  misc_feature: Encodes the peptide sequence at SEQ ID NO. 44080
actgagctatacacaacaccacagctgcaggaaatcgccaattggaaaggatggagacctcgatcgccttcgtgctgctgttctctctcctcgccgtctcgtccgtggcggagaagttcgatttcttctaccttgttcaacagtggccggggtcgttctgtgacacgcggcagggctgctgcttcccggacacgggcaagccggcggcggagttcggcatccacgggctgtggcccaactacgccaagtgcggccgcggccgcggggaggagctcgccagcgccgtgctcggcgaagacgacgtcgccttcttctccggcgccgtggggcggcggggcaagtgctggcccgagttctgcgacgacggcaacgcgctgagcctgtgggaggtccgggacctggtggcgtccctgaaccggaactggccgacgctgtcgtgcaagagcgggcgcagcttcgagttctggagctacgagtggaagaagcacggcacctgctccaacctcgcgcagcacgactacttcgcgcgcgcgctcgcgatcaaggcggcgtacaacctcaccgcgatcctcgccggcgccgggatcgtgccgtcggacacggcgacctactcgctgagcagcgtgagggacgccatcgc

SEQ ID NO: 44080 - protein, 196 aa, Panicum virgatum
  misc_feature: Ceres CLONE 2019346
  misc_feature (23)..(196): Pfam Name: Ribonuclease_T2 Pfam Description: Ribonuclease T2 family
  misc_feature: SWISSPROT Homolog: EC 3.1.27.1 Ribonuclease T(2)
METSIAFVLLFSLLAVSSVAEKFDFFYLVQQWPGSFCDTRQGCCFPDTGKPAAEFGIHGLWPNYAKCGRGRGEELASAVLGEDDVAFFSGAVGRRGKCWPEFCDDGNALSLWEVRDLVASLNRNWPTLSCKSGRSFEFWSYEWKKHGTCSNLAQHDYFARALAIKAAYNLTAILAGAGIVPSDTATYSLSSVRDAI

SEQ ID NO: 44081 - DNA, 854 bp, Panicum virgatum
  misc_feature: Ceres CLONE 2019355
  misc_feature: Encodes the peptide sequence at SEQ ID NO. 44082
gcgagcgcgtcgaccacggccagcggggagtggtcgcagagggcggggaagagctagcccctgccccgcgtaccagatctcgcgtttccacggggattcccgttattttttttccttgctcccctgtttcgcgattgaaattcgagcgggttggccattcgatgtcttgctgacctaatccggcgcgctctgatttgattgcaggttgcctaatcaaaaggagcatggcctcgcttgcaagtccatcttcctcagtcgccgccgccctcacccgtcaaccgacgcggttcttgaaagggtgcagtgtctccaaggagacaaagggctcggtttgcaacctcttcactccaaattcaaataatgccaaagtaaaatcagtgggctcgagaatatcatcatccttgaaaagggatggtggctatccagccgctggtgcctctgggaatggcgacgtgctattggcaagaagtacttccgtacgtggccaggaccattcggttgctgaccctgtactctcgacggattccatggttgcgccagaaatcctctctgctaatctggcacgtgttgtggacaagtttgcagatgaagacacagacactgaacttgatttggatagcccgacagagggctttgcatctattgcagatgccattgaggacatacggcaaggaaaacttgtgattgttgttgatgacgagtcaagggaaaatgaaggagaccttataatggctgcttccttggttacctcagaggctatggcttttatagtaaggcatgggactggaattgtgtgtgtcagcatgaaagaagaagatctggaaagactggaccttccattgatggttaagggg

SEQ ID NO: 44082 - protein, 209 aa, Panicum virgatum
  misc_feature: Ceres CLONE 2019355
  misc_feature (140)..(209): Pfam Name: DHBP_synthase Pfam Description: 3,4-dihydroxy-2-butanone 4-phosphate synthase
  misc_feature: SWISSPROT Homolog: EC 4.1.99.12
MASLASPSSSVAAALTRQPTRFLKGCSVSKETKGSVCNLFTPNSNNAKVKSVGSRISSSLKRDGGYPAAGASGNGDVLLARSTSVRGQDHSVADPVLSTDSMVAPEILSANLARVVDKFADEDTDTELDLDSPTEGFASIADAIEDIRQGKLVIVVDDESRENEGDLIMAASLVTSEAMAFIVRHGTGIVCVSMKEEDLERLDLPLMVK

SEQ ID NO: 44083 - DNA, 663 bp, Panicum virgatum
  misc_feature: Ceres CLONE 2019362
  misc_feature: Encodes the peptide sequence at SEQ ID NO. 44084
attccttgcttcttctgtttcgcaggtttatcgaaggtgagagccgtagagatcctcacgccggcggccaaggggtgatcacaggttgccctcctcgtccagcttcgacaaagaaaggatacgagagacaagggagaacgacgcgacatggctgatttctccaaggaatcatgtccttctgtgaagaatattttgcttctggattctgaagggaaacgtgttgctgtgaagtatttctcggatgattggcctagtaatgcatcaaagttggcctatgaaaaatctgtctttactaaaacactaaagacaaatgcacgcacagaagctgagataactctatttgatggttatattgttgtttacaaatttgtacatgaccttcactttttcgtcactgccggtgatgatgagaatgagctcattatagcaaatgtactgcaaggttttgctgattctgttggtcttctactcaggggtgatgttgagaagcggactgcactcgagaacttggatttgatacttctctgcattgatgaaattgtagatggcggcataatcctggaaacagatgcacacaacattgccggaaaggtagcgaccaatgctgttgacggttctgtccccttctcagagcagacgatatctcaggctctagctacagct

SEQ ID NO: 44084 - protein, 171 aa, Panicum virgatum
  misc_feature: Ceres CLONE 2019362
  misc_feature (11)..(154): Pfam Name: Clat_adaptor_s Pfam Description: Clathrin adaptor complex small chain
MADFSKESCPSVKNILLLDSEGKRVAVKYFSDDWPSNASKLAYEKSVFTKTLKTNARTEAEITLFDGYIVVYKFVHDLHFFVTAGDDENELIIANVLQGFADSVGLLLRGDVEKRTALENLDLILLCIDEIVDGGIILETDAHNIAGKVATNAVDGSVPFSEQTISQALAT

SEQ ID NO: 44085 - DNA, 709 bp, Panicum virgatum
  misc_feature: Ceres CLONE 2019366
  misc_feature: Encodes the peptide sequence at SEQ ID NO. 44086
acgccagggcccgagctccgtgctagggtttcctctcccgccgccgccggtggaggaggagctgagcgagtagcgccgggaggggaccatggggacgccggagacgtcgcgcgagccgtgcccggaccggatcctggacgacgtgggcggcgcgttcgggatgggcgccgtcggcggctccgtcttccacttcctcaagggcgcctacaactcccccaacgggatgcgcctgtcgggcggcgcgcaggccgtgcgcatgaacgcgccgcgggtggggggcagcttcgccgtctggggcggcctcttctccaccttcgactgcgccatggtctacgcgaggcagaaggaggacccctggaactccatcgtcgccggcgccgccacgggcgggttcctctccatgcgccagggcgcgggggccgcggggcggtcggcgctcatgggcgggatcctcctggccctcatcgagggcgccggcctcatgctcaaccgcgtcctggtaaacccgccgctgcccgccgaggatcctaacctcatgggccccggagggttcccgggcctcccgcaggcgccgctggtcgtggcgcctcctgaggccgcgagctccagcggtgcggctggctggttcgggggcctgttcggcaagaaggaggagaataaggacaactcgagcgggggcaagtcggagatcctggagagcttcgacacg

SEQ ID NO: 44086 - protein, 206 aa, Panicum virgatum
  misc_feature: Ceres CLONE 2019366
  misc_feature (4)..(133): Pfam Name: Tim17 Pfam Description: Tim17/Tim22/Tim23 family
MGTPETSREPCPDRILDDVGGAFGMGAVGGSVFHFLKGAYNSPNGMRLSGGAQAVRMNAPRVGGSFAVWGGLFSTFDCAMVYARQKEDPWNSIVAGAATGGFLSMRQGAGAAGRSALMGGILLALIEGAGLMLNRVLVNPPLPAEDPNLMGPGGFPGLPQAPLVVAPPEAASSSGAAGWFGGLFGKKEENKDNSSGGKSEILESFD

SEQ ID NO: 44087 - DNA, 692 bp, Panicum virgatum
  misc_feature: Ceres CLONE 2019368
  misc_feature: Encodes the peptide sequence at SEQ ID NO. 44088
aacgaatcgtcctcctctcaccaccgctctctccggcgctttcgctttctcccgtcttctctagccttcgcctcgctgcctctcgccgcagattgttccttgcgatcctagagctctagccatggctgggagagggaaggcgatcggctcgggtgccgccaagaaggccatgtccaggagctccaaggccgggctccagttccccgtcggcaggatcgctaggttcctcaaggccggcaagtacgccgagagggtcggcgccggcgcccccgtctacctcgccgccgtactcgagtacctcgcagctgaggttcttgagctggctggaaacgccgcgagggacaacaagaagacccgtatcgtgccgcgccacatccagctggccgtccgcaacgacgaggagctctcccgcctgctgggcacggtgaccatcgccagcggcggtgtcatgcccaacatccacaaccttctgctccccaagaaggccggtggcggcagcgccaaggccgcggccggcgacgaggactagatctttgactacaccgtccttgcggtggttgtgcttcttgtggatgccgcagtatcacttgtgcctgtgtagtagtgtgttctagactcgcctaggtgttgccttctggtagggtggttgtgtgtgtggctgtaccgatgcttaactagtttactgttttgct

SEQ ID NO: 44088 - protein, 135 aa, Panicum virgatum
  misc_feature: Ceres CLONE 2019368
  misc_feature (19)..(92): Pfam Name: Histone Pfam Description: Core histone H2A/H2B/H3/H4
MAGRGKAIGSGAAKKAMSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGSAKAAAGDED

SEQ ID NO: 44089 - DNA, 671 bp, Panicum virgatum
  misc_feature: Ceres CLONE 2019372
  misc_feature: Encodes the peptide sequence at SEQ ID NO. 44090
ttcccagcgcatcaggagaaaaaattcgtctcttcttccccgcagtccggattcccaaccaggttccagagaaaccccccgtccgattcgcgagatggcggagcagcccaacccccagccccaagtggatgagaaggaggtggtggtggagcagcagcaggaggagacgaagagggcccccaagctgaggtacctggatttcgtccatgtggcggcggcgcaggccgcggtgtgcctcgcggggctctacgggctcgccaagggccacgccggcccgctccgccccggcgtcgacgccgtcgagtccgcggtgaagggcctcgtcggccccgtctacgaccgcttccacagcgtgcccctcgacgtcctcgccttcgtcgaccgcaaggtggacgacaccgtgcccgggctggacaagcacctccctggcgcgttgaaggccgcgtcggcgcaggcctacgcggtggcccgcgagctggccgccgaggcgcagcagtccggcgtgaagagcgcggcccgcgcggcgctggccaaggtggagcccgtggccaaggacgtgtacgggtgcgttgagccggtggccagggacctgtacgtgcgctacgagcccgcggcggagcacctcgccgtctccacctggcgctcgctcaacggcctcccggtgttcccgc

SEQ ID NO: 44090 - protein, 192 aa, Panicum virgatum
  misc_feature: Ceres CLONE 2019372
  misc_feature (19)..(192): Pfam Name: REF Pfam Description: Rubber elongation factor protein (REF)
MAEQPNPQPQVDEKEVVVEQQQEETKRAPKLRYLDFVHVAAAQAAVCLAGLYGLAKGHAGPLRPGVDAVESAVKGLVGPVYDRFHSVPLDVLAFVDRKVDDTVPGLDKHLPGALKAASAQAYAVARELAAEAQQSGVKSAARAALAKVEPVAKDVYGCVEPVARDLYVRYEPAAEHLAVSTWRSLNGLPVFP

SEQ ID NO: 44091 - DNA, 751 bp, Panicum virgatum
  misc_feature: Ceres CLONE 2019388
  misc_feature: Encodes the peptide sequence at SEQ ID NO. 44092
ccaaatatagtccagttccttggagcagtcacagaaaccaagcctctaatgctagttaccgagtttctacgaggaggtgatcttcatcaatatctgaaggagaaaggtgcactcagcccacttgctgctattaattttgcactagacattgcaagaggaatggcatatcttcataatgagcctaatgttgtgattcaccgagacttaaaaccaagaaacattcttctggtgaattctgctgccaaccatttgaaagttggagattttggtcttagcaagatcatcaaagctcagcatgccagtgatgtatacaagatgactggagaaacgggaagctaccgctacatggcccctgaagttttcaagcaccggaaatatgacaagaaagttgatatcttctcttttgccatgatactatatgagatgctggaaggcgatccacctttctccaactacgaaccttatgaggctgctaagtatgttgcagaagggcatcgcccagctttccgtaaaggacatactaatgaactgaaggatttggttgagctatgttggtctggggatatcagtctgagaccatctttcttggagatcctcaagaggcttgagaagctcaaggagcatttttcacacgagaaccactggcatttgttccagtagcagtgcatatatattcattactaaaggtggtattctgaatgggttttcttgggagatctgacatggatgaatgtacaaaattaggtgcctc

SEQ ID NO: 44092 - protein, 219 aa, Panicum virgatum
  misc_feature: Ceres CLONE 2019388
  misc_feature (1)..(202): Pfam Name: Pkinase Pfam Description: Protein kinase domain
  misc_feature: SWISSPROT Homolog: EC 2.7.11.1 Non-specific serine/threonine protein kinase
PNIVQFLGAVTETKPLMLVTEFLRGGDLHQYLKEKGALSPLAAINFALDIARGMAYLHNEPNVVIHRDLKPRNILLVNSAANHLKVGDFGLSKIIKAQHASDVYKMTGETGSYRYMAPEVFKHRKYDKKVDIFSFAMILYEMLEGDPPFSNYEPYEAAKYVAEGHRPAFRKGHTNELKDLVELCWSGDISLRPSFLEILKRLEKLKEHFSHENHWHLFQ

SEQ ID NO: 44093 - DNA, 675 bp, Panicum virgatum
  misc_feature: Ceres CLONE 2019410
  misc_feature: Encodes the peptide sequence at SEQ ID NO. 44094
gcaatcgaaccaaaatcatttcgcccatggaaccaaaggatccttattacctgccaacattgttcggtaactctttcgggtttctcaatcgtcctctcgttcctctttctcctgagatatctgatgctcctgatgtttatgttattggcattccttttgatcttggttgtactggacgatcaggaactcgttctggtccaacagctattcgacaagcttcttccaacctccgttgggaacaaagcaaatatccccatcgacacaatgtctttcatcgcttatccgtagtcgattgtggcgacatccagattggtgcaggagaaagcaaacaatccataaatcagattcaatcaacagttcaacttctcctaaacaaatccgctggatcaaaaaagaagagagtgctcagttttggtggagaccatctcgttgctcttccgatcctcaaagcttattctgccttctatggagaaccaatcgcaatgatccatttcgatgcgcacacagatacttacaaaccaacagatggaatgatgtacgatcatgggacaatgttcttcaaagaaagaatggatggagttctttcctttgaacagtcagtccagatcgggatccgaacagagtgggattatgatgatcatccttataccgtaattacctctgatgaagtttggg

SEQ ID NO: 44094 - protein, 216 aa, Panicum virgatum
  misc_feature: Ceres CLONE 2019410
  misc_feature (33)..(215): Pfam Name: Arginase Pfam Description: Arginase family
  misc_feature: SWISSPROT Homolog: EC 3.5.3.11 Agmatinase
MEPKDPYYLPTLFGNSFGFLNRPLVPLSPEISDAPDVYVIGIPFDLGCTGRSGTRSGPTAIRQASSNLRWEQSKYPHRHNVFHRLSVVDCGDIQIGAGESKQSINQIQSTVQLLLNKSAGSKKKRVLSFGGDHLVALPILKAYSAFYGEPIAMIHFDAHTDTYKPTDGMMYDHGTMFFKERMDGVLSFEQSVQIGIRTEWDYDDHPYTVITSDEVW

SEQ ID NO: 44095 - DNA, 680 bp, Panicum virgatum
  misc_feature: Ceres CLONE 2019412
  misc_feature: Encodes the peptide sequence at SEQ ID NO. 44096
agagagagagaggccatgtcggcggcggcgcagcagcagagggcggcggcgggggcgggggcggagcagcaggaggaggtggagcacgggcccttccccatcgagcatctacaggcatctggaatagctgcactggatgtgaaaaagctcaaagattctggtctccacactgtggaggctgtggcttacactccaaggaaagaccttctgcaaatcaaaggaataagtgaagctaaagttgacaagatagttgaagcagcatcgaagatagttccacttgggtttacaagtgccagccaacttcatgcacaacggctggagattattcaagttacaactggatcaagagagcttgacaagatcttggaggggggggtagaaacaggatctatcacagagatatatggtgagttccgctctggaaagactcagttgtgtcacaccctttgtgttacatgtcagcttccattggatcaaggtggtggtgaaggaaaggctctatacattgatgcagagggcacattcagaccacaaaggctcttgcagatcgctgacaggtttggactgaatggtgctgatgtcttagagaatgtggcttatgccagagcttataatacggatcatcaatctagacttcttctggaagcagcttccatgatgatagagaccaggtttgctct

SEQ ID NO: 44096 - protein, 221 aa, Panicum virgatum
  misc_feature: Ceres CLONE 2019412
  misc_feature (82)..(221): Pfam Name: Rad51 Pfam Description: Rad51
MSAAAQQQRAAAGAGAEQQEEVEHGPFPIEHLQASGIAALDVKKLKDSGLHTVEAVAYTPRKDLLQIKGISEAKVDKIVEAASKIVPLGFTSASQLHAQRLEIIQVTTGSRELDKILEGGVETGSITEIYGEFRSGKTQLCHTLCVTCQLPLDQGGGEGKALYIDAEGTFRPQRLLQIADRFGLNGADVLENVAYARAYNTDHQSRLLLEAASMMIETRFA

SEQ ID NO: 44097 - DNA, 728 bp, Panicum virgatum
  misc_feature: Ceres CLONE 2019413
  misc_feature: Encodes the peptide sequence at SEQ ID NO. 44098
ctacagccaaggatacacactgcagcagtagcagcacttgggataggaatactacccattgattgacatcgttgatcatggctccagcatcagctgcaacaaaatgcagcagcggcatcgctctgctcttgctcctagcgctaatggcggccggcacttcgtgggcgcagctgtccaccagcttctactcctcctcgtgccccggtgtgtacgacgccgtcaagtcggtgatgaaatccgccatcgccactgagcagcgcatgggcgcctccaccgtccgcctcttcttccacgactgcttcgtccaaggctgcgacgcgtcgctgctgctggatgacacggccagcttccagggcgagaagatggcgacaccaaacaacggctccgtgagaggcttcgaggtcatcgacaccatcaagactgccgtcgagaaggtctgccccggcgtcgtctcctgcgccgacatcctcgccatcgcagccagggacagcgtcgtcatcctgggtgggccaaactgggacgtgaaggtcgggcggcgggactccacgacggcgagcttcagcggtgccaacaacaacatcccgccgccgacgtcgggcctcgccaacctcacgtcgctgttcgccgcgcaaggcctctcccaaaaggacatggtcgcgctttctggagctcacaccattggccaagcacgttgcaccaacttcagagctcatgtatacaatgacact

SEQ ID NO: 44098 - protein, 216 aa, Panicum virgatum
  misc_feature: Ceres CLONE 2019413
  misc_feature (48)..(216): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 50828
  misc_feature: Useful for making plants with altered carbohydrate content
MAPASAATKCSSGIALLLLLALMAAGTSWAQLSTSFYSSSCPGVYDAVKSVMKSAIATEQRMGASTVRLFFHDCFVQGCDASLLLDDTASFQGEKMATPNNGSVRGFEVIDTIKTAVEKVCPGVVSCADILAIAARDSVVILGGPNWDVKVGRRDSTTASFSGANNNIPPPTSGLANLTSLFAAQGLSQKDMVALSGAHTIGQARCTNFRAHVYND

SEQ ID NO: 44099 - DNA, 697 bp, Panicum virgatum
  misc_feature: Ceres CLONE 2019415
  misc_feature: Encodes the peptide sequence at SEQ ID NO. 44100
aacttcagcaggaaatcttgatgagaacctgtctggtaaaaagtttgcaagctatactgtgttcaagggaaaggctgcactttctattcatcctatactgccaagtttcagcaaaatggaatctggaggatctcggatgaacagaaatggatcagtaatgttgaccttctttcctgctgttggacaaaggaagtatgactatacaaagaaacagctttttgctctgtcacctactgaagttggaagcttgataagtcttgggcctgctgaatcctgtgagtttttccatgatccatccatgaaatcaagtcatgaaggacaggtgaaaaaatcgctgtcgattactccccttggcagtgacagtggatacttcgttaatataaccgttctgaacaacatgcagaagactactgatcgtctttcagtccctatcacaaaagctgagtttgcggtgatgcgcacagcactgagttttgcgttgccacacatcatgggctgggatcaggtgctgacgcaccatccagctcccccagctagcagcaagcccagggtggagcgtccacacccggattctgaatgggaaaggtgaaacctccttttagcagctaatatggaggattttgggcatcactagagaattgctgctgcaaagtttggaacatgggtgtgtgatgactgtatctccttcctgatcaat

SEQ ID NO: 44100 - protein, 195 aa, Panicum virgatum
  misc_feature: Ceres CLONE 2019415
  misc_feature (19)..(157): Pfam Name: Whirly Pfam Description: Whirly transcription factor
TSAGNLDENLSGKKFASYTVFKGKAALSIHPILPSFSKMESGGSRMNRNGSVMLTFFPAVGQRKYDYTKKQLFALSPTEVGSLISLGPAESCEFFHDPSMKSSHEGQVKKSLSITPLGSDSGYFVNITVLNNMQKTTDRLSVPITKAEFAVMRTALSFALPHIMGWDQVLTHHPAPPASSKPRVERPHPDSEWER

SEQ ID NO: 44101 - DNA, 643 bp, Panicum virgatum
  misc_feature: Ceres CLONE 2019418
  misc_feature: Encodes the peptide sequence at SEQ ID NO. 44102
aacatcaatagcaagatcaaaggttgagctgttccaacaaaaggatttgcagtatttgtagcgaattagctaggtagccagcggccatggtgttgctgttgccatctgcttctaggcaccatactcccatgccgctggtggtggcgttgctgctggtgctaatggcaatggaagctcggccgggagtggcgtcgttgctgtacgaccaggtcgagatcacctggggcggcgaccgcagcttcttctacatggagcgcgagggcgtcgacgtcctcgcgctctgcctcgagaagaccaacggcggctccgggttcgcctccaaggacacctacctctacggccgcttcgacatcgacatcatgctcgtcgccaacaactccgccggtacggtcgccaccttctacctgatgccggacggcgaggtgccgtgggcgtaccacgacgagatcgacctggaattcctcggcaacgccaccggcgagccgtacacgctccacaccaacatcttcgccaacggcgccggcggccgcgagcagcagttccggctctggttcgaccccaccaccgacttccacacctactccatcgagtggaaccccaagcacatcataatcgtagtggacggcacgccggtccgcgcgtt

SEQ ID NO: 44102 - protein, 185 aa, Panicum virgatum
  misc_feature: Ceres CLONE 2019418
  misc_feature (38)..(185): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50386
  misc_feature: Useful for making plants with altered carbohydrate content
  misc_feature: Functional homolog of the protein sequence given in SEQ ID NO 50385
  misc_feature: Useful for making plants with altered cell wall content and/or composition
MVLLLPSASRHHTPMPLVVALLLVLMAMEARPGVASLLYDQVEITWGGDRSFFYMEREGVDVLALCLEKTNGGSGFASKDTYLYGRFDIDIMLVANNSAGTVATFYLMPDGEVPWAYHDEIDLEFLGNATGEPYTLHTNIFANGAGGREQQFRLWFDPTTDFHTYSIEWNPKHIIIVVDGTPVRA

SEQ ID NO: 44103 - DNA, 614 bp, Panicum virgatum
  misc_feature: Ceres CLONE 2019430
  misc_feature: Encodes the peptide sequence at SEQ ID NO. 44104
ccgccgccgccgccgccgcagctgtcgctcaaaccgtcgcatctccgcagggttcgcaaagatggcggtgcctctgctaacgcagaagatcgtgaagaagcgggtcaagcagttcaagaggccccatctcgaccgctacaaatgcctcaagccaagctggcgcaggcccaagggtattgactcccgcgtcaggcggaagttcaagggatgcaccttgatgcccaacattggatacggctctgacaagaagacaaggcactacctccccaacaaattcaagaagtttcttgttcacaatgtctctgagctggagctgcttatgatgcacaacaggacgtactgcgcggagattgcccacaacgtctccacccgcaagcgcaaggagattgttgagcgtgctgcacagctggacatcgtggtcaccaacaagcttgccaggctacgtagccaggaggatgagtgaaatattcagtagtcgcagttgcgttgttcttagaacagtaccggagttggagatactcttccaccatttttatgcttatgttagacatgttcttttgctatgagtgtactagtgatggctaataccatctagttttgatctgacatcatga

SEQ ID NO: 44104 - protein, 133 aa, Panicum virgatum
  misc_feature: Ceres CLONE 2019430
  misc_feature (14)..(123): Pfam Name: Ribosomal_L32e Pfam Description: Ribosomal protein L32
MAVPLLTQKIVKKRVKQFKRPHLDRYKCLKPSWRRPKGIDSRVRRKFKGCTLMPNIGYGSDKKTRHYLPNKFKKFLVHNVSELELLMMHNRTYCAEIAHNVSTRKRKEIVERAAQLDIVVTNKLARLRSQEDE

SEQ ID NO: 44105 - DNA, 762 bp, Panicum virgatum
  misc_feature: Ceres CLONE 2019437
  misc_feature: Encodes the peptide sequence at SEQ ID NO. 44106
attctccccgttccctctcgcgcgcgcgaaggccaaggccggatcgggagggccctctcagatctcgcgcgcttcgccggccgcgcagcaacccagggagtaggagctagggggatcggggcgaggatgtttagcgggacgcagcagaagtgcaaggtgtgcaccaagacggtgtacccgatggaccagctgtccaccgacggcgtcgtcttccaccgctcctgcttcaagtgccagcactgcaagtccaccctctccctgagcagctattcctcgttcgaaggagtgccatactgcaaggcccatttcgagcagctgttcaaggagacagggagctacaacaagagcttccaatcacaatcacccgcaaagattactccagaaaagtcggcacctgagctgaccagaacaccaagcaaagctgcaaggatgttttcaggaacacaagacaagtgtgcaacttgtggcaaaaccgcatatcctcttgagaaggtaacagttgaagaaaaggcctaccacaagtcctgcttcaaatgctcccatgggggctgtgccatcacaccatccaactatgcagccttggaggggatcctctactgcaggcaccatttctctcaacttttcaaggagaagggaagctacaaccatctgatcaagtgtgcatcggtcaagcgtacagaagcacaggctgaacaaccagcacagccagctgctgattcttcttgatcttggccatttcaaccgtgggggtttgaaaggcaa

SEQ ID NO: 44106 - protein, 199 aa, Panicum virgatum
  misc_feature: Ceres CLONE 2019437
  misc_feature (110)..(166): Pfam Name: LIM Pfam Description: LIM domain
  misc_feature (9)..(65): Pfam Name: LIM Pfam Description: LIM domain
  misc_feature: Functional homolog of the protein sequence given in SEQ ID NO 50127
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Functional homolog of the protein sequence given in SEQ ID NO 50126
  misc_feature: Useful for making plants with altered carbohydrate content
MFSGTQQKCKVCTKTVYPMDQLSTDGVVFHRSCFKCQHCKSTLSLSSYSSFEGVPYCKAHFEQLFKETGSYNKSFQSQSPAKITPEKSAPELTRTPSKAARMFSGTQDKCATCGKTAYPLEKVTVEEKAYHKSCFKCSHGGCAITPSNYAALEGILYCRHHFSQLFKEKGSYNHLIKCASVKRTEAQAEQPAQPAADSS

SEQ ID NO: 44107 - DNA, 696 bp, Panicum virgatum
  misc_feature: Ceres CLONE 2019441
  misc_feature: Encodes the peptide sequence at SEQ ID NO. 44108
agttccctcacctagctacaagcctacaagccatggaagctacagcccaacgagacaaggaagcaatcgcaacccatgcccatgcagccaccacatcttcctcctcttcgtcctccacatcctcctcctcctgcctcatcaatggcgtgccaaaagaggttcccaagagctccaaaactacgaacaagcggaagcgagcctcttcgccggactcccaggaattagaagccaatggcagtaccggccaccaaggcgaggagagcagcagctgctgcagcaccgacgataacgtggtggcaagcggcggcaacaagtcccaggcggcggcggccggcggtgccgggtcgtccggcagccggagcgggtacaagcacccgtcgtaccgcggcgtgcggcgccggagctggggcaagtgggtgtccgagatccgggagccccgtaagaagtcgcgcatctggctgggcaccttccccacggctgagatggcggcgcgcgcgcacgacgtggccgcgctcgccatcaagggccgtgccgcgcacctcaacttcccggaccgcgcccacgagctgccccgcccggcgtccacctcccccgccgacatccaggccgcggcggcccaggccgccgccgccgccgaggtgcagtgcgacgcgccgccgtctccgtcgtcgtcgtctgccgagctgccgccctccc

SEQ ID NO: 44108 - protein, 221 aa, Panicum virgatum
  misc_feature: Ceres CLONE 2019441
  misc_feature (115)..(166): Pfam Name: AP2 Pfam Description: AP2 domain
  misc_feature: Functional homolog of the protein sequence given in SEQ ID NO 51287
  misc_feature: Useful for making plants with modulated biomass
  misc_feature: Useful for making plants with modulated flowering time
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 164 in the 11/375,241 US patent application
  misc_feature: The sequence is a functional homolog of SEQ ID NO 2233 in the 10/666,642 US patent application
  misc_feature: The sequence is a functional homolog of SEQ ID NO 96 in the 10/714,887 US patent application
  misc_feature: The sequence is a functional homolog of SEQ ID NO 96 in the 11/435,388 US patent application
MEATAQRDKEAIATHAHAATTSSSSSSSTSSSSCLINGVPKEVPKSSKTTNKRKRASSPDSQELEANGSTGHQGEESSSCCSTDDNVVASGGNKSQAAAAGGAGSSGSRSGYKHPSYRGVRRRSWGKWVSEIREPRKKSRIWLGTFPTAEMAARAHDVAALAIKGRAAHLNFPDRAHELPRPASTSPADIQAAAAQAAAAAEVQCDAPPSPSSSSAELPPS

SEQ ID NO: 44109 - DNA, 689 bp, Panicum virgatum
  misc_feature: Ceres CLONE 2019446
  misc_feature: Encodes the peptide sequence at SEQ ID NO. 44110
agtcgccgatcgatctcgctctagttatactagtatcaagcaaattaagagcctgtacgtatagctcaagtaagtagtgtgttcttcaagaaaatggcaggatataccatggcgttgattcgccatcctctggtggccgttgctgctctagtagtactgcagcagctggcgtcctgctcctccgtgcaggtggcctacagccctaccactccctccgccgccgccggcagcggcggaagcacgccggcgatgcaccacctgcacttctacatgcacgacgggtactccgggccgcacccgacggcggtgctgatcgtgaacggcacgggggcggagctgacgcccggggtgcggttcggcgacacggtggtgatggacgacgcgctgacggaagggcccacccggtcgtcccgggaggtgggacgggcgcagggcgtgtacgtgacggcgtcgcagggcgcgccggcgatgctgctcaccatgaacgtcctgctcacggcctaccaggggtacgagagcggcagctcggtgaccgtggtggggcggaacgacgtgacggcggccgtgcgcgagctcgccgtcgtcggcggcacggggcggttccgcatggccacgggctacgtgctgtggcggacggcgtcctggaagggcaagagcgccgtgctcgagctcgacgtcttcgtccgcgc

SEQ ID NO: 44110 - protein, 198 aa, Panicum virgatum
  misc_feature: Ceres CLONE 2019446
  misc_feature (29)..(197): Pfam Name: Dirigent Pfam Description: Dirigent-like protein
MAGYTMALIRHPLVAVAALVVLQQLASCSSVQVAYSPTTPSAAAGSGGSTPAMHHLHFYMHDGYSGPHPTAVLIVNGTGAELTPGVRFGDTVVMDDALTEGPTRSSREVGRAQGVYVTASQGAPAMLLTMNVLLTAYQGYESGSSVTVVGRNDVTAAVRELAVVGGTGRFRMATGYVLWRTASWKGKSAVLELDVFVR

SEQ ID NO: 44111 - DNA, 636 bp, Panicum virgatum
  misc_feature: Ceres CLONE 2019448
  misc_feature: Encodes the peptide sequence at SEQ ID NO. 44112
aaaagccacaacgttgcgaggggcgagacatgtgcctgcttgggtgatagttttgatccctggtggttggcggtttactcggctgcctgcagtgtggtgattatttgagaagctggaagttggactttttggctccgtcactcagcactgcaaccccgcaacagagcaaatatgctctccattctgcgcaaagccagactcaaggataaggagttgcgcatcttgatgctcggcctcgataatgcgggcaaaaccacgattgtcaaacagataatgggcgaggatgtgaacaccgtcagccccaccctcggcttcatcatcaagacgatcgactacgacgggtataaactcaacatatgggacgtcggcggccaaaagacactccgctcatactggcgcaactactttgagaagacggatgctttgatctgggtggttgatgccactgaccggctgcgtatcgaagactgtagagaggagctacacggcttgcttcaggaggagcgtctttcaggggcaagtctgctggtgtttgccaacaagaccgatgtctcggggtgcatgagtagcgatgaactgctgaagggtctacgactcgatgaaatccggacgcataaatggaatatcctccggtgc

SEQ ID NO: 44112 - protein, 154 aa, Panicum virgatum
  misc_feature: Ceres CLONE 2019448
  misc_feature (1)..(153): Pfam Name: Arf Pfam Description: ADP-ribosylation factor family
MLSILRKARLKDKELRILMLGLDNAGKTTIVKQIMGEDVNTVSPTLGFIIKTIDYDGYKLNIWDVGGQKTLRSYWRNYFEKTDALIWVVDATDRLRIEDCREELHGLLQEERLSGASLLVFANKTDVSGCMSSDELLKGLRLDEIRTHKWNILR

SEQ ID NO: 44113 - DNA, 663 bp, Panicum virgatum
  misc_feature: Ceres CLONE 2019455
  misc_feature: Encodes the peptide sequence at SEQ ID NO. 44114
actattctggttctagggccttcggtcgcagcatctctagccgagacattgacttgagcaaatctcatctacctctcccactccccgcaccgccttttacgcttggatcagcatacccttttgggcagcagcagaagcagcagcagcgcggaccgatcgagatcgatcgaaccattcaaccatcgaggtggagtggcccgagtagtatctagctagctagcaaggcgcgcggcggccggcatgaaggtgcagtgcgacgtgtgcgcggccgaggcggcctccgtcttctgctgcgccgacgaggccgcgctgtgcgacgcgtgcgaccgccgcgtccaccgcgccaacaagctcgccgggaagcaccgccgcttctccctcctccacccctcgccgtcgacgacgacgtcctcgtccgcgcagacgaagccgccgctctgcgacatctgccaggagcggagggggttcttgttctgcaaggaggacagggcgatcctgtgccgggagtgcgacgtgccggtgcacaccgcgagcgagatgacgcggcggcacagccggttcctgctcaccggcgtgcgcctctcgtcggcgccggtggactccaacgccgcgtcagaggaggaggaggaggagaacagcggcagcccctgcaacgccgactcc

SEQ ID NO: 44114 - protein, 140 aa, Panicum virgatum
  misc_feature: Ceres CLONE 2019455
  misc_feature (62)..(109): Pfam Name: zf-B_box Pfam Description: B-box zinc finger
  misc_feature (1)..(47): Pfam Name: zf-B_box Pfam Description: B-box zinc finger
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
  misc_feature: The sequence is a functional homolog of SEQ ID NO 234 in the 10/666,642 US patent application
  misc_feature: The sequence is a functional homolog of SEQ ID NO 288 in the 10/374,780 US patent application
  misc_feature: The sequence is a functional homolog of SEQ ID NO 582 in the 10/225,066 US patent application
  misc_feature: The sequence is a functional homolog of SEQ ID NO 662 in the 11/435,388 US patent application
  misc_feature: The sequence is a functional homolog of SEQ ID NO 906 in the 10/412,699 US patent application
  misc_feature: Functional homolog of the protein sequence given in SEQ ID NO 50993
  misc_feature: Useful for making plants with altered lignin content
  misc_feature: The sequence is a functional homolog of SEQ ID NO 236 in the 10/666,642 US patent application
  misc_feature: The sequence is a functional homolog of SEQ ID NO 908 in the 10/412,699 US patent application
MKVQCDVCAAEAASVFCCADEAALCDACDRRVHRANKLAGKHRRFSLLHPSPSTTTSSSAQTKPPLCDICQERRGFLFCKEDRAILCRECDVPVHTASEMTRRHSRFLLTGVRLSSAPVDSNAASEEEEEENSGSPCNAD

SEQ ID NO: 44115 - DNA, 651 bp, Panicum virgatum
  misc_feature: Ceres CLONE 2019458
  misc_feature: Encodes the peptide sequence at SEQ ID NO. 44116
aacaggaccctttggcaccgcaacccatctcctcccttcgctcccccagcgcccgccgctctccacgcggtcggcccgtgcgccgccctccacgctcccctgcccagctgcagctccagtccggctgctgcggcagcaccctcccttcccacgacttctctgttctttctctcggcctcggtcttcctttcctagcggcgacgaccgggcaagttgcgctgcccgttgttcgtcaagcgacgggcgcttcgccggcggcgaacatccgacacggacagatcagaaataagatcaaggggtgacagggatattgacaatcaacaaatccttcaagcagaagagaaggaggtcgtgtcatctgttgccacagtgttatctgacctctgcggtcctggagaatggatgcccatggcaaaactccatacagagcttcttgaacagtttggcaacgtgtggcaccccagcagggtccgaaagtacctaacaacagatgactggtcaccaacggagacgaagggcaggccttggtttggccttctggccctgctcagaaagtacccagagcattttgtcatcaacacaagatcgaaaggcagagtgacctcggagtttgtttcgctggtctccttgctctcctagagggaacaagaa

SEQ ID NO: 44116 - protein, 78 aa, Panicum virgatum; identical to SEQ ID NO: 14897
  misc_feature: Ceres CLONE 2019458
  misc_feature: Functional homolog of the protein sequence given in SEQ ID NO 50576
  misc_feature: Useful for making plants with altered alkaloid content
  misc_feature: Useful for making plants with altered lignin content

SEQ ID NO: 44117 - DNA, 707 bp, Panicum virgatum
  misc_feature: Ceres CLONE 2019463
  misc_feature: Encodes the peptide sequence at SEQ ID NO. 44118
gaaagcgactccacttcccttccgactccccgctcctctcggctcccgaagacatggcgatgggggctagggtttcctagtgccgccccatccatcgcctcctccgctcagctctccgctccaccctgccggtagatcgagtcttctagtgcgtcagcgcatttggatctctaggcgggcgcgaggagacaaggggcctgggcagcggcgagcagattgacaccctcctccccatcggcgacctccctctttgtcgagcatcagcgagtaggggccgtccccttccgcagcttcactccccaccagggattcgacaccgtccgcgcctccttcctgttctggtgtcagcgtcactgcaacagcaagatcggtgccccgacgtccccatcgacgacctccctcaaccgcacggtctcagcttcgtttccacaacgcttggcctgagaatgcaagaccctaacagcgacgatttctctgccacaaagttgcacaagaagaaggttgtataccggccgcttccatctggcatgctgaagggtgaacctgaactgctgcgtagagagggtccgcattcatcaggcatggtccataagccacccaaaagaagcttgaagagtgagtgccctgccacacctccatctgacagagggactcctgattccctgctggactccggtcctactgatgaagaataccgtgctttgcgg

SEQ ID NO: 44118 - protein, 86 aa, Panicum virgatum
  misc_feature: Ceres CLONE 2019463
  misc_feature: Functional homolog of the protein sequence given in SEQ ID NO 51029
  misc_feature: Useful for making plants with modulated nitrogen use efficiency
MQDPNSDDFSATKLHKKKVVYRPLPSGMLKGEPELLRREGPHSSGMVHKPPKRSLKSECPATPPSDRGTPDSLLDSGPTDEEYRAL

SEQ ID NO: 44119 - DNA, 655 bp, Panicum virgatum
  misc_feature: Ceres CLONE 2019467
  misc_feature: Encodes the peptide sequence at SEQ ID NO. 44120
attccgctttgagcttgcttgcagctccagctcccctcgtctcttggtggctacgccatggccaccgtagtcctgatgagctgcagcctccgcgcgccggccagcagcggcttatctggcgtccgcgccgccccggcaccggccatcgtcgccatgcccgccgccaagcagcaggttgttggccgcggcgccaggctgcgctcgcaggccacctacaacgtgaagctcatcacgcccgacggcgaggtagagctgcaggtgcccgacgacgtgtacatcctggatcaggccgaggaagaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggagaagctcacctcctcttcgtaatccgatccagtatatgcggctttcattgcttattaattatctcagctcccttgattatatatatatatatatatatatatatatatatatatatatatatatatatatatatgtatacatatataaaaataaacccatccaaatagct

SEQ ID NO: 44120 - protein, 149 aa, Panicum virgatum
  misc_feature: Ceres CLONE 2019467
  misc_feature (58)..(133): Pfam Name: Fer2 Pfam Description: 2Fe-2S iron-sulfur cluster binding domain
MATVVLMSCSLRAPASSGLSGVRAAPAPAIVAMPAAKQQVVGRGARLRSQATYNVKLITPDGEVELQVPDDVYILDQAEEEGIDLPYSCRAGSCSSCAGKVVSGSVDQSDQSFLEDDQVAGGWVLTCAAYPTSDVVIETHKEEKLTSSS

SEQ ID NO: 44121 - DNA, 659 bp, Panicum virgatum
  misc_feature: Ceres CLONE 2019471
  misc_feature: Encodes the peptide sequence at SEQ ID NO. 44122
cgttgcccgcaatcgaaagcagatcaaaccctagatctcgtctcgccgccccgatccgaatcccatggattcgtcgtcgtcgtcgtcctccagcctgagccagcagcccgagttcgactacctcttcaagctgcttcttatcggcgactccggcgtcggcaagagcagtctcctcctacgcttcaccgccgactccttcgaggacctctcccccaccataggtgttgacttcaaggtgaagatggttaacattggtggcaagaaactcaagcttgccatctgggacacagctggacaggagagatttaggaccttaaccagctcatactacagaggggcacagggaatcattatggatacatctgatgaaattaatgtcatatcactgaggaaagtctttttttttggaaagccttgaacttatttctttcgggtttcatctctagcctaccccaacttgcttgggaaaaaaagctatgttgttgttgttgttgttgtactgaggaaagtcttgaatgccttgaagtgaagttcgattttgaactcaaccttcagttaattttactttcaaattttatgctaggcgcactctaattaatgactatatactgtgcttttgaagtttaaattattaacgggggaattgtctttcagttaag

SEQ ID NO: 44122 - protein, 117 aa, Panicum virgatum
  misc_feature: Ceres CLONE 2019471
  misc_feature (22)..(116): Pfam Name: Ras Pfam Description: Ras family
  misc_feature: SWISSPROT Homolog: EC 2.7.11.1 Non-specific serine/threonine protein kinase
  misc_feature: Functional homolog of the protein sequence given in SEQ ID NO 50630
  misc_feature: Useful for making plants with altered lignin content
  misc_feature: Functional homolog of the protein sequence given in SEQ ID NO 50522
  misc_feature: Useful for making plants with modulated oxidative stress sensitivity
MDSSSSSSSSLSQQPEFDYLFKLLLIGDSGVGKSSLLLRFTADSFEDLSPTIGVDFKVKMVNIGGKKLKLAIWDTAGQERFRTLTSSYYRGAQGIIMDTSDEINVISLRKVFFFGKP

SEQ ID NO: 44123 - DNA, 630 bp, Panicum virgatum
  misc_feature: Ceres CLONE 2019483
  misc_feature: Encodes the peptide sequence at SEQ ID NO. 44124
caattgcttcaactgttccatacatgattggcagtggcaatcatgagagagattggcctgacaccggatcattctatggatacaatgattccggtggtgaatgtggtgttcctactcagactatgttctatatccctgcagagaaccggggaaaattctggttctgcatagctgacactgaagaggactggagaccaggaactgagcagtacaagttcatcgagcattgcttgtcgtcggtcgacaggcagaaacagccatggctcatcttcctcgcacaccgggttcttgggtactcatcagccagctggtacgagatcatgatgggatcttatggtgagccgatgggccgagaagggctccaagatctttggcagaagtacaaggttgacctagcggttttcggtcacattcacagctatgaacgcacctgccccatctatcagaatcgatgtgtccaagatggatcaaacaattacatcgggcgtttcaacgcgacaacccatgtcgtcgtcggtgggggtggtgcaagcctctccccgttcagagccaccgtgccatactggagcttcttcagggacctcgacttcggcttcgtcaagctcacagctctcaacaattcgttcctct

SEQ ID NO: 44124 - protein, 209 aa, Panicum virgatum
  misc_feature: Ceres CLONE 2019483
  misc_feature: SWISSPROT Homolog: EC 3.1.3.2 Acid phosphatase
IASTVPYMIGSGNHERDWPDTGSFYGYNDSGGECGVPTQTMFYIPAENRGKFWFCIADTEEDWRPGTEQYKFIEHCLSSVDRQKQPWLIFLAHRVLGYSSASWYEIMMGSYGEPMGREGLQDLWQKYKVDLAVFGHIHSYERTCPIYQNRCVQDGSNNYIGRFNATTHVVVGGGGASLSPFRATVPYWSFFRDLDFGFVKLTALNNSFL

SEQ ID NO: 44125 - DNA, 704 bp, Panicum virgatum
  misc_feature: Ceres CLONE 2019493
  misc_feature: Encodes the peptide sequence at SEQ ID NO. 44126
acgaaatgaaaccaagcagcagcggaaagacgcgcgcacgcacggggcacggctcgcgctccaacgcccagaggccagccctcccatttcaggaaaagcaaagattccgccgtccaatcccgagccgagccgagccgctctccgttgattcgggggatggcgccgaaggagagcgagcagagtccggccgaggcggcgcccgcgccggctgagcggagcatcccggaggaggcgcggctgctgctgcgcgagctggcggcggagtgggaggacgtggccggctgcggccgggagccggaggtggtgccgctcaagggcgccatgaccaacgaggtgtaccaggcgcggtggcccgccggcggcgaggagagggaggcgcggacggtgctggtgcgggtgtacggggagggcgtcgacctgttcttcgacagggaggacgaggtgcgcacgttcgagtgcatgtcgcggcacggccacggaccgcgactcctcggccgcttccccaacggccgcgtcgaggagttcatccacgccaggacattttcagctgctgacctgcgtgatccggagatttcagctattatagcctccaaattgaaggaatttcacaaccttgacatgccgggttcaaaatctgtgctcatttgggaaagattaaggaactggctcaaaactgcaaagagcttgtgctcctctgatgaagc

SEQ ID NO: 44126 - protein, 182 aa, Panicum virgatum
  misc_feature: Ceres CLONE 2019493
  misc_feature (73)..(181): Pfam Name: Choline_kinase Pfam Description: Choline/ethanolamine kinase
  misc_feature: SWISSPROT Homolog: EC 2.7.1.32 Choline kinase
MAPKESEQSPAEAAPAPAERSIPEEARLLLRELAAEWEDVAGCGREPEVVPLKGAMTNEVYQARWPAGGEEREARTVLVRVYGEGVDLFFDREDEVRTFECMSRHGHGPRLLGRFPNGRVEEFIHARTFSAADLRDPEISAIIASKLKEFHNLDMPGSKSVLIWERLRNWLKTAKSLCSSDE

SEQ ID NO: 44127 - DNA, 697 bp, Panicum virgatum
  misc_feature: Ceres CLONE 2019538
  misc_feature: Encodes the peptide sequence at SEQ ID NO. 44128
atccgctcgtttgagaccacaccatgcgcgcctccaccgccctcttcctctttgccgccctcttcgtggcctccaccctcgccaccactcatgacccgctcactggcgtcttcgccaagtggatgagggacaactccaagtcctactccaacgaggagtttgtcttcaggtggaacgtgtggcgcgagaaccagcagttcatcgatgagcacaaccgctcgaacaagaccttcttccttgccatgaaccagttcggcgatctcaccaacgccgagttcaacaagatctacaagggtctctctttcgactactccacccacgcggccaagaaggtctccaccgagaaggccgctcccgccctcaacctgcccgccgatttcgactggaggcagaagggtgccgtgacccacgtcaagaaccagggtcagtgcggctcgtgctggtcgttctccaccactggctcgactgagggcgccaacttcctcaagactggccgtcttaactcgctctccgagcagaacctcatggattgctccacctcgtacggtaacaacggttgcaacggtggtctgatggactacgcctttgagtacatcatcaacaacaagggcatcgacaccgagtcctcgtacccctacgagaccgctcagggcacctgccgctacaaccccgccaactctggtggttcgctctccac

SEQ ID NO: 44128 - protein, 224 aa, Panicum virgatum
  misc_feature: Ceres CLONE 2019538
  misc_feature (30)..(85): Pfam Name: Inhibitor_I29 Pfam Description: Cathepsin propeptide inhibitor domain (I29)
  misc_feature (115)..(224): Pfam Name: Peptidase_C1 Pfam Description: Papain family cysteine protease
  misc_feature: SWISSPROT Homolog: EC 3.4.22.15 Cathepsin L
MRASTALFLFAALFVASTLATTHDPLTGVFAKWMRDNSKSYSNEEFVFRWNVWRENQQFIDEHNRSNKTFFLAMNQFGDLTNAEFNKIYKGLSFDYSTHAAKKVSTEKAAPALNLPADFDWRQKGAVTHVKNQGQCGSCWSFSTTGSTEGANFLKTGRLNSLSEQNLMDCSTSYGNNGCNGGLMDYAFEYIINNKGIDTESSYPYETAQGTCRYNPANSGGSLS

SEQ ID NO: 44129 - DNA, 714 bp, Panicum virgatum
  misc_feature: Ceres CLONE 2019544
  misc_feature: Encodes the peptide sequence at SEQ ID NO. 44130
gccaagcgccacgctccaccgtaccaaccgcaaccagccgcgcgccgtgatcatctgtgcggtggtgctgtagttagttgctttccgctccgctgctcggcttcgctttcctgccgttgtgcggaccggcatcgatctaccagggcgaggaggatgaaggtgtcggtggccgcggcggcggcggcggcgcttctgctgctgctgctctcggcggcggacgcgagcgagctcaagctggggtactacgccaagacctgccgggggtgggagaacgtggtcaaggaccacgtcgccaaggccatccgggccaaccgcgccagcggcgccgccctcgtccgcctcatcttccacgactgcttcgtcagggtgcaaagacagttccgccgaaaatagtcctcgtacatacatgcacatgcctgttgagcaaaaaccgtccttctctcttattttccttttggcttcaactaaccatactcaccatatccgtcgaccgaagcagagcacctgcattgtacgaccccatgtactaatcattagcggttaccgaaactgtcaacgctaataatatagcaaccgttgttcttcgattcaaccacggcacctacctggaaattaaagcacgtacaaccgacgagagagagtcctaacagcacactcctccatcgcttcgttgccaataagcatgcctcccagtaaagctcccttgtagcttac

SEQ ID NO: 44130 - protein, 79 aa, Panicum virgatum
  misc_feature: Ceres CLONE 2019544
  misc_feature: SWISSPROT Homolog: EC 1.11.1.7 Peroxidase
  misc_feature: Functional homolog of the protein sequence given in SEQ ID NO 51054
  misc_feature: Useful for making plants with altered carbohydrate content
MKVSVAAAAAAALLLLLLSAADASELKLGYYAKTCRGWENVVKDHVAKAIRANRASGAALVRLIFHDCFVRVQRQFRRK

SEQ ID NO: 44131 - DNA, 965 bp, Panicum virgatum
  misc_feature: Ceres CLONE 2019575
  misc_feature: Encodes the peptide sequence at SEQ ID NO. 44132
ctggccctgggagtggttcccctccgcgcgccgccggccggccgccgccgcgttcccccaaccatcgccgccgcctccaccaacctcgccgcaccgtgcccgcctctaaccagctcgaccgcgccgagccaccggccactcggccagatgccgccgctccgccccccgccgccgcggctcctcctcaacaacgtctcgtgcatgcggaacgcgcagacggtgctccgcgacatcaacctcagcgtccacgacggcacggccctcgtcctgaccggcgccaacggctccggcaagaccaccctcctccgcatgctggccggcttctcgcgcccctcggccggggagatcctctggaacggccacgacatcacctcaccgggcgtgttccagcagtacaagctgcagctcaactggatgtcgctcaaggacgccgtcaaggagaagctcacggttctggagaacgtgcagtggttcgagctcctcgaggggaaggacggcagcaggtcggggccggccatcgagctcatggggctcggcaggctcatgaacgagaaggccaggatgctgtccatggggcagaggaagcggctgcagctcgccaggctgctcgccattgaccgcccgatctggctgttggatgagccctctgtcgcgctggatgcggagggtaccaggctgctcgagtacatcatcgctgagcaccggaagaagggtgggatcgtgttcgtggcgacgcatctcccgatcgagattgaggatttcatgtcccttcggcttccgcagaggttcccccggaggaagacgctggttgatcttgtccattgatgtcaatgtgagcccaggaatttagctgtatctctctaattcttctccggctatctgtctgaatgctgttggagcaatttttgactgatgctgtgtttgtgattctatatttgggaacatgacaacagatttaccatgcc

SEQ ID NO: 44132 - protein, 225 aa, Panicum virgatum
  misc_feature: Ceres CLONE 2019575
  misc_feature (36)..(209): Pfam Name: ABC_tran Pfam Description: ABC transporter
  misc_feature: SWISSPROT Homolog: EC 3.6.3.41 Heme-transporting ATPase
MPPLRPPPPRLLLNNVSCMRNAQTVLRDINLSVHDGTALVLTGANGSGKTTLLRMLAGFSRPSAGEILWNGHDITSPGVFQQYKLQLNWMSLKDAVKEKLTVLENVQWFELLEGKDGSRSGPAIELMGLGRLMNEKARMLSMGQRKRLQLARLLAIDRPIWLLDEPSVALDAEGTRLLEYIIAEHRKKGGIVFVATHLPIEIEDFMSLRLPQRFPRRKTLVDLVH

SEQ ID NO: 44133 - DNA, 1265 bp, Panicum virgatum
  misc_feature: Ceres CLONE 2019583
  misc_feature: Encodes the peptide sequence at SEQ ID NO. 44134
agaaatttccattcgaagcgcagcctcgatttgattcccaattcccaattccccaccatcaccaccgtctcccttcccgtgtgatcgctccacaagcccccatggccggctacccgccgcccgcctccggctacccctacggccccggcgccgggggtgccggaggctacggcgccccgccgccctacggctcctccccggccccctccgccccgccctacggcgacaagccccccaaggaaggcaagacctcctcctcctcctccacgccgccctactacggcgccccgccctcctcccagccctacggcggcggtggcggaggctacggcgcgccctacggcgccccgccgccctcatccgcccctccctacggcgccccgccgccctcgtccgccgctccctacggcgcgccgccgcacgcgcccgcgccctacggggccccgccgccggcgtacgggggcgggtacggcgggagccccttcgcgtcgcttgtgccgtccgcgttcccgcccgggaccgaccccaacgtggtggcctgcttccaggcggcagaccgcgacggcagcgggatgatcgacgacaaggagctgcagtccgcgctctccggttacaaccagagcttcagcctccgcaccgtccacctccttatgtacctattcaccaacaccaacgtccgcaagatcgggcccaaggaatttacttctgtgttttacagtcttcagaattggagagcaatatttgaaagatttgaccgtgatcggagtggtaagattgactcatcagaactgcgtgatgctcttctcagtctgggatattccgtctctccaactgtgctagacctgcttgtgtctaaatttgacaagactgggggcaagagcagagcaattgaatatgataacttcattgaatgttgcctcactgttaagggactgactgagaagttcaaggagaaggacaccgcatactccgggtctgcggcgtttacttatgaggctttcatgctgaccgtgctccctttcctcatcgcctagtagcacagttcagagccaaagctaagcatgccatgccagttgtgtaaaagtggagagagttgttttgagctgagttaaaattcttggatttgattggtgttcctggtgttgcttgtcataaagttgatgggtgggtatgtttagctcagaaaatgctacaacctatatatagcactggatctgtttgttcaacaataaccatctagtcattttccgtccattgcttctccc

SEQ ID NO: 44134 - protein, 310 aa, Panicum virgatum
  misc_feature: Ceres CLONE 2019583
  misc_feature (209)..(237): Pfam Name: efhand Pfam Description: EF hand
  misc_feature: SWISSPROT Homolog: EC 3.4.22.52 Calpain-1
MAGYPPPASGYPYGPGAGGAGGYGAPPPYGSSPAPSAPPYGDKPPKEGKTSSSSSTPPYYGAPPSSQPYGGGGGGYGAPYGAPPPSSAPPYGAPPPSSAAPYGAPPHAPAPYGAPPPAYGGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGKIDSSELRDALLSLGYSVSPTVLDLLVSKFDKTGGKSRAIEYDNFIECCLTVKGLTEKFKEKDTAYSGSAAFTYEAFMLTVLPFLIA

SEQ ID NO: 44135 - DNA, 619 bp, Panicum virgatum
  misc_feature: Ceres CLONE 2019587
  misc_feature: Encodes the peptide sequence at SEQ ID NO. 44136
acacaaccgcgtcgccttcctcttgctcccggccatataaaccgcgcaggcacccacaataccaaatcaaatcccccacccaataccaagagatccaatgccagccgcgccgtctcctgcctctgctgcccctgcaagtgcctcgcctgcggcctcttcagctgcctctgcagcatcctcatctccctcctcgtcaccctcggcgtcctcgccctcatcttctacctcatcttccgcccccacatgatcgccgccaccgtcgactccgcctccctcgccacattcaccctctccccaacctcctcgctcgcatacaacctcaccgtcgccatgaccgtgcgcaaccccaacaagcgcgtcggcctctactacgacaacgtcgaggccctcgccttctacaaggaccagcgcttcggctacgacccgctcgacgccttctaccaaggcaccgaggcctccacccagctcaagcccgagttccacggacagcaactgctgcaaggggacgtcaccgccgcgcagttcaagcaagaccagaccgacggcagcttcgccatcaacgtcggcctcaacgccaagctcaaggtcaaggtctgggccttcaaggtccgggggccca

SEQ ID NO: 44136 - protein, 206 aa, Panicum virgatum
  misc_feature: Ceres CLONE 2019587
  misc_feature (75)..(206): Pfam Name: Hin1 Pfam Description: Harpin-induced protein 1 (Hin1)
TQPRRLPLAPGHINRAGTHNTKSNPPPNTKRSNASRAVSCLCCPCKCLACGLFSCLCSILISLLVTLGVLALIFYLIFRPHMIAATVDSASLATFTLSPTSSLAYNLTVAMTVRNPNKRVGLYYDNVEALAFYKDQRFGYDPLDAFYQGTEASTQLKPEFHGQQLLQGDVTAAQFKQDQTDGSFAINVGLNAKLKVKVWAFKVRGP

SEQ ID NO: 44137 - DNA, 707 bp, Panicum virgatum
  misc_feature: Ceres CLONE 2019598
  misc_feature: Encodes the peptide sequence at SEQ ID NO. 44138
aaaatattttaatatcaaatattaatcatgtctgagggttctgaagtcaagactggcaactttatgctcgatttcgctttgggtggtgtctccgctgctgtctccaagaccgccgtcgctcccatcgaaagagttaagctcctcctccaaactcaagatgccaacgctaagctcaccaagaagtacactggtatcgttgattgcttgaccagagtccccaaggaagaaggtatcagcgctttctggagaggtaacctcgctaacgtcatcagatacttccccactcaagccttgaacttcgctttcaaggatacctacaagaagatcttctgcccatacaaccccaagaccgaattctggaagttcttcttcggtaacttggcctccggtggtgctgctggtgctacctctttgatggtcgtctatcctttggatttcgccagaactagacttgctgctgatgtcggtaagactggtgctgaaagacaattcactggtctcgttgattgcctcaccaaggtctacaagtccgatggttacaagggtctctatcaaggtttcggtgtctccgtcctcggtatcatcgcctacagagcctgctacttcggtggttacgataccttgaagagagtcttgttctctgatggcaagacctccatcctcttcaagttcctcgtcgcccaagtcgtcactgctgcttctggttt

SEQ ID NO: 44138 - protein, 226 aa, Panicum virgatum
  misc_feature: Ceres CLONE 2019598
  misc_feature (11)..(105): Pfam Name: Mito_carr Pfam Description: Mitochondrial carrier protein
  misc_feature (113)..(207): Pfam Name: Mito_carr Pfam Description: Mitochondrial carrier protein
MSEGSEVKTGNFMLDFALGGVSAAVSKTAVAPIERVKLLLQTQDANAKLTKKYTGIVDCLTRVPKEEGISAFWRGNLANVIRYFPTQALNFAFKDTYKKIFCPYNPKTEFWKFFFGNLASGGAAGATSLMVVYPLDFARTRLAADVGKTGAERQFTGLVDCLTKVYKSDGYKGLYQGFGVSVLGIIAYRACYFGGYDTLKRVLFSDGKTSILFKFLVAQVVTAASG

SEQ ID NO: 44139 - DNA, 710 bp, Panicum virgatum
  misc_feature: Ceres CLONE 2019608
  misc_feature: Encodes the peptide sequence at SEQ ID NO. 44140
actcaccgcctccgattctccgaacagagtcagctcgccacgaacagctgaactcggcttcgctacgctccaagctccacactagtcgccatggctctgcaggccgcgctcctcccttccgctctctccgtccccaagaagggccacctcgccgccgcggtgaaggacacggctttcctcaccgttccccagaagaagctgcaggtggcgtcgctgtcgatgcgggcgcaggccgtggcgacggcgccggtggccaccccgggcgccagcacgtcgacgagggacggcaagaagacgctgcggcagggcgtggtggtgatcacgggggcctcgtcggggctcgggctggccgccgccaaggcgctggcggagacgggcaagtggcacgtcgtcatggcgtgccgcgacttcctcaaggccgccaaggcggccaagagcgccggcatggcggagggcagctacaccatcatgcacctcgacctcgcctccctcgacagcgtccgccagttcgtcgacagcttccgccgcgccgggatgccgctggactcgctcgtctgcaacgccgccatctaccggccgacggccaagacgccgacgttcacggcggacgggtacgagatgagcgtcggcgtcaaccacctcggccacttcctcctggcgcggctgctgctcgaggacctcgacaagtycgactacccgtcgcggcggct

SEQ ID NO: 44140 - protein, 206 aa, Panicum virgatum
  misc_feature: Ceres CLONE 2019608
  misc_feature (73)..(201): Pfam Name: adh_short Pfam Description: short chain dehydrogenase
  misc_feature: SWISSPROT Homolog: EC 1.3.1.33 Protochlorophyllide reductase
  misc_feature (200)..(200): Xaa is any aa, unknown, or other
MALQAALLPSALSVPKKGHLAAAVKDTAFLTVPQKKLQVASLSMRAQAVATAPVATPGASTSTRDGKKTLRQGVVVITGASSGLGLAAAKALAETGKWHVVMACRDFLKAAKAAKSAGMAEGSYTIMHLDLASLDSVRQFVDSFRRAGMPLDSLVCNAAIYRPTAKTPTFTADGYEMSVGVNHLGHFLLARLLLEDLDKXDYPSRR

SEQ ID NO: 44141 - DNA, 520 bp, Panicum virgatum
  misc_feature: Ceres CLONE 2019608-R
  misc_feature: Encodes the peptide sequence at SEQ ID NO. 44142
cccggggtgcatcgccaccacggggctgttccgcgagcacatcccgctcttcaggctgctgttccccccgttccagaagttcatcacgaaggggttcgtgtcggaggccgagtccggcaagaggctggcgcaggtggtcagcgaccccagcctcaccaagtcgggagtctactggagctggaacaaggactcggcatccttcgagaaccagctctcgcaggaggccagcgacccggagaaggcaaggaagctctgggagctcagcgagaagctcgtcggcctcgcctgatgagcctgctctggcgcttctagctggcaggcacggttggcgctcgcggggtacggggacaaccggacaagcagagcagatgatgagcttttgttgcttgcttcatttgtaccattagtgaccattttgtttaggagctggtgatggcagtcagagaattgaagcctgtaactgcactatgtacaatttttttcttcacaaaccatggaataaaacaacaggcttaatatg

SEQ ID NO: 44142 - protein, 95 aa, Panicum virgatum
  misc_feature: Ceres CLONE 2019608-R
  misc_feature: SWISSPROT Homolog: EC 1.3.1.33 Protochlorophyllide reductase
PGCIATTGLFREHIPLFRLLFPPFQKFITKGFVSEAESGKRLAQVVSDPSLTKSGVYWSWNKDSASFENQLSQEASDPEKARKLWELSEKLVGLA

SEQ ID NO: 44143 - DNA, 722 bp, Panicum virgatum
  misc_feature: Ceres CLONE 2019614
  misc_feature: Encodes the peptide sequence at SEQ ID NO. 44144
gcggcctctctcttcctcgtccttccaccacacgcaggcggcaggccatcgaggtgagcttactgcgcctgcgtcctccggaaccctagcgcgcgcgcggggcgcgtgagatccttctccctcctcgcgggactgaggcgtcgcgctgctgttctccgcgcagatgtcgtcggcggaggcgaaggcggcggcggtgccggagtcggtgctgcggaagcgcaagcgcggggaccagtgggcggcggacaagaaggagaaggcgctcgcggacaggaagaaggcgctcgagagccgcaaggccatcttcgcgcgcgccgagcagtacgcgcaggagtacgacgcgcaggagaaggagcttgtgcagctcaagcgtgaggcccggctcaagggtgggttctatgtgagccctgaggccaagcttctgtttgtgatccgcatccgtggtatcaatgccatgcaccctaagacccgcaagatcctgcagctcctgcgtttgaggcagatcttcaatggtgttttcctcaaggttaacaaggccaccattaacatgctgcgcagggtggagccatacgttgcgtatgggtatccaaacctgaagagtgtaagggaattgatttacaagaggggttatggaaagctgaacaagcagaggatccctctgagcaacaacaatgtcatttgagagggcctcggggaccacaacatcatctgcatcgaggatc

SEQ ID NO: 44144 - protein, 172 aa, Panicum virgatum
  misc_feature: Ceres CLONE 2019614
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
MSSAEAKAAAVPESVLRKRKRGDQWAADKKEKALADRKKALESRKAIFARAEQYAQEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNNVI

SEQ ID NO: 44145 - DNA, 656 bp, Panicum virgatum
  misc_feature: Ceres CLONE 2019619
  misc_feature: Encodes the peptide sequence at SEQ ID NO. 44146
gtcaagttccactggaagcccacctgcggggtgcgctgcatcctcaccgacgaggaggcggcgctcgtcggggggcgcaaccacagccacgccacgcaggacctctacgactccatcgccgcgggcagcttcccggagtggcagctgctggtgcaggtgatggacccggacacagaggaccagtacgacttcgacccgctggacgacaccaagacgtggcccgaggacctgctgccgctgcggccggtggggcggctggtgctggaccggaacgtggacaacttcttcaacgagaacgagcagctggcgttcggccccgggctggtggtgccggggatctactactcggacgacaagatgctgcagtgccgggtgttcgcgtacgccgacacgcagcgctaccggctggggcccaactacctgatgctgcccgtgaacgcgccgcggtgcgcgcaccacaacaaccactacgacggcgccatgaacttcatgcaccgggacgaggaggtggactactacccgtccaggcacgcgccgctgcggcaggcgccgccggtgccggtgccgccgaggccgctggcggggaggagggagaaggccaccatcaggaagcccaacgacttccagcagcccggggagagggaccggtcctggga

SEQ ID NO: 44146 - protein, 218 aa, Panicum virgatum
  misc_feature: Ceres CLONE 2019619
  misc_feature (1)..(181): Pfam Name: Catalase Pfam Description: Catalase
  misc_feature: SWISSPROT Homolog: EC 1.11.1.6 Catalase
VKFHWKPTCGVRCILTDEEAALVGGRNHSHATQDLYDSIAAGSFPEWQLLVQVMDPDTEDQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPVPPRPLAGRREKATIRKPNDFQQPGERDRSW

SEQ ID NO: 44147 - DNA, 696 bp, Panicum virgatum
  misc_feature: Ceres CLONE 2019629
  misc_feature: Encodes the peptide sequence at SEQ ID NO. 44148
gacagggccggcagcctccaaattcatccattcattccttccctgcacaccccaccgcttgtcagcaaactagccgcccgtgagctcgcccccgacatccaaagcggccggccggactagccagggaccggcccggcgtaggtaccgaccgccctcacagcacaggcgcccatggcggcgctcctcctcgtggcggtggcgctggcgtcgtcggcgccgccgagcggcgcgcagcagctgccgccggcgccggcggcggctccgtcgggctccggcggcgggacgatcgacccggcgtgcatgacgtcgctgctcaacatgtcggactgcctgtcgtacgtgaccaaggggagcgcggcgcggcggcccgacgcgccgtgctgcccggagctggcggggctggtgggctccaacccggtctgcctctgcgagctcctctccggcgccgccgactcctacggcatcgccgtcgactacgcccgcgcgctcgcgctcccggggatctgccgcgtcgccaccccgcccgtctccacctgcacagccatggggtatcacgtccacgtgggcccagccgcagcgcccatgtcaggctccccgtcgcccatgtcaggcatggctccctccggggagggcccagtgttcccagggacgtcgccggtcgcctcgccgccgtcctcgaccagccacgcggcgcgc

SEQ ID NO: 44148 - protein, 174 aa, Panicum virgatum
  misc_feature: Ceres CLONE 2019629
  misc_feature (43)..(122): Pfam Name: Tryp_alpha_amyl Pfam Description: Protease inhibitor/seed storage/LTP family
MAALLLVAVALASSAPPSGAQQLPPAPAAAPSGSGGGTIDPACMTSLLNMSDCLSYVTKGSAARRPDAPCCPELAGLVGSNPVCLCELLSGAADSYGIAVDYARALALPGICRVATPPVSTCTAMGYHVHVGPAAAPMSGSPSPMSGMAPSGEGPVFPGTSPVASPPSSTSHAA

SEQ ID NO: 44149 - DNA, 1180 bp, Panicum virgatum
  misc_feature: Ceres CLONE 2019632
  misc_feature: Encodes the peptide sequence at SEQ ID NO. 44150
aatcagctcttatatcaatcaaaaatatggactcgcgtgaaactaacactagcgacggctccccaagacaagagactaagaaagaaaccccatggaagctcgttttagtctgcattattttcgtcttggtctttttcctctttgttttttatcctccagcaaagcagattctctatgagactcagaattatcttcaaagtcaaggctgggtcggaagcctaggcctctgcctgatcaccaccttcgtgatcgtgcctttcggcattccctacagcatggttcaaatgatgttcgccataatgattccagaattctggttagccctcttattgacaagtatatctcagaccttgggatctatcgtcacatattgggtcatgaagcacgtcttcagagaaaaactagccgcctgggccagaaaccagacaatcttcaaaggaattgacctcatccttagcagatctcctctaaagttctcaatcatcctcaatgtcacaaatttgccattgattatcaagaattacgccttggcaatgccagacagcgttgactttaagactttcaccatctcctctatcatcggagcagtcttcacttccgcgccccagatctatttattccaagaagctgaagaccttgacagcatattcsmyaataagaaaaaccccctaagtaccgctttcacagtcctttctactgtattttcaatcgcgatcatcttatatttcatctggtacacaaagaagattctaagtgatatacataaagaagtcaagacacttaaacctgctgatgctgaactaaaggaagttcaagacgatttagaagcaaataataaagatgcagacaaacctcaacgccaacacacagaagaagaggttgccgataaaatcagagttgaaggcatcttaataaagggaattaatcccaatgactcttcttcaaaccgagagatttctcgagtttaattatttggcttctaagctttagaacatctgtttagtcatcatttgtttagttcgagtaaagggtgtccataaacactaacacccctggtttctttgtcaaatcgcaagacatctataaaggcggtttcaaatcacgatgggttttttcttttgtctcttgtattgtatagcgaggaccttctctttttaattgaatgaatatatgtgaaaaa

SEQ ID NO: 44150 - protein, 321 aa, Panicum virgatum
  misc_feature: Ceres CLONE 2019632
  misc_feature (88)..(208): Pfam Name: SNARE_assoc Pfam Description: SNARE associated Golgi protein
  misc_feature (217)..(217): Xaa is any aa, unknown, or other
SALISIKNMDSRETNTSDGSPRQETKKETPWKLVLVCIIFVLVFFLFVFYPPAKQILYETQNYLQSQGWVGSLGLCLITTFVIVPFGIPYSMVQMMFAIMIPEFWLALLLTSISQTLGSIVTYWVMKHVFREKLAAWARNQTIFKGIDLILSRSPLKFSIILNVTNLPLIIKNYALAMPDSVDFKTFTISSIIGAVFTSAPQIYLFQEAEDLDSIFXNKKNPLSTAFTVLSTVFSIAIILYFIWYTKKILSDIHKEVKTLKPADAELKEVQDDLEANNKDADKPQRQHTEEEVADKIRVEGILIKGINPNDSSSNREISRV

SEQ ID NO: 44151 - DNA, 665 bp, Panicum virgatum
  misc_feature: Ceres CLONE 2019637
  misc_feature: Encodes the peptide sequence at SEQ ID NO. 44152
tgaaaccctacccttctccatccgctcccaccctctcgggtgccaggagaagcagccgccgccgccgccgccgccgcttctacaggcaccgcagggtaccaagatgggtggttttgtcaagacccaaaagaccagtgcgtactccaagcgtttccaagtgaagttcaagagaaggcgcgctggcaagacagactacagggcaaggatcaggttgattaaccaagacaagaacaagtacaacacgcccaaatacagatttgttgtgcgatttaccaacaaggacatcactgcacaaatcggatctgcaagtattgcgggtgatatggtacttgctgctgcctactcccatgagctgccacgatatggtcttgaagttggtctgaccaactatgctgcagcctactgcgctgggcttcttttgggccgtcgtgtgctcgagcttcatgatttggataacgagtatgagggcaacgttgaggccactggtgaagacttctctgttgagccagatgatgagaggaggcctttccgtgctcttttggatgttggacttgttaggactaccacaggaaaccgtgtctttggtgccctgaaggaagctttgtatggtggtctaaatattcctcacagtgagaagaggtttgctggtgtcaagaacgatgaaa

SEQ ID NO: 44152 - protein, 187 aa, Panicum virgatum
  misc_feature: Ceres CLONE 2019637
  misc_feature (27)..(173): Pfam Name: Ribosomal_L18p Pfam Description: Ribosomal L18p/L5e family
MGGFVKTQKTSAYSKRFQVKFKRRRAGKTDYRARIRLINQDKNKYNTPKYRFVVRFTNKDITAQIGSASIAGDMVLAAAYSHELPRYGLEVGLTNYAAAYCAGLLLGRRVLELHDLDNEYEGNVEATGEDFSVEPDDERRPFRALLDVGLVRTTTGNRVFGALKEALYGGLNIPHSEKRFAGVKNDE

SEQ ID NO: 44153 - DNA, 926 bp, Panicum virgatum
  misc_feature: Ceres CLONE 2019638
  misc_feature: Encodes the peptide sequence at SEQ ID NO. 44154
ggcgaaaacaagaacgaggttgccggcgcggccggcgatccctcctcctctctcagctctggctccctctgtccctcatccccttgcaggtttggtcgcgctggtagatcccggccaaaaagggattgctgctggctgttccaggccttggagccggtttgatcgtgggaagcggagggagaaggggctgatacgatcgaggagctagggatggatcagctcatggggaaggtgggcgggtactggttcagccagaaggccaacgccgagatgaacggcgccggcgacgacatcaactcaatctctagcagcattggagatggagctaaatggatggtgaacaaaatcaaagggaagatgcagaaaccactgcctgaatttctcaaggaatatgagctcccaatgggcctgttcccccaggacgcgaccaactacgagctggccgaggacacgaagctgctcaccgtgtacatcgcatcgccctgcgaggtcgggtacaaggactcgtcggtcctgaggttcgccaccagcgtgacgggttacctggagaagggaaagctgacccacgtcgagggcctcaagaccaagatcctgatctggaccaaggtgacggaggtcagggccgaggccaccaaggtgcacttcgccgccggcatgaacaagacccggaatcgggatgcttatgaggtcgtcagggatggtgttgtcgtagacaagttctagatcattcataggtaacgtgatcgtgatggatgcgtgcatcccttaagctgggactgaccatttcggtatgactgttctgtagcaccaaaagaaatgatgcgtacaccatgtagattggggtgtcagagtgtgatgaagtagttccttattgtttacgaccttgacagtcatttcgtgcgttcgagtcaaagtgaatttctcag

SEQ ID NO: 44154 - protein, 170 aa, Panicum virgatum
  misc_feature: Ceres CLONE 2019638
  misc_feature: Functional homolog of the protein sequence given in SEQ ID NO 50572
  misc_feature: Useful for making plants with modulated nitrogen use efficiency
MDQLMGKVGGYWFSQKANAEMNGAGDDINSISSSIGDGAKWMVNKIKGKMQKPLPEFLKEYELPMGLFPQDATNYELAEDTKLLTVYIASPCEVGYKDSSVLRFATSVTGYLEKGKLTHVEGLKTKILIWTKVTEVRAEATKVHFAAGMNKTRNRDAYEVVRDGVVVDKF

SEQ ID NO: 44155 - DNA, 709 bp, Panicum virgatum
  misc_feature: Ceres CLONE 2019643
  misc_feature: Encodes the peptide sequence at SEQ ID NO. 44156
atcaaactaaatttgaagagtttgtagctggacatccggagttgaatcctgggatagacttggctgttactgttttgacaacaggattctggccaagctacaaaacctttgatataaatcttcctgctgagatggtgaaatgtgtagaggttttcaaggagttctaccaaacaagaacaaagcacaggaaacttacctggatttattccttgggcacctgtaacatcaatgccaagtttgatgccaagcctattgaactaattgttacgacatatcaggctgcattgctactgctattcaatggagccgataggcttagttattctgagattgtaactcaactaaacctgtcagatgatgatgtagtgcgcttgctccattcactctcttgtgctaaatacaagattcttaacaaagagccagcaaacagatccatctcccccaacgatgtgtttgagttcaattcaaaattcaccgacagaatgagaagaattaagattcccctcccccctgtcgatgagaagaaaaaagttgtcgaagatgttgacaaagataggaggtatgcaattgatgcatcaattgtgcgcatcatgaagagccgtaaagttatgggtcatcagcagctagttgcagaatgtgttgagcagctcagccgtatgttcaagccggacttcaaagccatcaagaagaggattgaggatctcatcac

SEQ ID NO: 44156 - protein, 235 aa, Panicum virgatum
  misc_feature: Ceres CLONE 2019643
  misc_feature (1)..(158): Pfam Name: Cullin Pfam Description: Cullin family
QTKFEEFVAGHPELNPGIDLAVTVLTTGFWPSYKTFDINLPAEMVKCVEVFKEFYQTRTKHRKLTWIYSLGTCNINAKFDAKPIELIVTTYQAALLLLFNGADRLSYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLI

SEQ ID NO: 44157 - DNA, 577 bp, Panicum virgatum
  misc_feature: Ceres CLONE 2019666
  misc_feature: Encodes the peptide sequence at SEQ ID NO. 44158
ctctctccgcctcccccattcctcttcccctgggatccgagggcgcacccgcagccgcagcaagtcactgaatctcaatccggaaaagccatcacctgatcaggggagggctcgcgatctcgcgcaggagcggagatggggctcacgttcaccaagctggtcagccgcctcttccccaagaaggagatgaagatcctcatgggtgggctcgacgcggctgggaagaccaccatcctctacaagctcaagctcggcgaaatcgtcccccccatccccaccataggatttaatggtgaaactggtgagtacaaaaacattagcttcactggttgggatggtggggggcaggaaaagatccgtcccctggggagggactacttccagaacacccaggggctcatttttgttgtggacagcaacgacagagagcgtgttggtgaggacgaactccgtgatgctgtgcttctggtggttgcaaacaaacaaaatcttcctaatggcatgaacgctgctgaaatcaccgaccagcttggcctggactccctgggccagcgggactggtacatccagagcacat

SEQ ID NO: 44158 - protein, 147 aa, Panicum virgatum
  misc_feature: Ceres CLONE 2019666
  misc_feature (5)..(147): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLVSRLFPKKEMKILMGGLDAAGKTTILYKLKLGEIVPPIPTIGFNGETGEYKNISFTGWDGGGQEKIRPLGRDYFQNTQGLIFVVDSNDRERVGEDELRDAVLLVVANKQNLPNGMNAAEITDQLGLDSLGQRDWYIQST

SEQ ID NO: 44159 - DNA, 721 bp, Panicum virgatum
  misc_feature: Ceres CLONE 2019683
  misc_feature: Encodes the peptide sequence at SEQ ID NO. 44160
agatcggccggccccaattccaaacccgcctcggcgctcccctcccctccgccccgcccgcaccccgctgctccagccatggcggtcgccaccgagctgcgcggcagcgaggacagagcttcaacccatgcaaacgaggagaagaggtgggtattgtccgattttgaagttggcaaaccacttgggaggggcaagtttggccatgtttatttggccagagaaaagaggagtaataagattgtcgctctgaaagttcttttcaagagccaactcaaacaatcccaggtggaacatcagctgcgccgtgaagtggagattcagagtcatcttcgtcatgccaatatccttcgcctttatggatatttctacgatcagactcgtgtttacctgatcttggaatatgctgccatgggagaactttataaggagttgacaagatgcaaacacttttctgagaggcgctctgcaacttatattgcatcactcgcaagagccctgatctaccttcatgggaaacatgtcatccatagggacattaaaccagagaatcttttgattggagcacagggcgagctgaaaattgcagactttggctggtctgtccacaccttcaaccgaaggcggacaatgtgtggaactctagattacctgcctcctgaaatgggtgagaagacagagcatgactatcatgttgacatctggagcttgggtatactgtgct

SEQ ID NO: 44160 - protein, 214 aa, Panicum virgatum
  misc_feature: Ceres CLONE 2019683
  misc_feature (29)..(213): Pfam Name: Pkinase Pfam Description: Protein kinase domain
  misc_feature: SWISSPROT Homolog: EC 2.7.11.1 Non-specific serine/threonine protein kinase
MAVATELRGSEDRASTHANEEKRWVLSDFEVGKPLGRGKFGHVYLAREKRSNKIVALKVLFKSQLKQSQVEHQLRREVEIQSHLRHANILRLYGYFYDQTRVYLILEYAAMGELYKELTRCKHFSERRSATYIASLARALIYLHGKHVIHRDIKPENLLIGAQGELKIADFGWSVHTFNRRRTMCGTLDYLPPEMGEKTEHDYHVDIWSLGILC

SEQ ID NO: 44161 - DNA, 711 bp, Panicum virgatum
  misc_feature: Ceres CLONE 2019686
  misc_feature: Encodes the peptide sequence at SEQ ID NO. 44162
agaagaaaggagagcctcagagcagcaggaaggactctgccagatcgagccttcttcttctccctctcatccaagaacagcatcaaacaagaaaccagagagctagaatagagcaagatgacctgagactaagcaaaacgcacgcacgcacgcacgtagaggacgcgcgggaaggacttgcactccggctcatgggtctcctggaccagctgtgggacgacacggttgccgggccgcgcccggactccggcctcggcaagctccgcaagtacgcctccttctcgccctcttcctcttcagtgtccgcggccgcggccgcgccgccgcctgcggagggggcggccgtcgccgtgccgccacccggcgtgacgcgcagcatcagcatgctccgcccctcggcgctgtccgtcgtcacgtcgccgcgcagcgagtccagctctgcgccgtcgtcgccggccagcggcgccccggactcgcccttcggcgcagcgacgacgcccaagggagagggctggaagaagctgcgccggaaaggcaggatggccgccgccgacggcgccgacgcccccggcacgccgaggagccccactgtctacgactgggtggtgatcagctcgctggacccgtgaacgactgcgcaaggaaaccatcagcacagctagccaactgaagagggtttctgtgttttgtatacgtaaaaattaccccccg

SEQ ID NO: 44162 - protein, 145 aa, Panicum virgatum; identical to SEQ ID NO: 37398
  misc_feature: Ceres CLONE 2019686
  misc_feature (7)..(145): Pfam Name: Auxin_repressed Pfam Description: Dormancy/auxin associated protein

SEQ ID NO: 44163 - DNA, 644 bp, Panicum virgatum
  misc_feature: Ceres CLONE 2019694
  misc_feature: Encodes the peptide sequence at SEQ ID NO. 44164
acgcacgccttggttgtctctctcggtctcggcggcctttcctttccttgctagcgctagcggcgacgaccgggcgagtgccgccgtccgccacttcttcgtcggccgaccaccatctgaaaggggtaaggtggatgagtgaagaggacaagactgctgctgctgctgagcagccgaagcgagcccctaagctcaacgaaaggatcctctcttctttgtccaggagatctgtagctgctcatccatggcatgatgttgagatcggtcctggggctcccgctgtcttcaatgttgtcgttgagatcacaaagggaagcaaagttaaatatgagcttgacaagaaaactggactgattaaggttgatcgagtcctgtactcatcagttgtataccctcacaattatggtttcattccaaggactctttgtgaggacaatgacccaatggatgttttggtcctgatgcaggagcctgttattccgggttcattcctccgggcaagagcaattggccttatgcctatgattgaccagggtgaaaaggatgacaagataattgctgtctgtgctgatgatcctgaataccgtcactacaatgacatcagtgagctgtctcctcaccgcctgcaagaaatcaagcgcttc

SEQ ID NO: 44164 - protein, 169 aa, Panicum virgatum
  misc_feature: Ceres CLONE 2019694
  misc_feature (52)..(169): Pfam Name: Pyrophosphatase Pfam Description: Inorganic pyrophosphatase
  misc_feature: SWISSPROT Homolog: EC 3.6.1.1 Inorganic diphosphatase
  misc_feature: Functional homolog of the protein sequence given in SEQ ID NO 50116
  misc_feature: Useful for making plants with modulated nitrogen use efficiency
MSEEDKTAAAAEQPKRAPKLNERILSSLSRRSVAAHPWHDVEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKR

SEQ ID NO: 44165 - DNA, 658 bp, Panicum virgatum
  misc_feature: Ceres CLONE 2019700
  misc_feature: Encodes the peptide sequence at SEQ ID NO. 44166
gatgtgttgttatcatggcagcaaccacacaagctcaaaatatccaattcaacaacactaaaaactttacaacaaaaaccactgcaaaagaaattgttgacgcatttggaactggacaatatctatctggtaaaacagcagttgttacaggtggaaatattggaattggtcttgaaacagtcaaatccctcgcttatgctggagcacgagttattttagcttctcgatcaattgaaaatggattaaaagcgatcgaacaagaaatcaaaaacccaggacatggaaactacacagtttctgattcttccaagattgttgtaaaagcattagaccttagtagcctcaaatccatcaaatccttcgcagatgatcttctcaaaaccgaagaaagaatcgatttcctcattctaaacgcaggaatttttcaggctgatttcgaacatacggctgatgggtttgagaaacacattggggtcaatcatattgggcatttttatttataccaactattagaatcaaaacttcaaaaacaagaattcaattctcgagttgttgttgtttcaagtcttacataatcaaggacatattgatcatgaagacctccactttaaaaacaaaccctatgatggactcttagcatactctaattccaaactcg

SEQ ID NO: 44166 - protein, 190 aa, Panicum virgatum
  misc_feature: Ceres CLONE 2019700
  misc_feature (44)..(189): Pfam Name: adh_short Pfam Description: short chain dehydrogenase
  misc_feature: SWISSPROT Homolog: EC 1.3.1.33 Protochlorophyllide reductase
CVVIMAATTQAQNIQFNNTKNFTTKTTAKEIVDAFGTGQYLSGKTAVVTGGNIGIGLETVKSLAYAGARVILASRSIENGLKAIEQEIKNPGHGNYTVSDSSKIVVKALDLSSLKSIKSFADDLLKTEERIDFLILNAGIFQADFEHTADGFEKHIGVNHIGHFYLYQLLESKLQKQEFNSRVVVVSSLT

SEQ ID NO: 44167 - DNA, 710 bp, Panicum virgatum
  misc_feature: Ceres CLONE 2019706
  misc_feature: Encodes the peptide sequence at SEQ ID NO. 44168
ctctccaccaagagctgctgctaccaccaaaccggtctccggattcgtccagagctttgcccgtttcgcggacccagatctactccgcggcgccgcattcccgccgagatggagatcacggtgaggcggtcgacgatggtgcgcccggcgcgggagacgccgcggcagcggctgtggaactccaacctcgacctcgtggtgccgcgcttccacacgcccagcgtctacttctaccgccgcggcggccccgaggtggaggggttcttcgacagcgagcggatgcggcgcgcgctggcggaggcgctcgtgccgttctacccgatggcggggcgcctcgcgcgggacgaggacggcagggtcgagatcgactgcaacggcgaaggggtgctcttcgtcgaggtcgacgcgcccaacgccgccgtcgacaactacggcgatttcgcgcccaccatggagctcaagcgcctaatcccggcggtcgattacaccgatgacatctcggccttcccgctcctcgtgctccaggtgacttacttcaaatgtggaggcgtctcccttggtgttggcatgcaacaccatgtagcggatggcatgtccggcttgcacttcattaactcatggtctgacctctgccgtggagctcaaatttctgtcatgcccttcattgaccgcactctcctccgtgctcgtgatccaccgactccatcttt

SEQ ID NO: 44168 - protein, 200 aa, Panicum virgatum
  misc_feature: Ceres CLONE 2019706
  misc_feature (1)..(200): Pfam Name: Transferase Pfam Description: Transferase family
  misc_feature: SWISSPROT Homolog: EC 2.3.1.144 Anthranilate N-benzoyltransferase
  misc_feature: Functional homolog of the protein sequence given in SEQ ID NO 51297
  misc_feature: Useful for making plants with altered carbohydrate content
  misc_feature: Functional homolog of the protein sequence given in SEQ ID NO 50937
  misc_feature: Useful for making plants with altered cell wall content and/or composition
  misc_feature: Useful for making plants with altered lignin content
MEITVRRSTMVRPARETPRQRLWNSNLDLVVPRFHTPSVYFYRRGGPEVEGFFDSERMRRALAEALVPFYPMAGRLARDEDGRVEIDCNGEGVLFVEVDAPNAAVDNYGDFAPTMELKRLIPAVDYTDDISAFPLLVLQVTYFKCGGVSLGVGMQHHVADGMSGLHFINSWSDLCRGAQISVMPFIDRTLLRARDPPTPS

SEQ ID NO: 44169 - DNA, 714 bp, Panicum virgatum
  misc_feature: Ceres CLONE 2019742
  misc_feature: Encodes the peptide sequence at SEQ ID NO. 44170
aattgccgcattggaagcattgaccaaccggccggagcctcggccctccattgttgttcctcttcttcttcccttcacccagcgaggatccttcaagtgttcttctccagatcgaaaataaatggccaacgatgccagtcaaggtaaaagactggagacacagcagagtctcacaagtacgttaccgtcggaactaacattagacttcctgaagaaaattactaatgatttctccccagatcgaaagattggtcaatccgcatttgggacatattacaagggaattcttgataataatgggggcattttagctgtgaagaagcttgctgaaaactcgccactgccacgggacatatcatttgctaatgaggttacaaaccttatggctcttgaacatgaaaatataacaaagttagttggcttctgccgtgaagcgcatacgaaagtggttcagcgccagggaagatacgtggctgttaatattgacgaatgtttgctctgctataaataccggcctaatggtagtcttgacctgcatcttttcgataaaacacgtgaaattgactgggacaaacgattcaaaatagttaaggggatctgcaatggtttgctttaccttcataaaggattgagcaagccaatcattcatatgaatcttgtgcccaactctatatggttggatgataactgggtggcaaagattgctgatttttg

SEQ ID NO: 44170 - protein, 197 aa, Panicum virgatum
  misc_feature: Ceres CLONE 2019742
  misc_feature (37)..(194): Pfam Name: Pkinase_Tyr Pfam Description: Protein tyrosine kinase
  misc_feature: SWISSPROT Homolog: EC 2.7.11.1 Non-specific serine/threonine protein kinase
MANDASQGKRLETQQSLTSTLPSELTLDFLKKITNDFSPDRKIGQSAFGTYYKGILDNNGGILAVKKLAENSPLPRDISFANEVTNLMALEHENITKLVGFCREAHTKVVQRQGRYVAVNIDECLLCYKYRPNGSLDLHLFDKTREIDWDKRFKIVKGICNGLLYLHKGLSKPIIHMNLVPNSIWLDDNWVAKIADF

SEQ ID NO: 44171 - DNA, 457 bp, Panicum virgatum
  misc_feature: Ceres CLONE 2019752
  misc_feature: Encodes the peptide sequence at SEQ ID NO. 44172
gagagggcacagcagccagcgccaaaagcagctgcctgccgataccataccactgctgctgctgctgcaacacagcccagcccagccaccaggagagagagagcgaggagcgagggcggcggcggcagcagctaccagaggcggcgagctagcttgttcgctcatgcagggcgcgtaccgctcttccagcgaggagtcggcggcgtcgccagcggctgccgcggcggcagccatggccccgctggcggcggccgcggtgaagatggaggagcaggcggcggcggcggcggcggctgcggcgatggcggccggcacgcaggcgccggcgccgctccagcagatgcagccgcggcggcagtaccgcggcgtgtgctgagcatgctctcgtgcctggtggggcctggggggtatgtcttgactgctatatcccgccgtggtgtaaacaagaaaacgcctc

SEQ ID NO: 44172 - protein, 70 aa, Panicum virgatum
  misc_feature: Ceres CLONE 2019752
  misc_feature: The sequence is a functional homolog of SEQ ID NO 488 in the 10/374,780 US patent application
  misc_feature: The sequence is a functional homolog of SEQ ID NO 490 in the 10/374,780 US patent application
  misc_feature: The sequence is a functional homolog of SEQ ID NO 681 in the 10/666,642 US patent application
  misc_feature: The sequence is a functional homolog of SEQ ID NO 683 in the 10/666,642 US patent application
  misc_feature: The sequence is a functional homolog of SEQ ID NO 988 in the 10/412,699 US patent application
  misc_feature: The sequence is a functional homolog of SEQ ID NO 990 in the 10/412,699 US patent application
MQGAYRSSSEESAASPAAAAAAAMAPLAAAAVKMEEQAAAAAAAAAMAAGTQAPAPLQQMQPRRQYRGVC

SEQ ID NO: 44173 - DNA, 692 bp, Panicum virgatum
  misc_feature: Ceres CLONE 2019786
  misc_feature: Encodes the peptide sequence at SEQ ID NO. 44174
aagcaagcgagcacaaccacaagagctactgtatctgagagcagagagcaggagctagcttctttaatttgtgcaaattaaaggagattcttcattagctactagctagtaccaataatggcggcgaccaagatctacatcgtgtactactcgacctggggccacgtcacggctctggcggaggagctcaagaagggcgccgagtccgtggacggcgttgaggtgaccgtgtggcgcgtcccggagaccctgccggaggaggtgctggggaagatgtacgcggcgcccaagcgcgaggaccacccggtgatcacggcgcggcagctggcggaggccgacggcctgctgctgggcttccccacgcggttcggcatgatggccgcgcagatgaaggcgttcctcgactccacgggcgggctgtggcaggagcaggccctggccgggaagcccgccggcttcttcttcgccaccggcacccagggcggcggccaggagtccaccgcgctcaccgccgtcacgcagctggcgcaccacggcatgatctacgtcccgatcggtggaacctttggcgcgcgcatgttcgggatggacgaggtcaggggcgggagcgcctacggggccggcaccttcgccggcgccgacggcagcaggacgcccagcgagatcgagctcgccatgggccaccaccaggg

SEQ ID NO: 44174 - protein, 191 aa, Panicum virgatum
  misc_feature: Ceres CLONE 2019786
  misc_feature (8)..(140): Pfam Name: Flavodoxin_1 Pfam Description: Flavodoxin
MAATKIYIVYYSTWGHVTALAEELKKGAESVDGVEVTVWRVPETLPEEVLGKMYAAPKREDHPVITARQLAEADGLLLGFPTRFGMMAAQMKAFLDSTGGLWQEQALAGKPAGFFFATGTQGGGQESTALTAVTQLAHHGMIYVPIGGTFGARMFGMDEVRGGSAYGAGTFAGADGSRTPSEIELAMGHHQ

SEQ ID NO: 44175 - DNA, 687 bp, Panicum virgatum
  misc_feature: Ceres CLONE 2019787
  misc_feature: Encodes the peptide sequence at SEQ ID NO. 44176
aaaaagatccacgaattggaaaaaagaggaaaaacaaggggacaggaaaggtcttccctttgctcgacggcggcgatgtctctccctccggccccggcggaaagcggcggcggcggcgtcgtcctccaaccccagtgtggaagttggcagctatgtaaacaccggtgatgtcttcaaggagcctggcagtaataaacgtttaagctcaggatcttctggtaggccaacatccaaagcttgtagggaaaaaatgagaagggacaagctcaatgacaggtttattgaattgggctctaccttggaacctgggaagccagtaaaagctgacaaagctgctatcctaagtgatgctactcgcatggttattcagcttcgctctgaagcacagcagctcaaggacaccaatggtagtcttgaagaaaagattaaggaactaaaggcagagaaggatgagcttcgcgatgagaagcagaagctgaaactagagaaggagagtttagagcaccagatgaagcttatgacatcaacaccagcctacatgcctcatccaaccctgatgccagcgcccttcccacaggctcagctagcaccgttccatccccatgcgcaagctgcagggcagaagctgatgatgccctttgttggctacccgggatacccaatgtggcagttcatgccaccttctga

SEQ ID NO: 44176 - protein, 228 aa, Panicum virgatum
  misc_feature: Ceres CLONE 2019787
  misc_feature (74)..(125): Pfam Name: HLH Pfam Description: Helix-loop-helix DNA-binding domain
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Functional homolog of the protein sequence given in SEQ ID NO 51532
  misc_feature: Useful for making plants with altered lignin content
KRSTNWKKEEKQGDRKGLPFARRRRCLSLRPRRKAAAAASSSNPSVEVGSYVNTGDVFKEPGSNKRLSSGSSGRPTSKACREKMRRDKLNDRFIELGSTLEPGKPVKADKAAILSDATRMVIQLRSEAQQLKDTNGSLEEKIKELKAEKDELRDEKQKLKLEKESLEHQMKLMTSTPAYMPHPTLMPAPFPQAQLAPFHPHAQAAGQKLMMPFVGYPGYPMWQFMPPS

SEQ ID NO: 44177 - DNA, 700 bp, Panicum virgatum
  misc_feature: Ceres CLONE 2019798
  misc_feature: Encodes the peptide sequence at SEQ ID NO. 44178
acacacacgcacaagctcatcgcccagctcagcttcgactcgtctcgagcaagaaatagctttcgtcgccaactcgttttcttggaggagggccggccggcgagagatttatttacggttgaggaggaggagatggaggtcgccgccgccgccgccggcgccgccgccgcagcgagctacgtggccgacgacgttgacagctgcctgaaggcgaccgagctgaggctcggcctgccgggcaccgaggagacggcgccgccgacgccgccgtccacgcccaggggcaagaagcgcgaggggaacagcgccgccgccgaggaggcagccaagaccgcgccgccggccgccaaggctcaggtggtggggtggccgccggtgaggtcctacaggaagagctgcttccagcagtccagcagcgccgccaagagcaagccggcgccggcgccggaggagaaggccccggccgcgcctgccgccgccgccggtggaaacgcggcgctgttcgtcaaggtgagcatggacggagccccctacctgaggaaggtcgacctcaagatgtacaagggctaccgcgagctcagggaggccctggaggccatgttcctcggcttctccggcggcggcgccgacgcgccggccgtcaacccctccgacttcgccgtcacctacgaggacaaggacggcgacctcatgctcgtcg

SEQ ID NO: 44178 - protein, 189 aa, Panicum virgatum
  misc_feature: Ceres CLONE 2019798
  misc_feature (25)..(189): Pfam Name: AUX_IAA Pfam Description: AUX/IAA family
MEVAAAAAGAAAAASYVADDVDSCLKATELRLGLPGTEETAPPTPPSTPRGKKREGNSAAAEEAAKTAPPAAKAQVVGWPPVRSYRKSCFQQSSSAAKSKPAPAPEEKAPAAPAAAAGGNAALFVKVSMDGAPYLRKVDLKMYKGYRELREALEAMFLGFSGGGADAPAVNPSDFAVTYEDKDGDLMLV

SEQ ID NO: 44179 - DNA, 1322 bp, Panicum virgatum
  misc_feature: Ceres CLONE 2019802
  misc_feature: Encodes the peptide sequence at SEQ ID NO. 44180
actcacagctgacacatccatacaacagagtctcgtcttcctgagctcccagcgggacaacagatttgaggagccaggaggaggccgtgtgtggggtggggcgccatggatctggtgaacggggtgctcaactgggtggggacgccggccatggtggccagcctgctgctcttctacccgccgtactacctcttcaagacctgctactccttcctctcctggctcttccccgaggacgtcgccggcaaggtggtcctcatcaccggcgcctcctccggcatcggcgagcaactggcctaccagtacgccatgaagcgggcctccctagtcctagtcgcacgaagggagtcgagcctccgtcaggttgccgacacagcaatcgagcttggtgcacgtgacgtgatcgttctaccgggcgatgtcgctaaccctgatgactgcaagagatttgttcagaccgcgatcagtcactacgaccgattggaccatcttgtgtgcaatgctggcatcgcgagcgtgggggcgtttcaggagattccagatgtcaaaaactacagttcccagcttgatgtgaacttctggggttcagtgaatacaacctttgctgcactcccatatctgraaaggagccgagggagaatagttgtcgctgcttctgcaacaggatggaatcctgtcccgagaatgagcttctataatgctgccaatgctgccctgataaacttctttgagacgctgcgaaccgagctcggaagcgaaattgggatcacaatagtaacgcctgggtggatcgagtccgagatgtccaaagggaaatacctcaaggatcaaggagaaatggaggttgatcaagaaatgcgcgatgctcaaattggtttgttcccagtggagtatgcgaagaactgcgccagggccatggtgcaggcggcctgccagggtgagcgctacctcaccgtgccggcatggttcagggcgatgtacctgtggagggtgtttgcgccggagatcgtcgagacctgctaccgcctcctgtacatgcacggccatggcgcgaggcaaaccgacgccctgagcaagacgatggctgaggctggtgggaagcagctgctgtacccaacttcactgcgctccgacgacgtcaagaccgattgaggtccggtgcccgaagtgcaacttgcttctaggctctttgagcatcaactttgatcggctcccatatatagaatgggtgaagtacagaactctggttggaaactgctgttgtcatgttaatgtgctgtgtacctgataatgaataaggcatgctctggtgtggtctgtcc

SEQ ID NO: 44180 - protein, 348 aa, Panicum virgatum
  misc_feature: Ceres CLONE 2019802
  misc_feature (48)..(216): Pfam Name: adh_short Pfam Description: short chain dehydrogenase
  misc_feature: SWISSPROT Homolog: EC 1.1.1.146 11-beta-hydroxysteroid dehydrogenase
  misc_feature (173)..(173): Xaa is any aa, unknown, or other
MDLVNGVLNWVGTPAMVASLLLFYPPYYLFKTCYSFLSWLFPEDVAGKVVLITGASSGIGEQLAYQYAMKRASLVLVARRESSLRQVADTAIELGARDVIVLPGDVANPDDCKRFVQTAISHYDRLDHLVCNAGIASVGAFQEIPDVKNYSSQLDVNFWGSVNTTFAALPYLXRSRGRIVVAASATGWNPVPRMSFYNAANAALINFFETLRTELGSEIGITIVTPGWIESEMSKGKYLKDQGEMEVDQEMRDAQIGLFPVEYAKNCARAMVQAACQGERYLTVPAWFRAMYLWRVFAPEIVETCYRLLYMHGHGARQTDALSKTMAEAGGKQLLYPTSLRSDDVKTD

SEQ ID NO: 44181 - DNA, 694 bp, Panicum virgatum
  misc_feature: Ceres CLONE 2019805
  misc_feature: Encodes the peptide sequence at SEQ ID NO. 44182
ggctggtttcctttcctacacggccgcgccgcgcagcctcgcccacgcacggcacgccgccccgcagccccaccacccgcagcgagcgcgaggtggggttatgggccgtgccgctcgcgcccacctccccctcctcctccactcctcaaccgccgccgccgcccccgccgcggcctccttattacccggccgcacccgccccggctcctcctccctctaggcagcaccaatcgctggtccagtccggcaatcgagctccccaaccaccagcacgcgtcggcctccctctccaaagagcgcggcttcaatggcctgttcgcgggcgcgcctgctcggctcgccggcctcgatcgccgtcctcatcctctccttcttccaagggtcggtgtgcggcaccaccttcagcttcaccaaccggtgccccgacacggtgtggccgggcctgctggcgggctcggggacgccgccgctcgagaccacgggcttcgcgctcgcgccggggcagtcgcgctcgctgccagcgccgcaggggtggtcgggccgcttctggggccgctccggctgcgacttcgacgcctccggcaagggctcctgcgccacgggcgactgcggctccggcgaggtcgagtgccgcggcgcgggggcgtccccgcccgccacgctcgccgagttcaccctcgatggcgccggcggc

SEQ ID NO: 44182 - protein, 128 aa, Panicum virgatum
  misc_feature: Ceres CLONE 2019805
  misc_feature (36)..(128): Pfam Name: Thaumatin Pfam Description: Thaumatin family
MACSRARLLGSPASIAVLILSFFQGSVCGTTFSFTNRCPDTVWPGLLAGSGTPPLETTGFALAPGQSRSLPAPQGWSGRFWGRSGCDFDASGKGSCATGDCGSGEVECRGAGASPPATLAEFTLDGAG

SEQ ID NO: 44183 - DNA, 681 bp, Panicum virgatum
  misc_feature: Ceres CLONE 2019809
  misc_feature: Encodes the peptide sequence at SEQ ID NO. 44184
agcccaacgctcgacagcgtcatcatcactcacggtaccccaagccgcgcgcgccgctgcccgctggtggtggtgtcaaaagccgccgcgcgcgagtgcgaggcgctgggcaggggggcgagcgagcgttgcgtgcggagccggtgggaggcgcagggagcggaggacaggatagcgagggggagcgcggcatgggcgccgggatcaggatcctggcggcgttcctggcggcgctcgcggccgccgccggcgtggcggcgcagctgcggcaggactactacgccgcggtgtgcccggacctggagagcatcgtgcgcgacgccgtgtccaagaaggtccaggcccagcccgtcgccgtcggcgccaccatccgcctcttcttccacgactgcttcgtcgagggatgcgacgcgtccgtgatcctggtgtcgacggggaacagcacggcggagaaggaccaccccaacaacctctccctcgccggcgacggcttcgacacggtcatcaaggccaaggcggccgtcgacgccgtgccggcgtgcacgaaccaggtgtcgtgcgccgacatcctcgccctcgccacccgggacgtcattgccctgactggcgggccgtcgtacacggtggagctcgggaggctggacgggctggtctcgctgtcgaccaacgtcgacgggaagc

SEQ ID NO: 44184 - protein, 163 aa, Panicum virgatum
  misc_feature: Ceres CLONE 2019809
  misc_feature (41)..(163): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51677
  misc_feature: Useful for making plants with altered carbohydrate content
  misc_feature: Functional homolog of the protein sequence given in SEQ ID NO 51491
  misc_feature: Useful for making plants with altered cell wall content and/or composition
MGAGIRILAAFLAALAAAAGVAAQLRQDYYAAVCPDLESIVRDAVSKKVQAQPVAVGATIRLFFHDCFVEGCDASVILVSTGNSTAEKDHPNNLSLAGDGFDTVIKAKAAVDAVPACTNQVSCADILALATRDVIALTGGPSYTVELGRLDGLVSLSTNVDGK

SEQ ID NO: 44185 - DNA, 701 bp, Panicum virgatum
  misc_feature: Ceres CLONE 2019823
  misc_feature: Encodes the peptide sequence at SEQ ID NO. 44186
aaagcaaagccaagacacgtttcatttcatcatttggctcactcgctcgctcacctgtctgtccatcgctctagctcagctcccagtgatagctgcaagcgacagcacagccaacgccaccaagagctgggagaggaaggttgtagacgatggggaagctctggacgatcctcactcacctccactccctcgcagggccaacggtcatgctcctgtaccccctgtacgcgtcggtgcaggcgatggagagcccgtcgaagcttgacgacgagcagtggctagcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgacaagttcgtcagggagcagctccggaagcacggcctcaccgccggcggcggcaaggtcaagaaggacgacaagtcgccctcgtcttctcccaaggacaaggagaagcccaagagcaagttccttgccttcgtcacccccaagaaggatcacgaagcttactgaagcatgccgcagggttcgccggtgcggggacctcatcccggcggcttgccgatgcagagcctcttgtagtgtttctagtgtccagttgtgtttgtccatgctcgtcac

SEQ ID NO: 44186 - protein, 147 aa, Panicum virgatum; identical to SEQ ID NO: 13037
  misc_feature: Ceres CLONE 2019823
  misc_feature (4)..(101): Pfam Name: TB2_DP1_HVA22 Pfam Description: TB2/DP1, HVA22 family

SEQ ID NO: 44187 - DNA, 713 bp, Panicum virgatum
  misc_feature: Ceres CLONE 2019828
  misc_feature: Encodes the peptide sequence at SEQ ID NO. 44188
aaacgccactcctccctctcctctcgtctcggcctcaggatcagcgggatcggagcagcagcaatggcgatggcgatggcgtcgtcgagcgagctccggagctgcagcgccgtgggcgtgcccagcctgctggcgccgtcgtcccgctccggccggctgccgttctgcgccagcgccaccacctcgggccgcgtcaccatgtccgccgagtggatgcccggccagccccgccccgcccacctcgacggctcctcccccggggacttcggattcgaccccctcggcctcgccaccgtgccggagaacttcgagcggttcaaggagtcggaggtgtaccactgccgctgggccatgctcgccgtgcccgggatcttggtgccggaggcgctggggcttggcaactgggtgaaggcgcaggagtgggcggccgtgcccggcgggcaggccacgtacctgggcaacccggtgccgtggggcactctgcccaccatcctggtgatcgagttcgtggccatcgccttcgccgagcaccagcgcaccatggagaaggaccccgagaagaagaagtaccccggcggcgccttcgacccgctcggcttctccaaggaccccgtcaagttcgaggagtacaagctcaaggagatcaagaacggccggctggcgatgttggcgttcgtggggttctgcgtgcagcagtcggcgtacccgggcac

SEQ ID NO: 44188 - protein, 216 aa, Panicum virgatum
  misc_feature: Ceres CLONE 2019828
  misc_feature (55)..(212): Pfam Name: Chloroa_b-bind Pfam Description: Chlorophyll A-B binding protein
MAMAMASSSELRSCSAVGVPSLLAPSSRSGRLPFCASATTSGRVTMSAEWMPGQPRPAHLDGSSPGDFGFDPLGLATVPENFERFKESEVYHCRWAMLAVPGILVPEALGLGNWVKAQEWAAVPGGQATYLGNPVPWGTLPTILVIEFVAIAFAEHQRTMEKDPEKKKYPGGAFDPLGFSKDPVKFEEYKLKEIKNGRLAMLAFVGFCVQQSAYPG

SEQ ID NO: 44189 - DNA, 725 bp, Panicum virgatum
  misc_feature: Ceres CLONE 2019832
  misc_feature: Encodes the peptide sequence at SEQ ID NO. 44190
agactctggtttcttcctccccccgtcatctctgctgcgccgccatcgcataaatcctccgccctctccctcctccgtaaacccctccctctctcgcttcctcggccggcctgctcccgtgatctgtgctgcagatcggtcgacatggcgctcgtattgcattctggacctggaaacaagaatgctttcaaggcacttattgctgcagaatacagtggggttaaggttgagttgacaaagaattttgagatgggtgtcaccaacaagacccctgagtttcttaagatgaacccccttgggaagactcctgaaggtgctgtttttgagagcaatgctattgcacgctatgttgctcgcttgaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcgttgaagagagcgctcggttctctgaacacgcaccttgcctcaaagacattccttgttgggcattctgtcactctagctgacattgtattgacatgcaacctctaccatggatttgcacggatcttgaccaagagcttcacatccgagttcccgcatgtcgagaggtatttctggactatgggtaaccagcctaactc

SEQ ID NO: 44190 - protein, 193 aa, Panicum virgatum
  misc_feature: Ceres CLONE 2019832
  misc_feature (1)..(71): Pfam Name: GST_N Pfam Description: Glutathione S-transferase, N-terminal domain
  misc_feature (99)..(192): Pfam Name: GST_C Pfam Description: Glutathione S-transferase, C-terminal domain
  misc_feature: SWISSPROT Homolog: EC 2.5.1.18 Glutathione transferase
MALVLHSGPGNKNAFKALIAAEYSGVKVELTKNFEMGVTNKTPEFLKMNPLGKTPEGAVFESNAIARYVARLNDGNPLFGSSRIEQAHVEQWMDFAATEVDPGVAWYLYPRLGYIPYSQTTEETAIASLKRALGSLNTHLASKTFLVGHSVTLADIVLTCNLYHGFARILTKSFTSEFPHVERYFWTMGNQPN

SEQ ID NO: 44191 - DNA, 1270 bp, Panicum virgatum
  misc_feature: Ceres CLONE 2019843
  misc_feature: Encodes the peptide sequence at SEQ ID NO. 44192
aaaaagccaagccaagccaccaccccctctactacctgcttgctactactctccatcccatcccatcccatcccgccctttgcttctcacctgctactgctgtcgtcaccggcctcgcctcccaaccgcacccgccggcgcctcgcctcgcctcctgcctgctgaccggaaggcggattcactgactcactggaggagcaagaggcttgagctgctggtcgatcgctctccgctccgggcaagcaagccatggatccgtcgtcgggcgcgttcctgccgccgcagccgcaggtgggctccttctccttcccccggagctccagcaacgtgtcgctgtcgtcactggccaggagcgccagcggcggcagcgccggacgcgggaggggcgccaccaggggcaggaggatgatgcgcagggtctgccgcggcgtcatcaccttcatcttcgccatcgaagcaagcaagctcattcgatgcctgcgtacatgcagctggtctgttcctgggagccgtgaccggcggcctgatcgggctggccacggagagcggcctgttccgcggcaccggcatcggcgccatcaccggcgcgctcgtctccatcgaggtcgtcgactcctccatccggctgtggcaggcgcgccgctccgggatctggagcatcctctatgtgctgaacgtgatctacagcctcctgaccggcaggctcgtccgcgagaaggtcgacccggcggtgcagcgggtggtccggagccagatgaacgcggtggactcgtcgccattcagggagtctccggacctgttcgaggtggaggccaccaacggcatgccgcgggcgtccatcgacaagctccccgagtcctggatcaccgaggagtacaagcgcgacgccgtcggcgacccctccggctgctcggtctgcctccaggatttccaggttggggagaaggtgcggagcctgccggattgctggcacgtgttccacgtgccgtgcatcgacggctggctgatcaagcacgggtcctgcccgctctgcaggaggaagctctagacgccccgacgccatggatgctgcttgctgcgagtcgatgtgcccttgtgccccactgctgcctaggatgaggagaggagctggaggaggaagagactgacatctatagaacccttaatttatatagagcttttttttcttttttgcttctgctgctgcttgtacgtgttctaccctttctcttgcatcttttttgatctatatataatgtcttcctctctc

SEQ ID NO: 44192 - protein, 97 aa, Panicum virgatum
  misc_feature: Ceres CLONE 2019843
  misc_feature (52)..(93): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: Functional homolog of the protein sequence given in SEQ ID NO 50918
  misc_feature: Useful for making plants with modulated nitrogen use efficiency
  misc_feature: Functional homolog of the protein sequence given in SEQ ID NO 51383
  misc_feature: Useful for making plants with altered alkaloid content
  misc_feature: The sequence is a functional homolog of SEQ ID NO 448 in the 11/435,388 US patent application
  misc_feature: Functional homolog of the protein sequence given in SEQ ID NO 51689
  misc_feature: Useful for making plants with altered lignin content
MNAVDSSPFRESPDLFEVEATNGMPRASIDKLPESWITEEYKRDAVGDPSGCSVCLQDFQVGEKVRSLPDCWHVFHVPCIDGWLIKHGSCPLCRRKL

SEQ ID NO: 44193 - DNA, 522 bp, Panicum virgatum
  misc_feature: Ceres CLONE 2019870
  misc_feature: Encodes the peptide sequence at SEQ ID NO. 44194
ctctttcagctcccataagcacccattttgaacaatgaagcttgagatttgctccttctctggtcacaagatttatcctgccaagggtaagacctacgtccgtgtcgactctagaactttccgtttcatcaacggtaaggccgcctcttacttcctccaacgtttgaacccccgtaagatcagatggaccgttatctaccgtcgtttgaacaagaagggtatgactgaggaagtccaaaagaagcgttctcgtcgtaccgtcaagcacgaacgtgctgttgttggtgcctcttgggatgctatccgtgccaagcgtaaccaaaagcctgatgctcgtgctgccgctcgtcaagctgccatctccaagtccaaggacgccaagaaggctgctgctgctgccaagaaggctgctaaccctgctggttctcaagccaaggttagcaagcaacaagccaagggcttcgctcccaaggccgctgccacctctcgctaaattgctttacaaccaacaattttaatatg

SEQ ID NO: 44194 - protein, 152 aa, Panicum virgatum
  misc_feature: Ceres CLONE 2019870
  misc_feature (1)..(71): Pfam Name: Ribosomal_L24e Pfam Description: Ribosomal protein L24e
MKLEICSFSGHKIYPAKGKTYVRVDSRTFRFINGKAASYFLQRLNPRKIRWTVIYRRLNKKGMTEEVQKKRSRRTVKHERAVVGASWDAIRAKRNQKPDARAAARQAAISKSKDAKKAAAAAKKAANPAGSQAKVSKQQAKGFAPKAAATSR

SEQ ID NO: 44195 - DNA, 694 bp, Panicum virgatum
  misc_feature: Ceres CLONE 2019871
  misc_feature: Encodes the peptide sequence at SEQ ID NO. 44196
agagagagggagcaaaggcgaagcagccaacaaccagaggcgcccgaggccgagggagacgaagctcttgagagaattgggagacagagagagagagggggagggaggaggacgatggaacaggcgtgctcgccttcctcctccatggccctgaggcagtgcaggatttgccatgacgaggaggacgagggcggcgcggccatggagtcgccctgcgggtgctccggctccctcaagtacgcgcacaggggatgcgtgcagcgctggtgcgacgagaaggggagcaccctctgcgagatttgccttcagaatttcgagcctggctacaccgttcctcccaagaaaaaccaacctgccgatgtcgcggtcaccatcagagagagcctggaggtgcccaggatggactacgagccggacgaggaggaggacgtcgacgcggcggtggccggcgccggcgacccggagtacgccgagtgcgcccgcgccgccggcaggagcgcgtcctggtgccgctcggtggccgtgacgttcaccgtcgtgctgctgctgaggcacctggtcaccgtggcgacggtcggagcggcgaaccagttcgccttcagcctcctcacggtgtacttgctgcgggcgagtgggatcctgctgccgttctacgtcgtcatgaggctcatctccgtgatccagcagggtcagc

SEQ ID NO: 44196 - protein, 193 aa, Panicum virgatum
  misc_feature: Ceres CLONE 2019871
  misc_feature (16)..(63): Pfam Name: zf-C3HC4 Pfam Description: Zinc finger, C3HC4 type (RING finger)
MEQACSPSSSMALRQCRICHDEEDEGGAAMESPCGCSGSLKYAHRGCVQRWCDEKGSTLCEICLQNFEPGYTVPPKKNQPADVAVTIRESLEVPRMDYEPDEEEDVDAAVAGAGDPEYAECARAAGRSASWCRSVAVTFTVVLLLRHLVTVATVGAANQFAFSLLTVYLLRASGILLPFYVVMRLISVIQQGQ

SEQ ID NO: 44197 - DNA, 713 bp, Panicum virgatum
  misc_feature: Ceres CLONE 2019881
  misc_feature: Encodes the peptide sequence at SEQ ID NO. 44198
ggtggtatccaaatcggtaacgcctgttgggaactcttctgcttggaacacggtatccaacctgatggtcaaatgccctctgacaagactatcggtggtggtgatgatgctttcaacaccttcttctccgaaactggtgccggcaagcacgtccccagatccgtcttcctcgatttggaacctaccgtcgtcgatgaagttagaactggtacctacagacaattgttccatcccgaacaattgatctccggtaaggaagatgccgctaacaacttcgccagaggtcactacaccattggtaaggaaatcgtcgacctttgcttggacagaatcagaaagctcgctgataactgtaccggtcttcaaggtttcatggtcttcaacgctgtcggtggtggtaccggttccggtttgggctctctccttttggaaagactctccgtcgattacggcaagaagtccaagctcggcttcaccatctatccttctccccaagtctccactgccgtcgttgaaccttacaactccgtcttgtccactcactcccttttggaacacactgatgtcgctgttatgcttgataacgaagctatctacgatatctgcagaagacaactcgatatcgaaagacccacttacaccaacttgaacagactcattgctcaagtcatctcctctttgactgcctctttgagattcgatggtgccctcac

SEQ ID NO: 44198 - protein, 237 aa, Panicum virgatum
  misc_feature: Ceres CLONE 2019881
  misc_feature (38)..(235): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
GGIQIGNACWELFCLEHGIQPDGQMPSDKTIGGGDDAFNTFFSETGAGKHVPRSVFLDLEPTVVDEVRTGTYRQLFHPEQLISGKEDAANNFARGHYTIGKEIVDLCLDRIRKLADNCTGLQGFMVFNAVGGGTGSGLGSLLLERLSVDYGKKSKLGFTIYPSPQVSTAVVEPYNSVLSTHSLLEHTDVAVMLDNEAIYDICRRQLDIERPTYTNLNRLIAQVISSLTASLRFDGAL

SEQ ID NO: 44199 - DNA, 701 bp, Panicum virgatum
  misc_feature: Ceres CLONE 2019883
  misc_feature: Encodes the peptide sequence at SEQ ID NO. 44200
aacttcgccgtcccctgcggcgacgacggcgacggcatgtacttctccgccgaggcccccgacgtgccgtccatggtgctccccacctgcgccgacttcgacgggttccaggcggcgaccaaggatatggtgaagaataagaaggggacgaccacgctcgccttcatcttcgacaagggcgtcatcgtcgccgccgactccagggccagcatgggcggctacatatcctcacaaactgtgaggaaaattattgaaataaacccctacatgttgggaactatggctggaggcgccgctgattgccaattttggcataggaaccttgggaccaagtgccggctccatgagctttcgaacaagcgaaggatctctattgctggtgcttccaaactgttggccaatatcctttattcatatcgtggaatgggactgtcaattggtacaatgattgcggggtgggatgaaaagggtcctggcctgtactatgttgacagtgagggtgcaaggctcgtgggaaacaggttctctgttggctctggttccctctatgcttatggtatcttggatgaaggttaccgcttcaacatgtcagttgaagaagctggtgagttagctcgaagggctatttatggggcaaccttccgtgatgcagcaagtggtggttgtgttagtgaattgcagtttatcacgttggccccgat

SEQ ID NO: 44200 - protein, 233 aa, Panicum virgatum
  misc_feature: Ceres CLONE 2019883
  misc_feature (46)..(229): Pfam Name: Proteasome Pfam Description: Proteasome A-type and B-type
  misc_feature: SWISSPROT Homolog: EC 3.4.25.1 Proteasome endopeptidase complex
NFAVPCGDDGDGMYFSAEAPDVPSMVLPTCADFDGFQAATKDMVKNKKGTTTLAFIFDKGVIVAADSRASMGGYISSQTVRKIIEINPYMLGTMAGGAADCQFWHRNLGTKCRLHELSNKRRISIAGASKLLANILYSYRGMGLSIGTMIAGWDEKGPGLYYVDSEGARLVGNRFSVGSGSLYAYGILDEGYRFNMSVEEAGELARRAIYGATFRDAASGGCVSELQFITLAP

SEQ ID NO: 44201 - DNA, 997 bp, Panicum virgatum
  misc_feature: Ceres CLONE 2019890
  misc_feature: Encodes the peptide sequence at SEQ ID NO. 44202
gcacagcaatctctccctcaaatcagtcccctccccgtccctgcgtttgccgccgccgctcccaaccgccggcgccgctatgggaggtgggcgcggggtacccgctcgtggactgcgccgtctgcatcgcggaggtcgccgcgggggaagccgcccgcatgctgccccggtgcggccacgcgttccatgtcgagtgcatcgacatgtggctgcgctcccactccacctgcccgctctcccgctgcggtcgtcgacgaggaggcggcggcggtgcccccgcgggctcccggggccgacctggagtcggccaacttccccatcgcaacgccagcggagcttcccccggcggcgcgccagccgccggcggtgccggcgcaggcgccgcagctgattccagggtccctcaccagagtcgcgaccgtcgtggatgcggcaagggtagccgccctacgctggctgctgggctgcagcctcgcgacaccgtctccaccgacgccaccgcagcagcagcagcaagacttctcccccagtcgacggacttggcggacggcgactccgctgcgatggagacctcatctgcacgagcgggcgcctatggtgagctccttgatgacctctgcatcaagctcttccacgacgagcggataccccacctgatcattgctggccgcctagcccctctagatctagctcgccaaggtgctcaatcatttggggaagcacaagatggcggcggcaattgcgcatgaagccctctgctgcatcctggcgagatcgcgagaagccttgaggcaactaatctcgcttattctgcttgtgcctacatcccattagaagttgttcaatggtttgactcttgccacaggtgaataagatgtgggcggggctttgccactgctaagattaatttctgtctcgaggtgagttgtgcttgactcgactgatggggatgagattggggcatgtctattggatgttggcacttgccaagcagccg

SEQ ID NO: 44202 - protein, 248 aa, Panicum virgatum
  misc_feature: Ceres CLONE 2019890
  misc_feature (38)..(81): Pfam Name: zf-C3HC4 Pfam Description: Zinc finger, C3HC4 type (RING finger)
TAISPSNQSPPRPCVCRRRSQPPAPLWEVGAGYPLVDCAVCIAEVAAGEAARMLPRCGHAFHVECIDMWLRSHSTCPLSRCGRRRGGGGGAPAGSRGRPGVGQLPHRNASGASPGGAPAAGGAGAGAAADSRVPHQSRDRRGCGKGSRPTLAAGLQPRDTVSTDATAAAAARLLPQSTDLADGDSAAMETSSARAGAYGELLDDLCIKLFHDERIPHLIIAGRLAPLDLARQGAQSFGEAQDGGGNCA

SEQ ID NO: 44203 - DNA, 666 bp, Panicum virgatum
  misc_feature: Ceres CLONE 2019894
  misc_feature: Encodes the peptide sequence at SEQ ID NO. 44204
gacagtcacctctctgcttggtgtgggttgtggccttgtgggcgttgcttcctgatctgctcatcttgattcttgagggagatcaactagagagaagctagcatggggaggtcgccgtgctgcgagaaggcacacacgaacaagggcgcctggaccaaggaagaggaccagcgcctcgtcgcctacatcaatgcacacggcgaaggctgctggaggtcgctccccatggcggcggggctgcagcgctgcgggaagagctgccggctgcggtggatcaactacctgcgccccgacctcaagcggggcaacttcaccgaggaggaagacgacctcatcatcaagctccaccagatcctcgggaacaagtggtctctgatcgccgggcggttgccgggtcggacggacaacgagatcaagaactactggaacacgcacatcaagcgcaggctcctggcccgcggcatcgacccgcagacgcaccatcctctccctctcagtggcgccgccgccaacgcgccaagcagccgtcgtccccaggaccagccggcggcggcgcgctcaagctgctcaccgcagaccagcggtgcgggccacagcgcgcccgtgctgcacctcggcggcatcgatctcaacctgtccttaagccctcccagccaaccgtcctcg

SEQ ID NO: 44204 - protein, 187 aa, Panicum virgatum
  misc_feature: Ceres CLONE 2019894
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1010 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1073 in the 10/374,780 US patent application
  misc_feature: The sequence is a functional homolog of SEQ ID NO 1002 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 824 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 296 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 271 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 442 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1681 in the 10/374,780 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: Functional homolog of the protein sequence given in SEQ ID NO 51269
  misc_feature: Useful for making plants with modulated biomass
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 796 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 126 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: Functional homolog of the protein sequence given in SEQ ID NO 50733
  misc_feature: Useful for making plants with altered cell wall content and/or composition
MGRSPCCEKAHTNKGAWTKEEDQRLVAYINAHGEGCWRSLPMAAGLQRCGKSCRLRWINYLRPDLKRGNFTEEEDDLIIKLHQILGNKWSLIAGRLPGRTDNEIKNYWNTHIKRRLLARGIDPQTHHPLPLSGAAANAPSSRRPQDQPAAARSSCSPQTSGAGHSAPVLHLGGIDLNLSLSPPSQPS

SEQ ID NO: 44205 - DNA, 596 bp, Panicum virgatum
  misc_feature: Ceres CLONE 2019897
  misc_feature: Encodes the peptide sequence at SEQ ID NO. 44206
aagcgttaagagcacgaaacaacacaagctagaacgaggcgaaacaaggagtagaaactagaaaatggccggaggaagtgaggagctgaagctgctcggcgcctgggcgagcccgttcgctctgcgcgtgaagctcgcgcttgggttcaagggcctgagctacggggacgtcgaggaggatcttggcagcaagagcggcctcctcctcgcgtccaacccggtgcacaagaaggtgcccgtgctcctccacaacggcaagccggtctgcgagtcgcagataatcgtgcagtacatcgacgaggccttccccggcaccggcccctctctccttcctgctgacccgtatgaacgtgccgtcgctcgcttctgggccgcctacgtcgacgacaagctcttggcctcgtggttgcagtcgttcaggggcaagacggaggaggagaaggcggaggggctgaagcagacgctcgcggcggtggagcacatggaggcggccttcagggagtgctccaagggcaagcccttcttcggcggcgacaccgtcgggtacctggacgtcacgctcgggaccctggtcgcgtgggtgcacgccggcgaga

SEQ ID NO: 44206 - protein, 177 aa, Panicum virgatum
  misc_feature: Ceres CLONE 2019897
  misc_feature (6)..(79): Pfam Name: GST_N Pfam Description: Glutathione S-transferase, N-terminal domain
  misc_feature: SWISSPROT Homolog: EC 4.4.1.5 Lactoylglutathione lyase
  misc_feature: Functional homolog of the protein sequence given in SEQ ID NO 51078
  misc_feature: Useful for making plants with modulated biomass
MAGGSEELKLLGAWASPFALRVKLALGFKGLSYGDVEEDLGSKSGLLLASNPVHKKVPVLLHNGKPVCESQIIVQYIDEAFPGTGPSLLPADPYERAVARFWAAYVDDKLLASWLQSFRGKTEEEKAEGLKQTLAAVEHMEAAFRECSKGKPFFGGDTVGYLDVTLGTLVAWVHAGE

SEQ ID NO: 44207 - DNA, 674 bp, Panicum virgatum
  misc_feature: Ceres CLONE 2019905
  misc_feature: Encodes the peptide sequence at SEQ ID NO. 44208
ggccctagaacacaatgccactaggacaaatcaacaaaagaagaagcggaagaaggcagattcagctaaaaacgttcaacctaacaatgttgactacggttacaatgttccatttgaccctgcatattataacccttttgtcagtgggtatccttgggtacctgaaccttacatgtacagctctatggggatgccttatggtggttatccaatggacccatatggtgttaattgcttcaatggcatgccaccgcaggctcttgccatgcaaggctatccagcaagttatcaaaggcctggaactcagcccatgcattaccagggcagtgaagctgttgcaacacgtccaaggcatgatgagagacctaaggacagtagttttaagccccaatcatcagagtgcaaccgccaactgggatcttctcatggattagaatcaaggaacagagcaaggtcaggctccgagagacagcaccatgtgcgttctgacagggtctccgatgaccacgatgagagccactcgagtaggaagagaatgcgccatccttctccagtgtatggcgacaagcagagccgccaggcatcgaggcacggttccaggagtcgtgaggattcaagcgacgatgaatgcaacttcaagaagagttggggccgcagatcatcagtcggtgtgg

SEQ ID NO: 44208 - protein, 224 aa, Panicum virgatum
  misc_feature: Ceres CLONE 2019905
  misc_feature: The sequence is a functional homolog of SEQ ID NO 1252 in the 10/666,642 US patent application
ALEHNATRTNQQKKKRKKADSAKNVQPNNVDYGYNVPFDPAYYNPFVSGYPWVPEPYMYSSMGMPYGGYPMDPYGVNCFNGMPPQALAMQGYPASYQRPGTQPMHYQGSEAVATRPRHDERPKDSSFKPQSSECNRQLGSSHGLESRNRARSGSERQHHVRSDRVSDDHDESHSSRKRMRHPSPVYGDKQSRQASRHGSRSREDSSDDECNFKKSWGRRSSVGV

SEQ ID NO: 44209 - DNA, 675 bp, Panicum virgatum
  misc_feature: Ceres CLONE 2019918
  misc_feature: Encodes the peptide sequence at SEQ ID NO. 44210
actcccacgtcacctcacggtctgcttctcttcctcgcctcctacaagtagccgcggctcccgcgccgccggcgacagctgagagtgacgaggcgcagcggacgacgagcgcgcgggcatggcgacgagctccaaaccggccgcggctgtggaccccgaggtcgcgctcgcccacaggttccctgaggtctccttcgactacgacgagagggatgtggcgctgtacgcgctcggcgtcggggcctgcggcgacgacgccgtcgacggcaaggagctacacttcgtgtaccacagggacgggcagccacacattaaggttcttccgacctttgtttctttatttcccaacaagaacagcaatgggcttggaattgttgatgtgcctggccttaacttcgatgcaagccttctattgcacgggcaacaatacatagagatctacaggctaattccttcttctgccagtgttgtaaacaaggttaaagtagctggtttgcacgataaagggaaagccactattcttgagctcgaaactaccacaagcctcagagagtctggggaaattttatgcatgaacaggagtactatctacttgcgtggtgctggaggtttttcagactcttcacggccctatacttatgctaattatcctgctaatcaagttcatctcatttc

SEQ ID NO: 44210 - protein, 185 aa, Panicum virgatum
  misc_feature: Ceres CLONE 2019918
  misc_feature: The sequence is a functional homolog of SEQ ID NO 2 in US patent 7176349
MATSSKPAAAVDPEVALAHRFPEVSFDYDERDVALYALGVGACGDDAVDGKELHFVYHRDGQPHIKVLPTFVSLFPNKNSNGLGIVDVPGLNFDASLLLHGQQYIEIYRLIPSSASVVNKVKVAGLHDKGKATILELETTTSLRESGEILCMNRSTIYLRGAGGFSDSSRPYTYANYPANQVHLI

SEQ ID NO: 44211 - DNA, 635 bp, Panicum virgatum
  misc_feature: Ceres CLONE 2019929
  misc_feature: Encodes the peptide sequence at SEQ ID NO. 44212
agagagagagagagagagagagagaggcgaaaagcaggcaggagcttgttgctggtgttgctcgtacgcgtccggagagcgaaggggagggtgcgagcgagcggtggccatggcggagcagcacaaggaggagtcggtgctggagaagatctcggacaagctccacggccgcgggggcggcggctcatcgtcgtcgtcggactcggacgacgaccgctcgtcggcgacggccgcggtgaaggccaagatctaccgcctcttcggccgcgagaagcccgtccactccgtcctcggcggcggcaagcctgccgatctgtttctatggaagaacaagaagatttctggtggtgtgcttgccggcgcaactgccatctggctgctgtttgaggtcatggactaccacctgctcaccctgctgtgccactgcctcatcctcaccctggccatcctgttcctctggtcgaatgccaccactttcatcaacaagtctcctcctaacatccctgaggtgaagatcccagaggacctggcagtgaatgttgcacgttcactgagatacgagatcaacaggggctttgctaccttgagggagatcggtcagggccatgacctgaagaagtttctgattgtaattg

SEQ ID NO: 44212 - protein, 175 aa, Panicum virgatum
  misc_feature: Ceres CLONE 2019929
  misc_feature (66)..(175): Pfam Name: Reticulon Pfam Description: Reticulon
MAEQHKEESVLEKISDKLHGRGGGGSSSSSDSDDDRSSATAAVKAKIYRLFGREKPVHSVLGGGKPADLFLWKNKKISGGVLAGATAIWLLFEVMDYHLLTLLCHCLILTLAILFLWSNATTFINKSPPNIPEVKIPEDLAVNVARSLRYEINRGFATLREIGQGHDLKKFLIVI

SEQ ID NO: 44213 - DNA, 1498 bp, Panicum virgatum
  misc_feature: Ceres CLONE 2019932
  misc_feature: Encodes the peptide sequence at SEQ ID NO. 44214
aattcaaaaccctaaacgagaaatcgaacgcgtcggcgaccatggaggcgtctccgtcctctccccctgccctcggcgccacagccgcagccaccgctggagttggtggtcggagctcgaatcccctactgccgtctcctgatctcaccgacttcttcgtatggagggaatttgtatggggaggaattgcaggtgcatttggggaaggcatgatgcatccagttgacactctgaaaacaaggcttcagagtcaggctataatgacaggggctaaggctcagaagaatatattccagatggttaggacagtttgggcttctgatggtctgagaggtttttacagaggaatcagcccaggtgttactggatcacttgcaactggtgcaacatatttcggtgttattgaatcaactaagacatggttggagaatgctaatcctaatctaagtgggcactggtcacattttattgctggagcaattggtgatacacttggatcctttgtatatgtgccttgtgaagtcatgaaacaaagaatgcaagtccaaggcacccaaaaatcttgggcatcagctgcagctaaaggaagtatttctcaaactcatgggactcagatgtatgggtactacaacggaatgctccatgctggttgttctatctggagagagcatggtttgaaggggctttatgcaggatactggtctacgcttgccagagatgtcccttttgctggtctaatggtcactttctatgaagcaatgaaagaattgaccgagtatgggaaaacaaagtatttgccaaacagtgatttggatgtcagcaactcctttgaagggcttgttctaggaggattggcaggcggctgtagtgcatacttgacaacccccttggatgtgataaagacaagactgcaagtacaaggatcaacatctaggtacaatgggtggctggatgctataacaaagacatggacttccgagggggtgcatggtttgttcaagggaagcgttcctagaataatctggtatatccctgcatctgcattcacattcatggcagtggagttcctaagggaccatttcaacaataaggtcgacacagatgccagtgaactagccaccctgtcaatcgatgcgagatcagaagtcgaggaagcagcttaatgttcctttccctatgaagcgaccctgatattcctgcctggtgggatttatccagtggaatctctgtctttcgtaaacatgatactcctatgtttttttagataaaggaatagccttatattccacaacgtagcaggcttcggccgtgtaaatgttgagggcatacattgtcagctaggcgagaacgtttgtatgtatcagggagaagggaactgacaacctcatgatcctttattgggttgcaattcttcgagttaggaatctggtttcttggtgggagactgtgagtactttgaatgatgattaaagtgaacatgtaacattctgcagtgacc

SEQ ID NO: 44214 - protein, 373 aa, Panicum virgatum
  misc_feature: Ceres CLONE 2019932
  misc_feature (261)..(351): Pfam Name: Mito_carr Pfam Description: Mitochondrial carrier protein
  misc_feature (39)..(132): Pfam Name: Mito_carr Pfam Description: Mitochondrial carrier protein
  misc_feature (137)..(248): Pfam Name: Mito_carr Pfam Description: Mitochondrial carrier protein
MEASPSSPPALGATAAATAGVGGRSSNPLLPSPDLTDFFVWREFVWGGIAGAFGEGMMHPVDTLKTRLQSQAIMTGAKAQKNIFQMVRTVWASDGLRGFYRGISPGVTGSLATGATYFGVIESTKTWLENANPNLSGHWSHFIAGAIGDTLGSFVYVPCEVMKQRMQVQGTQKSWASAAAKGSISQTHGTQMYGYYNGMLHAGCSIWREHGLKGLYAGYWSTLARDVPFAGLMVTFYEAMKELTEYGKTKYLPNSDLDVSNSFEGLVLGGLAGGCSAYLTTPLDVIKTRLQVQGSTSRYNGWLDAITKTWTSEGVHGLFKGSVPRIIWYIPASAFTFMAVEFLRDHFNNKVDTDASELATLSIDARSEVEEAA

SEQ ID NO: 44215 - DNA, 631 bp, Panicum virgatum
  misc_feature: Ceres CLONE 2019933-R
  misc_feature: Encodes the peptide sequence at SEQ ID NO. 44216
ctttccgagcctccaggcctgatgagcaagctgcggccatcagatccgccagaacggccgaggaagaagagaggagaaggtcggctctgcgactgcgacaagagcaggacgcagcttaccttgagtctcttcggcgggatcaggagaaagaaagatcccgcaagagtctgcaagagggagctgccaagccgagggcaggtaaccagcttcgcgcaagacatcctggccaggcagcacgccaacctaccaagccgacccagatcagagcatcccctcagaaggaaactgcagcttcacaaagaactgaacctaataccaagatcatgataaggtttcccaacggtgagaggaggcagcagagcttccatcacacggacaccgtcaaggatgtctacaggtatgtggactcctcgggcataccaggcatcggaagctaccagctcgtgaggagctacccaaggaagacgtacggtcagcagcagctggggatgactctcggagacgcaggtttctatccgagtgtgacgttgtacattgagcagctttcgtaatcttgctgggttgctgtaatcgtgattcgtgaaactggcataaatttcaagaaaacaatgcgatgggaagatctggagac

SEQ ID NO: 44216 - protein, 182 aa, Panicum virgatum
  misc_feature: Ceres CLONE 2019933-R
  misc_feature (99)..(180): Pfam Name: UBX Pfam Description: UBX domain
FRASRPDEQAAAIRSARTAEEEERRRSALRLRQEQDAAYLESLRRDQEKERSRKSLQEGAAKPRAGNQLRARHPGQAARQPTKPTQIRASPQKETAASQRTEPNTKIMIRFPNGERRQQSFHHTDTVKDVYRYVDSSGIPGIGSYQLVRSYPRKTYGQQQLGMTLGDAGFYPSVTLYIEQLS

SEQ ID NO: 44217 - DNA, 688 bp, Panicum virgatum
  misc_feature: Ceres CLONE 2019933
gacctgaccgatcataacgcctgctgaggccggcggacatcgccggagaatccagccatgtcctcaggtccggcgaggggaagcggcagcagcagcgcgggagagagcctccggaactcctgcaacgacttcgcccggaccctggcgcggctgccggccagcatcatggaaggcctgtcgaggtcgatccctcgccgtcggagccaccaccaccctatcccccaccgtctccagccaccgccgcaagcgcctccgctccttcctccgccgttcgtccccgaggagctcttcttcttcagcgtgttcgagcagcagtacggcgcgcaccacccgttcttctacgcctgccgcttcgccgacgccctgagggccgcgcggagggagggcaagctcgtcttcgtgtacctccacgacccgggccacccctacaccgagcccttctgccggcggacgctctgcagcgacgtggtggtggagttcctcgacgccaacttcgtgtcctggggagccgtcagcggcacgggggaagggccgggcatggtggcgtcgctgcagcccggtagcttccccttctgtgccatcgtcgttccggtctccgacgaaagcatcgcagtcctgcagcaggtggagggaccagtgtcaccgtcagagctggtggagatcttgcagcgcactattgacgagcagg

SEQ ID NO: 44218 - DNA, 650 bp, Panicum virgatum
  misc_feature: Ceres CLONE 2019942
  misc_feature: Encodes the peptide sequence at SEQ ID NO. 44219
ctccgcggaggaagagcaagggataaagccctagagtttggcgagggagggcggagccgcggctgctggtcggtggtcgctacatcggatctccccgccgccgtcgcttgaacctaggcctttgttctccttccccgtgaggtgccgcaatggccgcgaaaggctcctcatccaacttggagaaggagcagatgttttggatggcggagaaggagatggagtacagggttgatctcttcaatagacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacctgggaagcactagttgcatttttgtagcataatctgtcgctctgtttccccattttggttggttttacaatgtggccacctgctagtaagtgctccaatacagcaccagtgacttgctaattcatggaccgcccaaaaggaaatcccaatgtcttgcactttccagggatgtgccttgtctatgaatcatgaacagcgaacatgcttgtaataatttgatacagctcgagagaacaattctgttgct

SEQ ID NO: 44219 - protein, 83 aa, Panicum virgatum
  misc_feature: Ceres CLONE 2019942
  misc_feature (14)..(80): Pfam Name: zf-Tim10_DDP Pfam Description: Tim10/DDP family zinc finger
MAAKGSSSNLEKEQMFWMAEKEMEYRVDLFNRLTQTCFDKCVEKRYKETELNMGENSCIDRCVSKYWQVSNIVGQMLGNRPQM

SEQ ID NO: 44220 - DNA, 686 bp, Panicum virgatum
  misc_feature: Ceres CLONE 2019943
  misc_feature: Encodes the peptide sequence at SEQ ID NO. 44221
acactaagcattgaatttgagagtaattagcaattacattccattccattccgtttcattctcaattttttacacagttcaaaaatcttcatcaaaatgtcgttgattccaagtttctttggtggccgaaggagcaacacttttgatccattctctcttgacatttgggatcccttcaaggattttcctttctccaattctgcactttctgcttcttcattccctcgtgagaattctgcatttgcaagcacacgagtggattggaaggaaactccagaagcacatgtgttcaaggctgatcttcctggattgaagaaggaggaagtgaaggttgaaattgaagatgacagggttcttcagataagcggagagaggaatgtcgaaaaagaagataagaacgatcaatggcatcgcgtggagcgtagcagtggaaagttcatgaggagattcagattgccggagaatgctaaaatggatcaagtgaaagctgcaatggagaatggtgttctcactgttactgttccaaaagaagaagttaagaaacctgatgttaagtctattgagatctctggttgaacttagaatgagttctgtctgttattatgttacttaaaattattcgcgtccttgagagtgttggttggaatgcttaccttttgtgtgtgatgtgggtgtgagttatcatg

SEQ ID NO: 44221 - protein, 159 aa, Panicum virgatum
  misc_feature: Ceres CLONE 2019943
  misc_feature (55)..(158): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIPSFFGGRRSNTFDPFSLDIWDPFKDFPFSNSALSASSFPRENSAFASTRVDWKETPEAHVFKADLPGLKKEEVKVEIEDDRVLQISGERNVEKEDKNDQWHRVERSSGKFMRRFRLPENAKMDQVKAAMENGVLTVTVPKEEVKKPDVKSIEISG

SEQ ID NO: 44222 - DNA, 596 bp, Panicum virgatum
  misc_feature: Ceres CLONE 2019950
  misc_feature: Encodes the peptide sequence at SEQ ID NO. 44223
gagaatggatgtggcagtccatgtattgatttccggcaggttagctcagaactagctgctgctgcaaaagatgcagatctgttaattttagagggcatggggcgagcactgcataccaacctcaatgcacgttttaagtgtgatgctctaaagcttgctatggtgaagaatcagagattggcagaaaagcttttcaatggaaatatatatgactgcatctgtaaattcgaacccgtttcttaacaatatggcaatgactgcggaggatttgcaacttgcagaagtgagttggttcatctgcacccaactggatgaagaaacatgcatacgccgaatgatccgtccaatgtaccaggaaactccttaccatatctgtgatagtcttgaacaagataattaaggtttaaaggtcattcccagaaagattggatagaggttcgacccaggtaagctggagcctggagctcttgtttaaggaggctcgaatatgcaccctctttagcagcatagctgggctgaagtacatactcagatcctggcgagctattgtcatcaaactcgaatcaatccaataaaatgttctctgggataatgac

SEQ ID NO: 44223 - protein, 80 aa, Panicum virgatum
  misc_feature: Ceres CLONE 2019950
  misc_feature: SWISSPROT Homolog: EC 2.7.1.33 Pantothenate kinase
ENGCGSPCIDFRQVSSELAAAAKDADLLILEGMGRALHTNLNARFKCDALKLAMVKNQRLAEKLFNGNIYDCICKFEPVS

SEQ ID NO: 44224 - DNA, 682 bp, Panicum virgatum
  misc_feature: Ceres CLONE 2019957
  misc_feature: Encodes the peptide sequence at SEQ ID NO. 44225
agaaatcaagctgcaagatattcaaaggagatgggttgcttctaatcgatgggcagaagctgcccaatttgcgcttgctagaagcctcacaccatcacagagcgacctcctcgcccttgaagctgctgagggaaataatatcctcaggagaacaaaggatgctgtaatcactctgcaaagtgttctagaagggaagcacaacactgaaattgacgaaactctaaatcagtatcaggtcccagctgatcggtggtggtcatcgctttacaaagtcattgaaggcctcgccatgatgagcagattgggccgcaaccgcctccaacaaccttcctacaattttgagaacggttctattgactgggaccaaatgtagatgtagaactctggagtagaacactgattccattccctgaagtctcgttgtggagtaggttggaggtgcagttatttctggcggatttggttgttcctactgtgtgtaggtgctgccacggacataagaagtgccagttttttttagtagtagatagattcacggccctgacgccgctctgaaaatgaataatgagctagttttgccacagcaggacggttcacgacttactgtgccgtcgtccgcaaggattgtaattttctatgcacactccgacatcattatatgccaaattttgataacttgtgc

SEQ ID NO: 44225 - protein, 123 aa, Panicum virgatum
  misc_feature: Ceres CLONE 2019957
  misc_feature: SWISSPROT Homolog: EC 3.6.3.44 Xenobiotic-transporting ATPase
EIKLQDIQRRWVASNRWAEAAQFALARSLTPSQSDLLALEAAEGNNILRRTKDAVITLQSVLEGKHNTEIDETLNQYQVPADRWWSSLYKVIEGLAMMSRLGRNRLQQPSYNFENGSIDWDQM

SEQ ID NO: 44226 - DNA, 712 bp, Panicum virgatum
  misc_feature: Ceres CLONE 2019960
  misc_feature: Encodes the peptide sequence at SEQ ID NO. 44227
atcgaccgagccaacccctgccagagcaaacatcaccgaccccgccccaacacgtcccaggagcgagagcgtaggcagaggaaccgaagatgagcgtggagatccttgacgggagcacggtccggagcttcgtggaggacgagggcgccttcaactcctccgtggacggccgcttcgccgcgctggacgccgaccacgacggcctgctcacgtacgcggagatggccggcgagctcatgagcctccgggtcctcgagaagcacttcggcgtggacgacgcggaggtgcgggccgacgagctcgccgcgctctaccgcggcctgttcgcgcggttcgacagggatggcagcggcgaggtggaccgggacgagttccgggcggagatgagggaggtgatgctcgccgtggccaacgggctcggcttcctccccgtgcagatggtcgtcgaggatggcagcttcctcaaggtggccgtcgacagggagctcggccagctcgccaaagctgcataaacctctactaattgccttgccgaccacgcatcatggcttaattacctcggcagcggatttttcgcatttgttgtttttccctattcgtaacttcagatattgtattgatgaactacatcgttgctaattatgggcgtaatagttttttttattctgaggatgtaacagttgatagtgagatatgcattgggtgctacatt

SEQ ID NO: 44227 - protein, 140 aa, Panicum virgatum
  misc_feature: Ceres CLONE 2019960
  misc_feature (74)..(102): Pfam Name: efhand Pfam Description: EF hand
MSVEILDGSTVRSFVEDEGAFNSSVDGRFAALDADHDGLLTYAEMAGELMSLRVLEKHFGVDDAEVRADELAALYRGLFARFDRDGSGEVDRDEFRAEMREVMLAVANGLGFLPVQMVVEDGSFLKVAVDRELGQLAKAA

SEQ ID NO: 44228 - DNA, 689 bp, Panicum virgatum
  misc_feature: Ceres CLONE 2019971-R
  misc_feature: Encodes the peptide sequence at SEQ ID NO. 44229
cgagccccggcgagtgcaatgaggagtacaacaagctggcgaggaggttcaacgccgagctgcaggaggccctgaggaagctcaacggtgagctcgccggcgcgcaggtggtctacgcagagacgtacagcttggcgtctgccatcattgccagcccgtccgattacggattcgagaacgccgtgcaaggttgttgtggtacaggactcatcgaaacatcagtcctttgcggcgtggatgaaccgttgacgtgtcaagacgcggacaagtatatgttcttcgattcagttcatccgtccgagcggacgtaccggatagttgctgacaatcttctgaacaatgcattgcaagtgttcctgtgacatctctagtttgtacccgcgtagtttttaataacaaaaatattaaacggaccgaattaattaatgttaattagaaccccttgctagcaggacgtgctggctgtactagagatgagaagcacaggtttacccggccctatagtggcccaattaagggtgttacatgtgcatgccctatttatgtgaaattaggttggcgctcacctgtccttgcaccaccctaggtcactgactggcaggagtgaaaatgcaaatatcagcaggactgtctttattcatactgttctgttagatcaccgagaagataaatcagtaccaacctttccg

SEQ ID NO: 44229 - protein, 119 aa, Panicum virgatum
  misc_feature: Ceres CLONE 2019971-R
  misc_feature: SWISSPROT Homolog: EC 3.2.1.51 Alpha-L-fucosidase
SPGECNEEYNKLARRFNAELQEALRKLNGELAGAQVVYAETYSLASAIIASPSDYGFENAVQGCCGTGLIETSVLCGVDEPLTCQDADKYMFFDSVHPSERTYRIVADNLLNNALQVFL

SEQ ID NO: 44230 - DNA, 649 bp, Panicum virgatum
  misc_feature: Ceres CLONE 2019971
ggaagtaatgtaccaggcgatcccctacagcagcgcccggccgtggctcatgccggcgcccgaggcgggcgtcgtctccgtgaagccggagccggaggcggcggcggcggccaccggcgcggaggagcccgcccggcccgacgccgcggcgggggacgacgacggcgggcgggcggaggtcgagagggccgtggccgagagcccggtgctggtggtggggcgccgcgggtgctgcctgagccacgtcgtgaagcggctgctgcaggggctcggggtgaacccggccgtgcacgaggtcgccgacgaggccgcgctcgccggggtcgtcccgcccggcggcgccgaggccgccgcgctgcccgcggtgttcgtcggcgggaagctcctgggcgggctcgaccggctcatggccgtccacatcgccggcgagctcgtgcccatcctcaagaaggccggcgccctctggctctaattcaaccaggcgtgtttctttctgtttctgccttccagtctcacagaaaagggccgttggatcgagagtattacatcacaccgcggcggatgatgatcatgtgctgtgctaggactttgttcgatttttctcttgatttaggggaagcaagaaagaaaatgataattcctcgcgttg

SEQ ID NO: 44231 - DNA, 581 bp, Panicum virgatum
  misc_feature: Ceres CLONE 2019990
  misc_feature: Encodes the peptide sequence at SEQ ID NO. 44232
acctcactcactcatccactgcaaatggcacacaggatgacctcctcttcttccttggtcctccttgcaggcaccctccttgcactggcctcatggcaacaggccgtcgcctacgatcctagccctctccaagatttctgtgttgcagacaagaactcgcctgtgcgtgtcaatgggtttccttgcaaggacccaatggcggtcaccccggatgacttcttcaacccagccatgatcatcgacaagcgccgggacaccaacaacaaggtcggatccaacgtcaccaacatcaacgttgagagcttcccgggcctcaacaccctaggtatctcgttggctcgcatcgactacgcacccctgggcgtaaacccacctcacatccacccccgcgccaccgagctcctcaccgtgctcgagggaacactctaccttggctttgtcacctccaaccccaacaggctcttctccaaggtggtcaagaagggtgacgtgttcgtcttccctaaggccatgattcacttccagatgaacctcgaccatgaaaagccagcggctgccttgtcttcgttcagcagcccaaa

SEQ ID NO: 44232 - protein, 181 aa, Panicum virgatum
  misc_feature: Ceres CLONE 2019990
  misc_feature (66)..(181): Pfam Name: Cupin_1 Pfam Description: Cupin
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MTSSSSLVLLAGTLLALASWQQAVAYDPSPLQDFCVADKNSPVRVNGFPCKDPMAVTPDDFFNPAMIIDKRRDTNNKVGSNVTNINVESFPGLNTLGISLARIDYAPLGVNPPHIHPRATELLTVLEGTLYLGFVTSNPNRLFSKVVKKGDVFVFPKAMIHFQMNLDHEKPAAALSSFSSP

SEQ ID NO: 44233 - DNA, 647 bp, Panicum virgatum
  misc_feature: Ceres CLONE 2019990-R
  misc_feature: Encodes the peptide sequence at SEQ ID NO. 44234
cgcggaggaagagcaagggataaagccctagagtttggcgagggagggcggagccgcggctgctggtcggtggtcgctacatcggatctccccgccgccgtcgcttgaacctaggcctttgttctccttccccgtgaggtgccgcaatggccgcgaaaggctcctcatccaacttggagaaggagcagatgttttggatggcggagaaggagatggagtacagggttgatctcttcaatagacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacctgggaagcactagttgcatttttgtagcataatctgtcgctctgtttccccattttggttggttttacaatgtggccacctgctagtaagtgctccaatacagcaccagtgacttgctaattcatggaccgcccaaaaggaaatcccaatgtcttgcactttccagggatgtgccttgtctatgaatcatgaacagcgaacatgcttgtaataatttgatacagctcgagagaacaattctgttgct

SEQ ID NO: 44234 - protein, 83 aa, Panicum virgatum; identical to SEQ ID NO: 44219
  misc_feature: Ceres CLONE 2019990-R
  misc_feature (14)..(80): Pfam Name: zf-Tim10_DDP Pfam Description: Tim10/DDP family zinc finger

SEQ ID NO: 44235 - DNA, 630 bp, Panicum virgatum
  misc_feature: Ceres CLONE 2019991
  misc_feature: Encodes the peptide sequence at SEQ ID NO. 44236
agcattctctttatcgtctttatcatcctccttattgtcactgctttcatcactgttgcactgacgtacttccagcttgctgccgaagatcatgagtggtggtggaggtcgttcctatgtggaggatcaactggtttctttgtctatggctactgcctgtactactactatgcacgatcagatatgtctggtttcatgcagacatctttcttctttggctacatggcctgcatctgctatgcattcttcttgatgcttgggatggtgggcttccacgccgccttgttctttgtccgccacatatacaaatccatcaagtgcgaatgagctgtttgtcggaagatgaagagcagcagagttgtacctgtttttggtgccactgagaagtccaaatatagaaaaggttagctctcgtgtgcaacaggagcagctagagattgccgtctttcagattaggccattatttataggaacaggtaatgcacctataaatttgttatgtttatgtgtctgctgtgataaaaatcgtctttcccttcgtcctatgtattatcccctagtgacggcagacagtaactttgttggaaccatgacatgcctgaatatctgtggaagacccatgttgtgttc

SEQ ID NO: 44236 - protein, 108 aa, Panicum virgatum
  misc_feature: Ceres CLONE 2019991
  misc_feature: Functional homolog of the protein sequence given in SEQ ID NO 50395
  misc_feature: Useful for making plants with altered cell wall content and/or composition
SILFIVFIILLIVTAFITVALTYFQLAAEDHEWWWRSFLCGGSTGFFVYGYCLYYYYARSDMSGFMQTSFFFGYMACICYAFFLMLGMVGFHAALFFVRHIYKSIKCE

SEQ ID NO: 44237 - DNA, 568 bp, Panicum virgatum
  misc_feature: Ceres CLONE 2019993
  misc_feature: Encodes the peptide sequence at SEQ ID NO. 44238
gaaaaatcatggtatgcatttccgtgtattagctaaagcattgcgtatgtcggggggagatcatatccacgccggtacagtagtaggtaagttagaaggggaacgcgaaataactttaggttttgttgatttattgcgcgatgatttcattgaaaaagatcgttctcgcggtatctttttcactcaggactgggtatccatgccaggtgttataccggtggcttcagggggtattcatgtttggcatatgccagctctgaccgaaatctttggagacgattccgtattacaatttggtggaggaaccttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtcctgaactagccgcagcttgtgaagtatggaaggcgatcacatttgatttcgcgccggtggataccatagataagtagataaaactagatataaagaaggtctaaataaaataaaaaagaagc

SEQ ID NO: 44238 - protein, 173 aa, Panicum virgatum
  misc_feature: Ceres CLONE 2019993
  misc_feature (1)..(158): Pfam Name: RuBisCO_large Pfam Description: Ribulose bisphosphate carboxylase large chain, catalytic domain
  misc_feature: SWISSPROT Homolog: EC 4.1.1.39 Ribulose-bisphosphate carboxylase
KNHGMHFRVLAKALRMSGGDHIHAGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSPELAAACEVWKAITFDFAPVDTIDK

SEQ ID NO: 44239 - DNA, 621 bp, Panicum virgatum
  misc_feature: Ceres CLONE 2019994-R
  misc_feature: Encodes the peptide sequence at SEQ ID NO. 44240
ctccccctctcccccgatggcccgcacgaagcagacggcgaggaagtccaccggcggcaaggcgccgaggaagcagctggcgacgaaggcggcgcgcaagtcggccccggcgaccggcggcgtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctccgcttccagagctcagccgtcgccgcgctgcaggaggcggccgaggcctacctcgtcgggctcttcgaggacaccaacctctgcgccatccacgccaagcgcgttaccatcatgcccaaagacatccagctcgcccgccgcatccgtggcgagagggcctaggcgccgtcgccgtggagtggaagtagtagaaatggtagcttgtcatctgtgtccaatcggaatggtgtagagatgtgctgggttccttagctttggttgttggtcgaatcaagaagtggttggttggtctcctgctgtaacttatcccattgtatcttcggtaccttggagttgcaatggatcaatgaaatggc

SEQ ID NO: 44240 - protein, 136 aa, Panicum virgatum; identical to SEQ ID NO: 10238
  misc_feature: Ceres CLONE 2019994-R
  misc_feature (58)..(132): Pfam Name: Histone Pfam Description: Core histone H2A/H2B/H3/H4

SEQ ID NO: 44241 - DNA, 665 bp, Panicum virgatum
  misc_feature: Ceres CLONE 2019994
agctagtgattcctttcctgcactaatgcaactcgactttactgcattcctgtgtcaaatgcccgggtgccactagggaacatccctaaaacaaaacagacaattgctataccactcgggttctccgtgttttactcagttaccctctcttacaacaggctcatgacgaccgaaaaatctgaagagaggaatgccactagcttctgcgatgaggatgtgtcttttctgaagaagagtgtgtagtgaccaagaactggatgcaccctccaactcaaactgcaacagataacatgcatggtcccatggtagtcaagtgccacgctgattgtgttggcgcgtgtactcccagacagcgatggcgccactgacatggacgttgagggacctcaccacgcccagctgcgggatctccacgcacccgtccaggacgtggatgatgtccacggggatgccttccttctcccggcccagcaccagcaccgtccgcctcgggaactcgaacctgtccaggggcctgctgtgggccgtctgctccagcccgatcaccgagtacccctgcgcccgcttcctctccaggtaggccttcacgctgtccaccgggacctccgagatgggcagccatttctcagcggttacactgccatttgcaacagccagcacagcac

SEQ ID NO: 44242 - DNA, 709 bp, Panicum virgatum
  misc_feature: Ceres CLONE 2019997
  misc_feature: Encodes the peptide sequence at SEQ ID NO. 44243
agaattcttctcgacaacccggttttgagcatcgcccaacgacaaaatgcctcccaagtctggtaagaaggccgctccggcccctttccctcaggggaaggctggctccaagaaggcccccaagaacccgctcatcgagaagcggccccggaacttcggtatcggccaggccatccagcccaagcgcaacttgtcgcgcatggttaagtggcccgagtatgtccgcctccagcgccaaaagaagatcctcaacatgcgcctgaaggtgccgcctgcgatcgcccaattccagcaggttcttgacaagaacactgccgcccaggctttcaagctcctcaacaagtaccgccctgagaccaagacggacaagaaggagcgtctcctcaaggaggccaccgccatcaaggagggcaagaagaaggaggacgtcagcaagaagccctacgtcgtcaagtacggcctcaaccacgttgtcggcctgatcgagaacaagaaggcctcgctcgtcctcatccccaacgatgtcgaccccattgagctcgtcatcttcctgcccgctctctgccgcaagatgggcatcccctatgccattatcaagggcaaggccaggctcggaaccgtcgtccacaagaagactgccgctgttctcgccatcaccgaggttcgctccgaggataagaacgagctgtctaagctcgtctccgccatc

SEQ ID NO: 44243 - protein, 220 aa, Panicum virgatum
  misc_feature: Ceres CLONE 2019997
  misc_feature (120)..(215): Pfam Name: Ribosomal_L7Ae Pfam Description: Ribosomal protein L7Ae/L30e/S12e/Gadd45 family
MPPKSGKKAAPAPFPQGKAGSKKAPKNPLIEKRPRNFGIGQAIQPKRNLSRMVKWPEYVRLQRQKKILNMRLKVPPAIAQFQQVLDKNTAAQAFKLLNKYRPETKTDKKERLLKEATAIKEGKKKEDVSKKPYVVKYGLNHVVGLIENKKASLVLIPNDVDPIELVIFLPALCRKMGIPYAIIKGKARLGTVVHKKTAAVLAITEVRSEDKNELSKLVSA

SEQ ID NO: 44244 - DNA, 695 bp, Panicum virgatum
  misc_feature: Ceres CLONE 2020002
  misc_feature: Encodes the peptide sequence at SEQ ID NO. 44245
gcacaaaccctcctcgcctccgccgccgctgccccgccgtcgccgaggaggaggaagaagaagaagaagaagaagaagcgccggccaagatgaagaccattctggcgtcggagaccatggacatcccggaggaggtcacggttaaggtggccgccaaggtggtgacggtggagggcccccgcgggaagctcacccgcaacttcaagcacctcaacctcgacttccagctgcaggacggcggccgcaagctcaaggtcgacgcctggttcggcacccgccgcaccatggccgccatccgcaccgccatctcccacgtccagaacctcatcaccggcgtcaccaagggttaccgctacaagatgaggttcgtctacgctcacttccccatcaacgcctccatcaccaacggcaacaccgccatcgagatcaggaacttcctgggcgagaagaaggtcaggaaggtggacatgcttgagggtgtgaccatcttgcggtccgagaaggtcaaggatgagctcatcctcgacggcaacgacatcgagctcgtctctcgctctgccgccctcatcaaccagaaatgccatgtgaagaacaaggatatcagaaagttcttggatggcatctacgtcagtgacaagggtgccattaacgaggagcagtgagcttgcctagtcattagctaaaaatgcctggag

SEQ ID NO: 44245 - protein, 190 aa, Panicum virgatum
  misc_feature: Ceres CLONE 2020002
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MKTILASETMDIPEEVTVKVAAKVVTVEGPRGKLTRNFKHLNLDFQLQDGGRKLKVDAWFGTRRTMAAIRTAISHVQNLITGVTKGYRYKMRFVYAHFPINASITNGNTAIEIRNFLGEKKVRKVDMLEGVTILRSEKVKDELILDGNDIELVSRSAALINQKCHVKNKDIRKFLDGIYVSDKGAINEEQ

SEQ ID NO: 44246 - DNA, 526 bp, Panicum virgatum
  misc_feature: Ceres CLONE 2020008
  misc_feature: Encodes the peptide sequence at SEQ ID NO. 44247
gcaggaattcaggatattcttcataaaatcaggccaaataaattaaacctggccaggcttgactatgctgcaaatgagggttggaaaactttcctttcttataagaatacccaacaggatatcctgattggcctactgcccttgcttaaatgtggccgtaatgttccttgccctgaactataaggaaggggttcaattgtccttaaccttcatgtctatgaaactgcatcccctgtgcatggccttaatgcaaataacctccaccaccagggttatgaaattctactaatgaaaaaaccaaaaaaaatccctcaaaggaaacaccgttccaaaaaattggttgtaatttcaggagttggacctccccactattaccgcaagttgggttataaccttgaagggccttacttggccaagggtttggcatgatgtcttttcatttttcatgaaatcatgtaaagcaaactaccgccggtcatgtaacattagaagtttttaaaaatgtttttcattaattaatgcaaat

SEQ ID NO: 44247 - protein, 60 aa, Panicum virgatum
  misc_feature: Ceres CLONE 2020008
  misc_feature: SWISSPROT Homolog: EC 2.3.1.48 Histone acetyltransferase
AGIQDILHKIRPNKLNLARLDYAANEGWKTFLSYKNTQQDILIGLLPLLKCGRNVPCPEL

SEQ ID NO: 44248 - DNA, 704 bp, Panicum virgatum
  misc_feature: Ceres CLONE 2020013
  misc_feature: Encodes the peptide sequence at SEQ ID NO. 44249
gcatttccatcatattgacttgcaatccttctattcagtatactgtatttgatcagctcaagcaaaggataattcagaggcagcgacgtaaaaatggaggatcagcagacgataactcccgagttgctctgtctgctttctcagcttttctccttggggctgtctccaaaagtattgctacagtattgacttatccattaatcaggtgcaaggtgatgattcaggctgcagaccttgatgaggatgaggatgatgaatctgaaaggccaaggaaatcaagagcacccaaaacgatgctaggtgccttgcatgctatctggagcaaggaaggcattccaggcttcttcaaaggtctacatgctcagatcctgaaaacagttctgagctccgcattgctgctgatgataaaggagaagatctcgaagttcacatgggtctcactgcttgccctgcgccgttatcttttcgtttctcagaagaggatcaagtctgcagaactgtaaattgttagcttcaaacaactagcaccccatagtaacatggtgcatctggagttcatataccaaggaataaatctgtggaataacgatcagaactacagaaggaaaaaggtttgatttatatgtggctggttggcctttttttcccgagaatactacgtgggggactgggggtcatgttgatagcgtcagggagtgttcttc

SEQ ID NO: 44249 - protein, 166 aa, Panicum virgatum
  misc_feature: Ceres CLONE 2020013
  misc_feature (44)..(147): Pfam Name: Mito_carr Pfam Description: Mitochondrial carrier protein
ISIILTCNPSIQYTVFDQLKQRIIQRQRRKNGGSADDNSRVALSAFSAFLLGAVSKSIATVLTYPLIRCKVMIQAADLDEDEDDESERPRKSRAPKTMLGALHAIWSKEGIPGFFKGLHAQILKTVLSSALLLMIKEKISKFTWVSLLALRRYLFVSQKRIKSAEL

SEQ ID NO: 44250 - DNA, 489 bp, Panicum virgatum
  misc_feature: Ceres CLONE 2020016
  misc_feature: Encodes the peptide sequence at SEQ ID NO. 44251
ggctgggctggcgtagtctggctctacagcatcgtcttctacttccctctcgacttgttcaagttcttcatccgcttcgtgctcagcggcagggcctgggacaacctcctcgagaacaagactgccttcaccaccaagaaggattacgggcgggaagagagggaggcgcagtgggccaccgcccagaggaccctccacgggctgcagcctccggaggtggcctccaacacgctgttccaagacaagagcagctaccgcgagctgtcggagatcgcggagcaggccaagagacgagctgagatcgcgaggctgcgggagctcaacacgctcaagggccacgtggagtcggtggtgaagctcaagggcctggacatcgacaccatccagcagaactacacggtgtgaggcgcgcgccgccgggacgtcgacgaaacctttgcttgcccccgtactgcgaacggagtcgtctgaattgaaaccaaaccaaac

SEQ ID NO: 44251 - protein, 134 aa, Panicum virgatum
  misc_feature: Ceres CLONE 2020016
  misc_feature: SWISSPROT Homolog: EC 3.6.3.6 Proton-exporting ATPase
GWAGVVWLYSIVFYFPLDLFKFFIRFVLSGRAWDNLLENKTAFTTKKDYGREEREAQWATAQRTLHGLQPPEVASNTLFQDKSSYRELSEIAEQAKRRAEIARLRELNTLKGHVESVVKLKGLDIDTIQQNYTV

SEQ ID NO: 44252 - DNA, 686 bp, Panicum virgatum
  misc_feature: Ceres CLONE 2020021
  misc_feature: Encodes the peptide sequence at SEQ ID NO. 44253
ccctctacctccgtcccactcctgctcgctgctcccacgacacagccgcgcacgagcccctgcacctaccccttcgaggatgagccgcagcctcgggatcccggtgaagctgctgcacgaggcggcgggccacgtcgtcacggtcgagctcaagaccggcgaggtctaccgcggcgccatggtcgagtgcgaggacaactggaactgccagctcgacaacatcaccttcacggcaaaggacggcaaggtgtcgcagctggagcacgtcttcatcagggggagcagggtcaggttcatgatcatacccgacatgctcaagaacgcccccatgtttaagcgcctcgaggccaggattaggggtaaaggctcagctgttggggttggccgtggccgtgcggtcgccatgcgtgctcgggctgctgctggtcgcggtggtggtccggttggacggggcagtgcaccccctgtgaggaggtagatctgtctaaaggatcgtgcacacggttatctggcgaaccaagtttgtgtcttgttatgaaaactttgcttgggcagccaggcttgtaaggtagcttatgtgtatctctgcagtagtttgtgttttacagaatggatgtgtgactttggtgtctttgacccgtggtggattgctcttgagctaatgtgctgttaggtttaagcatgat

SEQ ID NO: 44253 - protein, 132 aa, Panicum virgatum
  misc_feature: Ceres CLONE 2020021
  misc_feature (10)..(75): Pfam Name: LSM Pfam Description: LSM domain
MSRSLGIPVKLLHEAAGHVVTVELKTGEVYRGAMVECEDNWNCQLDNITFTAKDGKVSQLEHVFIRGSRVRFMIIPDMLKNAPMFKRLEARIRGKGSAVGVGRGRAVAMRARAAAGRGGGPVGRGSAPPVRR

SEQ ID NO: 44254 - DNA, 693 bp, Panicum virgatum
  misc_feature: Ceres CLONE 2020026
  misc_feature: Encodes the peptide sequence at SEQ ID NO. 44255
gtgagacccaaccacaagagcggcggcgcgggcggaccaggaggaggccgcggagcagccgggcaaggccaccgctgccaccatgggtatctcgcgtgactcgatgcacaagcgccgggccaccggtgggaagcagaaggcctggaggaagaagcgaaagtatgagcttggccgccagccagccaacaccaagttgtcaagcaacaagacggtgaggagggtccgtgtccgaggaggtaatgtgaagtggagggctctccgcctagataccggtaactactcatggggtagtgaggctgttacccgcaagacccgtatcctggatgttgtctacaatgcgtcaaacaatgagcttgttcggacccagacccttgtgaagagcgccattgtgcaagttgatgctgccccattcaagcagtggtacctcactcactatggagtggacattggtaggaagaagaagggcctggctgctaagaaggatgctgctgagggtcaagagggtgaggccgcagctgaggaaaccaagaagagtaaccatgtccagaggaagcttgagaagcgccagcagggacgcacacttgacccgcacattgaggagcaatttggaagtggaaggttgttggcatgcattgcttctcgccctgggcagtgtggccgagctgacggttacatcattgagggtaaagagct

SEQ ID NO: 44255 - protein, 203 aa, Panicum virgatum
  misc_feature: Ceres CLONE 2020026
  misc_feature (1)..(199): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKGLAAKKDAAEGQEGEAAAEETKKSNHVQRKLEKRQQGRTLDPHIEEQFGSGRLLACIASRPGQCGRADGYIIEGKE

SEQ ID NO: 44256 - DNA, 593 bp, Panicum virgatum
  misc_feature: Ceres CLONE 2020029
  misc_feature: Encodes the peptide sequence at SEQ ID NO. 44257
agagagcgcggtggtggtgttcagcgtgagcagctgctgcatgtgccacgccgtgaagcggctcttctgcggcatgggcgtgcacccgacggtgcacgagctggacctcgacccgcgcggccgggagctggagcgcgccctcgcccgcctcctcggctacggccccggcggcgcgcccgtcgtccccgtcgtcttcatcggcggcaagctcgtcggcgccatggaccgcgtcatggccgcgcacatcaacggctccctcgtcccgctcctcaaggaggccggcgcgctctggctctgagctgcaggccggccgcgcgccatcgcccttgctgctgctgagctggctcgtggcaacaagctacgcagcttcgttctccgttgttcttacctgttgttgttgttgctgctgcacaacttgatgtcacttgccacaagcaagctaatcaaactaaggtgataggaggatataatattatccatcgacagggtgatggtaggtcactgagctgatgagttgctgtgtgtgtgacagtgtgtgtgtgcgcgcgcgcgcgcaagagagaggctggtaccgtatgtgcttttttctcacc

SEQ ID NO: 44257 - protein, 98 aa, Panicum virgatum
  misc_feature: Ceres CLONE 2020029
  misc_feature (4)..(71): Pfam Name: Glutaredoxin Pfam Description: Glutaredoxin
  misc_feature: Functional homolog of the protein sequence given in SEQ ID NO 51226
  misc_feature: Useful for making plants with altered protein content
ESAVVVFSVSSCCMCHAVKRLFCGMGVHPTVHELDLDPRGRELERALARLLGYGPGGAPVVPVVFIGGKLVGAMDRVMAAHINGSLVPLLKEAGALWL

SEQ ID NO: 44258 - DNA, 690 bp, Panicum virgatum
  misc_feature: Ceres CLONE 2020035
  misc_feature: Encodes the peptide sequence at SEQ ID NO. 44259
ctttctctcttctctccccgcttccagctgcatcctcccctgccacagctgaggcttcattaggcatcatgtacacggctcgcagaaagatccagaaggaaaagaacgccgaacccaccgagttcgagctgcaggtcgcccaggccctgttcgacctcgaggtcaacgccaccgatcttaagggcgacctcaaggagctgttcatcagcggtgccaggcaggtcgacctcggtggtggcaagaccgccatcctcgtcttcgtgcccttccgtctgctcaagggcttccacaaggtccagggccgtctcgtccgcgagctcgagaagaagttcagcggccagcacgtcgtcgtgatcgccaaccgtcgcatcctccccgtcatcggcaagaagaacaggacgaagaggcagaagaggcccatgagccgcaccctcaccgctgtacatgatgccatccttgaggacctcgtctaccccaccgagatcaccggcaagcgcatccgtgtcaggctcgatggctccaggctctacaaggtgtacctcgacaagaaggaccagaacaacgttgagtacaagctcgagaccttcgccaggctctacaagaagctcaccggcaaggaggtcgctttcctgttcccctaaagcactccaaccctcacaaaaaacacattaaatgctccttctctgatcg

SEQ ID NO: 44259 - protein, 190 aa, Panicum virgatum
  misc_feature: Ceres CLONE 2020035
  misc_feature (6)..(190): Pfam Name: Ribosomal_S7e Pfam Description: Ribosomal protein S7e
  misc_feature: Functional homolog of the protein sequence given in SEQ ID NO 50192
  misc_feature: Useful for making plants with modulated biomass
MYTARRKIQKEKNAEPTEFELQVAQALFDLEVNATDLKGDLKELFISGARQVDLGGGKTAILVFVPFRLLKGFHKVQGRLVRELEKKFSGQHVVVIANRRILPVIGKKNRTKRQKRPMSRTLTAVHDAILEDLVYPTEITGKRIRVRLDGSRLYKVYLDKKDQNNVEYKLETFARLYKKLTGKEVAFLFP

SEQ ID NO: 44260 - DNA, 511 bp, Panicum virgatum
  misc_feature: Ceres CLONE 2020035-R
gtgctatactgccgatgctccaagctgaagaggatgaaagatttgtcaaagagtggaagaagtatcttgaggaggaggccaggatcatgaaagatgttccaggatggaaggttggcgagagcgtgtacaactctgggaaatggatgcctccggctactggtgaactccgccctgaggtttggtaagggcctactgccagcgctgataatttcatcatgtcatgaggacatgaataaggcctctaaacctgtgtacctttatttttttcctttaccaaggatcgactccttaaacacctctgtttgttgtggtgtatgaaatttgactggctaataattggacatatcaagccgacttccttgtcttccgaattttgaactgtgcttgcacgttgatgacgatgcaacatcatttccttgatgtatgtcgtgactgcctcaggagtttcttggaaacccatgtatgcgagaaagtatgggatataaagaagatatccttgtgtgtttttaag

SEQ ID NO: 44261 - DNA, 738 bp, Panicum virgatum
  misc_feature: Ceres CLONE 2020044
  misc_feature: Encodes the peptide sequence at SEQ ID NO. 44262
  misc_feature (549)..(549): n is a, c, t, g, unknown, or other
taaagctggagcagaaggggaccggaccaggagcaaggagctcccacgccatcaccctcgtcggcgacacggcctacgcgttcggcggcgagctcaccccgcgcgtgccggtggacaacaccatgtacgccttcgacctccagacccagacctggtcgccggtcgccgccacgggcgacgtgcctccgccgcgcgtcggcgtgaccatggcggccgtcggcggcacggtgtacgtctccggccgcctgaacgacctgtgggggtacgacgtggccgccgggcggtgggagcagctgccgccgccgggggaggcggcgtgccgcccgcgcggcggggccgggctggccgtcgccggcgggaagctgtgggtggtgtatggcttcggcggggaggagctcgacgacgtgcactgctacgacccggccaccgggcggtggtcggcggtggagaccgccggcgacaagccgagcccccgcagcgtgttctgcgccgtcgggatcggggcgcgcgtcgtcgtgttcggcggcgaggtggaccccagtgacctgngccacctcggcgccggcaagttctcggccgaggcgttcgcgctggacacggggaccggcgcgtggacgcgcctggaagacggcgccgccggggccggggccgagcaccacccggggcctcgcgggtggtgcgcgttcgcggcgggggagaaggacggccggcgagggctgctgatctacggcgggcact

SEQ ID NO: 44262 - protein, 245 aa, Panicum virgatum
  misc_feature: Ceres CLONE 2020044
  misc_feature (11)..(58): Pfam Name: Kelch_1 Pfam Description: Kelch motif
  misc_feature (63)..(102): Pfam Name: Kelch_1 Pfam Description: Kelch motif
  misc_feature (108)..(152): Pfam Name: Kelch_1 Pfam Description: Kelch motif
  misc_feature: SWISSPROT Homolog: EC 3.1.3.16 Phosphoprotein phosphatase
  misc_feature (183)..(183): Xaa is any aa, unknown, or other
KLEQKGTGPGARSSHAITLVGDTAYAFGGELTPRVPVDNTMYAFDLQTQTWSPVAATGDVPPPRVGVTMAAVGGTVYVSGRLNDLWGYDVAAGRWEQLPPPGEAACRPRGGAGLAVAGGKLWVVYGFGGEELDDVHCYDPATGRWSAVETAGDKPSPRSVFCAVGIGARVVVFGGEVDPSDLXHLGAGKFSAEAFALDTGTGAWTRLEDGAAGAGAEHHPGPRGWCAFAAGEKDGRRGLLIYGGH

SEQ ID NO: 44263 - DNA, 697 bp, Panicum virgatum
  misc_feature: Ceres CLONE 2020048
  misc_feature: Encodes the peptide sequence at SEQ ID NO. 44264
acaagcaaagcacactcccagcttcccagaccagctcttgctctcttcactagcttccagcaacagcttgcacagccagcctgctcagaatgggcaaggaggtggacgtgtccaccctcgaggctggcggcgcccgcgactacgccgacccgccgccggcgccgctggtggacatcgacgagctctgcaagtggtccctgtaccgcgccgtgatcgccgagttcgtggccacgctgctgttcctgtacatcacggtggcgacggtgatcgggtacaagcaccagacggacgcgtcggcgtcgggccccgacgcggcgtgcggcggcgtgggcatcctcggcatcgcgtgggcgttcggcggcatgatcttcatcctcgtctactgcaccgcggggatctctggcggccacatcaacccggcggtcaccttcgggctgttcctggcgcgcaaggtgtccctggtgcgcgccgtcctgtacatggcggcgcagtgcctgggcgccatctgcggcgtcgcgctcgtcaagggctttcagagcggcttctacgcgcgctatggcggcggcgccaacgaggtcagtgccggctactccaccggcacggggctcgccgccgagatcgtcggcaccttcgtgctcgtctacaccgtcttctccgccaccgacccaaagcgcaacgcccgcgactcccacgtccc

SEQ ID NO: 44264 - protein, 202 aa, Panicum virgatum
  misc_feature: Ceres CLONE 2020048
  misc_feature (31)..(202): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
MGKEVDVSTLEAGGARDYADPPPAPLVDIDELCKWSLYRAVIAEFVATLLFLYITVATVIGYKHQTDASASGPDAACGGVGILGIAWAFGGMIFILVYCTAGISGGHINPAVTFGLFLARKVSLVRAVLYMAAQCLGAICGVALVKGFQSGFYARYGGGANEVSAGYSTGTGLAAEIVGTFVLVYTVFSATDPKRNARDSHV

SEQ ID NO: 44265 - DNA, 734 bp, Panicum virgatum
  misc_feature: Ceres CLONE 2020058
  misc_feature: Encodes the peptide sequence at SEQ ID NO. 44266
gaaacgccagctagcccgattcgcctgggcccagcccaagctagggtttcctccgccgcgccggcgcttggccacaacccccagccgccgccatgtacaacggcatagggctgcagacccctcgggggtccggcacgagcgggcacgtccaggcgagcaagttcctcgccaagccccggccgtcctcctccgcggtcggcggcggcgggacccccgacctgccgcgcaccggctccggcctcgaagggatgcggaagccgaacaaggacatcctggagcacgaccggaagcggcaggtggagctgcggctgctcgtgctgagggacgcgctcgaggagcaagggtacacggaggccgagatcgaggtgcgcgtcgaggaggagcgcaaggccgccgagaccgaggcggcggcggaggaaggccggcctgctgcccagggcaaagggttcaaggacacgcatggtcaccatgccgcagcgcggaaggagaaccagctgcagactatgaggggtgctcttgggctagatcctgaggatgtgcagaagaaaggggggctttagaaagtgatgtggagcctggagagcttgttccaatgaagcaggggacgatgactatgaaacgactagcagcaagacctgtaggaagggtaaagcatgaatgtaatttagatgcagacaatgatcttgacatcaagaagacggagatgtaggagagttgggtctttgtgtacttac

SEQ ID NO: 44266 - protein, 155 aa, Panicum virgatum
  misc_feature: Ceres CLONE 2020058
  misc_feature (54)..(98): Pfam Name: cwf21 Pfam Description: cwf21
MYNGIGLQTPRGSGTSGHVQASKFLAKPRPSSSAVGGGGTPDLPRTGSGLEGMRKPNKDILEHDRKRQVELRLLVLRDALEEQGYTEAEIEVRVEEERKAAETEAAAEEGRPAAQGKGFKDTHGHHAAARKENQLQTMRGALGLDPEDVQKKGGL

SEQ ID NO: 44267 - DNA, 740 bp, Panicum virgatum
  misc_feature: Ceres CLONE 2020060
  misc_feature: Encodes the peptide sequence at SEQ ID NO. 44268
ctgaagcaagcaagcaagcaaccgagctcaactactgatgctcacctcagctgctagctcctcacaacaacgcagggggccggggggcgccatggacctccccgtggcgctcgcgatcctcttcttctgcgtcctcctcctctcctccgccgccatcgccgtcctcctcgtccgccgctgcctcgccgccctccggcgccccgacgccgaccccgaggcgcgagcggtcgtgccccagcggccgcagtacgagctggccttgtcagcggaggcggcagccgcagagcaagcgaccgaccgcaaggacgcgccgcggcggctcacgtggcgggaggtggaggcgctgaccggcggcttcgacgaggcggccgtcgtgggcaggggcggctccagcaccgtctacctcgccaggctccgggacggcgcgcccgtcgccgtcaaggtgcaccgctggtgcggcggcgagcgccgcctgcgcgcgttccggcaggagctcgacctgctccgccgcatccgccacccgcgcatcgtcgcgctcatcgcctactccgacgaccacggtgcgtgcgtgcgagcttcaaatcatttttttatttaatttgtctccctccgtggctccgttgattagtgctagttttctcctctctattaatttctttccccctcgtcgtaataaatcaaagaaatgatgagtgaagaagctttcaccctacgcttacgttacctgctccatctgcttc

SEQ ID NO: 44268 - protein, 168 aa, Panicum virgatum
  misc_feature: Ceres CLONE 2020060
  misc_feature: SWISSPROT Homolog: EC 2.7.11.1 Non-specific serine/threonine protein kinase
MDLPVALAILFFCVLLLSSAAIAVLLVRRCLAALRRPDADPEARAVVPQRPQYELALSAEAAAAEQATDRKDAPRRLTWREVEALTGGFDEAAVVGRGGSSTVYLARLRDGAPVAVKVHRWCGGERRLRAFRQELDLLRRIRHPRIVALIAYSDDHGACVRASNHFFI

SEQ ID NO: 44269 - DNA, 509 bp, Panicum virgatum
  misc_feature: Ceres CLONE 2020078
  misc_feature: Encodes the peptide sequence at SEQ ID NO. 44270
aaggacaagagcttctttgactcgcttgattcagatggaacttgccctccatggctatcagaggaagatatttcctactacgcagaaaagtttgcaaagacaggttttactggaggatttaattactacagatgcatggacctgaactgggagcttgctgcaccatggactggtgctccagtaaaagttccaacaaaattcattgttggggacctagacattacatacaacaccccgggggtacaggactacattcacaaaggtggcttcaaggcaagcgtgccaaatcttgaggatgttgttgtcatggagggagtaagccacttcatcaaccaggagaagcctagtgaggtctctgatcacatttgtgagttctttagcaagttctgatataaggaaaatcctattgatcctataggctttcgggctgcttatatatgtcaaatacagttgtgagatcaccatactgattatgatataaataaaatacaatctctctcttggagcag

SEQ ID NO: 44270 - protein, 129 aa, Panicum virgatum
  misc_feature: Ceres CLONE 2020078
  misc_feature: SWISSPROT Homolog: EC 3.3.2.10 Soluble epoxide hydrolase
KDKSFFDSLDSDGTCPPWLSEEDISYYAEKFAKTGFTGGFNYYRCMDLNWELAAPWTGAPVKVPTKFIVGDLDITYNTPGVQDYIHKGGFKASVPNLEDVVVMEGVSHFINQEKPSEVSDHICEFFSKF

SEQ ID NO: 44271 - DNA, 496 bp, Panicum virgatum
  misc_feature: Ceres CLONE 2020103
  misc_feature: Encodes the peptide sequence at SEQ ID NO. 44272
acagccacaccacgcacagagagacgcagcagcagcagcagcagcagcagggcactacgactcgtactagctagctagctagctactcgtagcagctgctagctgcaggtaaccatggcgaagaagaaagccgccgtggtcgccacgctcctggccctgaacctcctcttcttcgccttcgccaacgcctgcggctgccagtgcggcgcctgccctagtccaggcggcggcggaaggggaggaggaggaggcagtgggggtggtggatctggcggcgggggaggcagcggtggtggtggcggcggcagcggaggcgggggaggcagcggtggaggcggcggcggagggagcagcggcggaggaggaggaggcagtgggggtggtggatctggcggccggagaggcagcggtggtggtggcggcagcagcggaagcgggggaggcagctgaggagggagcagcggcggccgtcgcggaaggagcaacggcggaggag

SEQ ID NO: 44272 - protein, 111 aa, Panicum virgatum
  misc_feature: Ceres CLONE 2020103
  misc_feature: Functional homolog of the protein sequence given in SEQ ID NO 50702
  misc_feature: Useful for making plants with altered lignin content
MAKKKAAVVATLLALNLLFFAFANACGCQCGACPSPGGGGRGGGGGSGGGGSGGGGGSGGGGGGSGGGGGSGGGGGGGSSGGGGGGSGGGGSGGRRGSGGGGGSSGSGGGS

SEQ ID NO: 44273 - DNA, 697 bp, Panicum virgatum
  misc_feature: Ceres CLONE 2020104
  misc_feature: Encodes the peptide sequence at SEQ ID NO. 44274
gggtatagcaaagtggttaatgatgcatctttctaagatacttcgaaattttcggaggaagaggtcaaaaatacttcgattaattaaaacaaaatattaggatcacgcaatgcaatcgtcaacccccgttcccaagaacactccggcggctccccaccgacagcgctcgatcgagctaagcttggtcgcccggccgcgtgcaaaagatctatccatggcgcggctcccgcgactgcccgccgcggcggcctttgccgtggccgtcctcctctcggccgccgcgctgccggcggcgcgggccgcgtcgccggcggcggacgacgcgcccgagtaccggaaccacaccgtgggcggcgccgacggctggttcttcgacgccaggaccaatgccacctccggaaactactccggttgggccaacggcgagacgttctacctcggtgactacctcatattcaagacgaacgacaactcgtcggtggtgcacaccaccaatgccaccacctacgacctctgcgacccctccgacgacctgtctccggccacctacatctacagcggcggcggcctcgaggagaacaacaccatcccggtccctctcgtcgaggagggcgcccactacttcttctccgacgccgacggcggcgcgcagtgcccgcaggggatgcgcttcgagatcaagggcgaacacggccaa

SEQ ID NO: 44274 - protein, 160 aa, Panicum virgatum
  misc_feature: Ceres CLONE 2020104
  misc_feature (51)..(151): Pfam Name: Cu_bind_like Pfam Description: Plastocyanin-like domain
MARLPRLPAAAAFAVAVLLSAAALPAARAASPAADDAPEYRNHTVGGADGWFFDARTNATSGNYSGWANGETFYLGDYLIFKTNDNSSVVHTTNATTYDLCDPSDDLSPATYIYSGGGLEENNTIPVPLVEEGAHYFFSDADGGAQCPQGMRFEIKGEHG

SEQ ID NO: 44275 - DNA, 691 bp, Panicum virgatum
  misc_feature: Ceres CLONE 2020112
  misc_feature: Encodes the peptide sequence at SEQ ID NO. 44276
ctctcatcccaaagttccagtcggacctctccgcccgctaccacctcctcccgccgccggggccgacgccgccgccgccgcctcggcgcgggcgctcctcaccatcgacctcccggcggtgacggcggacctcatcgacgcgctcccggcgatggagctggtggtggcctcgtccgtcggcgtcgaccacgtcgacctcgccgcgtgccggcgccgcgggatccgggtcaccaacgccggggacgcgttcgcggccgacgctgcggattacgccgtcgggctggccgtcgccgcgctccgccgcgttcccgcagccgacgcctacgtccgccgcggcggctgggtggcccacggcgagtacccgctcgccaccaaggtgagcggcaagcgcgtggggatcgtgggtctcggccgcatcggctcgcaggtggctcggcgcctcgccgccttcgggtgccccgtcgcctaccactcgcggtcgcccaagccgtcgtcaccctacaggttcgtccccacggtgcgcgccctggccgcggacagcgacgtgctggtgctgtcgtgcgcgctgacggaggagacgcggcgcgtggtggggcgggaggtgatggaggcgctgggcaaggacggcgtgctcgtccacgttggccgcggcgggctggtggacgagccggagctggtgcgctgcctgcgg

SEQ ID NO: 44276 - protein, 229 aa, Panicum virgatum
  misc_feature: Ceres CLONE 2020112
  misc_feature (92)..(229): Pfam Name: 2-Hacid_dh_C Pfam Description: D-isomer specific 2-hydroxyacid dehydrogenase, NAD binding domain
  misc_feature: SWISSPROT Homolog: EC 1.1.1.26 Glyoxylate reductase
SHPKVPVGPLRPLPPPPAAGADAAAAASARALLTIDLPAVTADLIDALPAMELVVASSVGVDHVDLAACRRRGIRVTNAGDAFAADAADYAVGLAVAALRRVPAADAYVRRGGWVAHGEYPLATKVSGKRVGIVGLGRIGSQVARRLAAFGCPVAYHSRSPKPSSPYRFVPTVRALAADSDVLVLSCALTEETRRVVGREVMEALGKDGVLVHVGRGGLVDEPELVRCL

SEQ ID NO: 44277 - DNA, 712 bp, Panicum virgatum
  misc_feature: Ceres CLONE 2020122
  misc_feature: Encodes the peptide sequence at SEQ ID NO. 44278
accctagtctccatccccccacccgccgcccctcaaccctacccagccgccgccgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagcagaggcgaagctcctcatacggcagggtggggcagctgccccagctatcggcgcagcagaaccccaccccgccttccgcccctcccatggcgacatggcattccaggcggctgtatgtccgccggaggaagaagacggcggtggctagtcgagacaggcagacgacccatttagtttttggcccactgaaattcgagtgagcttagcggagctgctccatccgcaaacgcaagcttcacgcacagcctctctccccgcagcttctccgccgggcttcacctgcgaacccgcctcgatcgatcagcgttccacgcggagcaggcagatggccgccacgatgaagctccggatcctcgccatcgccgt

SEQ ID NO: 44278 - protein, 149 aa, Panicum virgatum
  misc_feature: Ceres CLONE 2020122
  misc_feature (6)..(74): Pfam Name: ubiquitin Pfam Description: Ubiquitin family
  misc_feature: Functional homolog of the protein sequence given in SEQ ID NO 50134
  misc_feature: Useful for making plants with modulated cold sensitivity
  misc_feature: Useful for making plants with modulated flowering time
  misc_feature: Functional homolog of the protein sequence given in SEQ ID NO 50512
  misc_feature: Useful for making plants with modulated nitrogen use efficiency
MQIFVKTLTGKTITLEVESSDTIDNVKAKIQDKEGIPPDQQRLIFAGKQLEDGRTLADYNIQKESTLHLVLRLRGGAKKRKKKQRRSSSYGRVGQLPQLSAQQNPTPPSAPPMATWHSRRLYVRRRKKTAVASRDRQTTHLVFGPLKFE

SEQ ID NO: 44279 - DNA, 420 bp, Panicum virgatum
  misc_feature: Ceres CLONE 2020126
  misc_feature: Encodes the peptide sequence at SEQ ID NO. 44280
gtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgaccactcgctccacaacgccttcagcacctacggcgaggtcctcgagtcctagatcttcctcgatcgtgagacccacaggtcccgcggcttcggcttcgtcaccttctcgagcgagcaggcgaggcgctacgccatcgaggggatgaacggcacggagctggacggccgcaacatgaccgtctacgaggcccagacccgcggcggcccgcgctccggcggcggcaacggctacaacgcgctgctagggcggcagcgact

SEQ ID NO: 44280 - protein, 37 aa, Panicum virgatum
  misc_feature: Ceres CLONE 2020126
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDHSLHNAFSTYGEVLES

SEQ ID NO: 44281 - DNA, 645 bp, Panicum virgatum
  misc_feature: Ceres CLONE 2020129
  misc_feature: Encodes the peptide sequence at SEQ ID NO. 44282
atcccattccttccaagccacctctgctctgctcactctgtcctcgcggttgctaagctaagctaaactaagcaaagcttaaggcaagctaggcggcatgggcaaggacgacgtgatcgagggcggcgccggcggcggcgagttcgcggccaaggactacacggacccgcccccggcgccgctgatcgacgcggcggagctggggtcgtggtcgctgtaccgcgccatgatcgccgagttcatcgcgacgctgctcttcctctacaccgtcttctccgccaccgaccccaaacgcaacgcccgcgactcccacgtcccggtgctggcgccgctccccatcgggttcgccgtgttcatggtccacctggccaccatccccgtcaccggcaccggcatcaaccccgccaggagcctcggcgccgccgtcatctacaacaaggacaagccatgggatgaccactggatcttctgggtcggccccttcgtcggcgcggccatcgccgccttctaccaccagtacatcctccgggccggcgccatgaaggccctcggctccttccggagcaacgcgtgagccgcctgagtagccttcttcctgtgacctgtgagcttggaaaaggctgcgtgctgaagcaatggcggtcg

SEQ ID NO: 44282 - protein, 158 aa, Panicum virgatum
  misc_feature: Ceres CLONE 2020129
  misc_feature (3)..(139): Pfam Name: MIP Pfam Description: Major intrinsic protein
  misc_feature: Functional homolog of the protein sequence given in SEQ ID NO 50196
  misc_feature: Useful for making plants with modulated drought sensitivity
MGKDDVIEGGAGGGEFAAKDYTDPPPAPLIDAAELGSWSLYRAMIAEFIATLLFLYTVFSATDPKRNARDSHVPVLAPLPIGFAVFMVHLATIPVTGTGINPARSLGAAVIYNKDKPWDDHWIFWVGPFVGAAIAAFYHQYILRAGAMKALGSFRSNA

SEQ ID NO: 44283 - DNA, 743 bp, Panicum virgatum
  misc_feature: Ceres CLONE 2020131
  misc_feature: Encodes the peptide sequence at SEQ ID NO. 44284
aagaaggaaaagtactggatctagatgggaaaatgtggcctgatgcttctgatactgatgcttcctcccactataaggttcctttctcaagaactgtctacattgagaaaactgattttcgcctaaaggactcgaaagattactatggtctagcccctggtaaatctgtcatgctaaggtatgcattccccataaaatgcacagatgttatctatgttgatagtcctgatgatattgtcgaaattcgagctgaatatgaccctttgaagacttctaaacttaagggtgttctgcactgggttgctgagccgacacctggcgtcgaaccgttaaaggtggaagttagattgttcgagaagctgttcatgtcagagaatcccgctgaattggaggattggctgggggatcttaacccgaactcaaaagaggtgataaaggatgcttatgctgtaccgtcacttgccactgcagttctgggtgacaagttccagtttgagcgccttggctactttgctgtggataccgactccacgccggagaagcttgtgttcaacagaacagttaccctccgtgattcgtttgggaaggctggacccaagtgacttctatctaattttgagagcgtcggttttgattgggtgcagactgcagaggcgcacctgaatcacctgatccatacaatttgtgaagcaaaatgatagtgtaatccatgatcacagttttttgcctctctccttgtgaat

SEQ ID NO: 44284 - protein, 199 aa, Panicum virgatum
  misc_feature: Ceres CLONE 2020131
  misc_feature (3)..(173): Pfam Name: tRNA-synt_1c_C Pfam Description: tRNA synthetases class I (E and Q), anti-codon binding domain
  misc_feature: SWISSPROT Homolog: EC 6.1.1.18 Glutamine--tRNA ligase
EGKVLDLDGKMWPDASDTDASSHYKVPFSRTVYIEKTDFRLKDSKDYYGLAPGKSVMLRYAFPIKCTDVIYVDSPDDIVEIRAEYDPLKTSKLKGVLHWVAEPTPGVEPLKVEVRLFEKLFMSENPAELEDWLGDLNPNSKEVIKDAYAVPSLATAVLGDKFQFERLGYFAVDTDSTPEKLVFNRTVTLRDSFGKAGPK

SEQ ID NO: 44285 - DNA, 392 bp, Panicum virgatum
  misc_feature: Ceres CLONE 2020132
  misc_feature: Encodes the peptide sequence at SEQ ID NO. 44286
attacagtacgcactccggctaacgcgccccgcactctctcacaaagctcaagcctttcgctcgctcgctcgctcgcggctacatctacaatggcgcgattccagctcgcggccctggccatggccatgctcttcgccgcggcggcggcgcaggccccggccgccaccccgacgccggcgcccagggcgtcccccccgccggcgactcctccgccgacaccggcgccggtgtctccgcccgcgcaggcccccgccgttcctcccccagccccggcacccacgagtcccgacccgacccccgaagctgctgacaccgaggcagcagagtccgccacctccaaggtgagctcaacctcggcgcccgccacaacgggcccctccccggcaactac

SEQ ID NO: 44286 - protein, 100 aa, Panicum virgatum
  misc_feature: Ceres CLONE 2020132
  misc_feature: Functional homolog of the protein sequence given in SEQ ID NO 50464
  misc_feature: Useful for making plants with altered carbohydrate content
  misc_feature: Functional homolog of the protein sequence given in SEQ ID NO 50194
  misc_feature: Useful for making plants with altered cell wall content and/or composition
MARFQLAALAMAMLFAAAAAQAPAATPTPAPRASPPPATPPPTPAPVSPPAQAPAVPPPAPAPTSPDPTPEAADTEAAESATSKVSSTSAPATTGPSPAT

SEQ ID NO: 44287 - DNA, 636 bp, Panicum virgatum
  misc_feature: Ceres CLONE 2020145
  misc_feature: Encodes the peptide sequence at SEQ ID NO. 44288
aatttgtaaacttcattaaaaagttttatcaaaccctcttcaacacatcctataaatgagagaagttatttctattcacgtcggtcaaggtggtatccaaatcggtaacgcctgttgggaactcttctgtttggaacacggtatccaacctgatggtcaaatgccctctgacaagactatcggtggtggtgatgatgctttcaacaccttcttctccgaaactggtgccggcaagcacgtccccagatccgtcttcctcgatttggaacccaccgtcgtcgatgaagttagaactggtacctacagacaattgttccaccccgaacaattgatctccggtaaggaagatgccgctaacaacttcgccagaggtcactacaccattggtaaggaaatcgtcgatctttgcttggacagaatcagaaagctcgctgataactgtactggtctccaaggtttcatggtcttcaacgctgtcggtggtggtaccggttccggtttgggctctctccttttggaaagactctccgtcgattacggcaagaagtccaagctcggcttcaccatctatccctctcccccagtctccactgccgtcgttgaaccttacaactctgtcttgtccactcactcccc

SEQ ID NO: 44288 - protein, 193 aa, Panicum virgatum
  misc_feature: Ceres CLONE 2020145
  misc_feature (49)..(193): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MREVISIHVGQGGIQIGNACWELFCLEHGIQPDGQMPSDKTIGGGDDAFNTFFSETGAGKHVPRSVFLDLEPTVVDEVRTGTYRQLFHPEQLISGKEDAANNFARGHYTIGKEIVDLCLDRIRKLADNCTGLQGFMVFNAVGGGTGSGLGSLLLERLSVDYGKKSKLGFTIYPSPPVSTAVVEPYNSVLSTHS

SEQ ID NO: 44289 - DNA, 426 bp, Panicum virgatum
  misc_feature: Ceres CLONE 2020154
  misc_feature: Encodes the peptide sequence at SEQ ID NO. 44290
gggttcagtagctgcatctacaccagaattctatgagtattgccacacaaaggaagagtacgaggaacatggagcaagcatatgcagaacaagcccagttttcaaaggaatgtactgaaattttctacacatcgcatcttccagtaggagctcgtttaggtttctttgaatagaatatagccaattttgattctttttgacccgtcccaaccattatcggggcatccagatagaaccgtagcgttgtttgtagtcgtctgttctgtattgcctgttgtgtatagccagcagcttggttcctgttcgaggtgcatgattgtagccagaaccttagacagttgggaggaatattggttttccttttctattagtttgtccaggcaaatttatgattttttgttaataaggattcaggttaaattttgg

SEQ ID NO: 44290 - protein, 38 aa, Panicum virgatum
  misc_feature: Ceres CLONE 2020154
  misc_feature: Functional homolog of the protein sequence given in SEQ ID NO 51690
  misc_feature: Useful for making plants with modulated flowering time
GSVAASTPEFYEYCHTKEEYEEHGASICRTSPVFKGMY

SEQ ID NO: 44291 - DNA, 720 bp, Panicum virgatum
  misc_feature: Ceres CLONE 2020160
  misc_feature: Encodes the peptide sequence at SEQ ID NO. 44292
aaaaaaaaagccaagaaacgcatttattttgcaatggcagattggcacgcggaccgagtactcggtttccaccatgattagctccatggatactgtgccatgtgaccatctacatctaacatcggcacgacgactactataccgatgcccaactgcatgctcaaactcctctgccttggcttactcccggcactcctataagaagaccggcagtctcgtccctttccatcaccaccaaacagcaggcaaacacacagcacatcctcctgacatccaacgagtacatacatacgagcagcttagtagtagaacgaagctgagatcatcgatatggtggccgcccaggcagctgctgcgctcgttcttgggctcctcctcgccgtgcttgtcgcgcatggcgcccgcgcgcagtcggcgaacgacacctcccccgccgtccgccaactcctcggctccggcggcggctggctcccggccaaggccacctggtacggcgcgcccaacggcgccggccccgacgacaacggtggcgcgtgtggcttcaagggcaccaaccagtacccgttcatgtccatgacgtcgtgcggcaacgagcccctgttccaggacggccagggctgcggcgcatgctacgagataaagtgcaccagcaaggacaaccccgcctgctccgggcagccccagcgggtgatgatcacggacatgaactactacccgggg

SEQ ID NO: 44292 - protein, 129 aa, Panicum virgatum
  misc_feature: Ceres CLONE 2020160
  misc_feature (83)..(129): Pfam Name: DPBB_1 Pfam Description: Rare lipoprotein A (RlpA)-like double-psi beta-barrel
  misc_feature: Functional homolog of the protein sequence given in SEQ ID NO 51060
  misc_feature: Useful for making plants with altered carbohydrate content
MVAAQAAAALVLGLLLAVLVAHGARAQSANDTSPAVRQLLGSGGGWLPAKATWYGAPNGAGPDDNGGACGFKGTNQYPFMSMTSCGNEPLFQDGQGCGACYEIKCTSKDNPACSGQPQRVMITDMNYYP

SEQ ID NO: 44293 - DNA, 600 bp, Panicum virgatum
  misc_feature: Ceres CLONE 2020165
  misc_feature: Encodes the peptide sequence at SEQ ID NO. 44294
tcccccaaccctagccgccgcgccgccgccgcttctcctcctcgcttgaaggcaggagcttgtgaagggtccatcagactgagaagatggttcttaagactgaactttgccgttttagtggccagaagatatatccagggaagggtattaggttcattcgtgctgattcccaggttttcctttttgctaactcaaaatgcaagcgttacttccacaaccgcctgaagcctgcgaagcttacctggacagctatgtacaggaagcagcacaagaaggacattcatgctgaagctgtgaaaaagaggcgtcggaccaccaagaaagcggaggtggcgaaatctcagaagacacaaaccaagggtgcagcaccgaagggtcctaagggccccaagattggtggtggtggtgggaagcgctgaatgcccattgcatcatagagatatagttctgtcaactagccttctctcccatcctatcttagacattggtcaaattagtctgctgtcttgagttttcacctttctgatgagattggtgtcctgaatgttttggattgtttcttgagttgatttaaattggcacttatgtctattgttgttc

SEQ ID NO: 44294 - protein, 110 aa, Panicum virgatum
  misc_feature: Ceres CLONE 2020165
  misc_feature (3)..(73): Pfam Name: Ribosomal_L24e Pfam Description: Ribosomal protein L24e
  misc_feature: Functional homolog of the protein sequence given in SEQ ID NO 50442
  misc_feature: Useful for making plants with modulated nitrogen use efficiency
MVLKTELCRFSGQKIYPGKGIRFIRADSQVFLFANSKCKRYFHNRLKPAKLTWTAMYRKQHKKDIHAEAVKKRRRTTKKAEVAKSQKTQTKGAAPKGPKGPKIGGGGGKR

SEQ ID NO: 44295 - DNA, 637 bp, Panicum virgatum
  misc_feature: Ceres CLONE 2020168
  misc_feature: Encodes the peptide sequence at SEQ ID NO. 44296
tgcttgtctatgatgtcaactctaacaggtcattcgatacactcaacacatggcatgatgagtttctcaatcaagccagcccatcagatcctaaaacttttccgttcatcttacttggtaacaagatcgacgtagatggtggaaaaagcagagtggtttctgagaagaaagcaatggagtggtgtgcttctaaaggcaatattccttattacgaaacttctgcaaaagaggactacaatgttgacaatgcattcctgtctgttgccaagcttgctctagagcatgagcgtgatcaggacatctacttccaggccgttgctgatcctgtcccagagactgaaccgaggagtggatgtgcatgctagtagttagccatcacccttgttccttccagattttgcttattgattgcggcattcttttcaagtgatgccgagcaggcattctttcaagtgatgctgggacaggcattcttttagttttggaatgcgcactaatgtttcagccatccaagtcttgcttttgtagccattgtacgatagttagcggccatggctttttgtacacgatataccgagtggtggccagccctgtttcttggtttgggcaataagaatgcagaggtggacaattctgg

SEQ ID NO: 44296 - protein, 120 aa, Panicum virgatum
  misc_feature: Ceres CLONE 2020168
  misc_feature (1)..(93): Pfam Name: Ras Pfam Description: Ras family
  misc_feature: Functional homolog of the protein sequence given in SEQ ID NO 50193
  misc_feature: Useful for making plants with modulated water use efficiency
LVYDVNSNRSFDTLNTWHDEFLNQASPSDPKTFPFILLGNKIDVDGGKSRVVSEKKAMEWCASKGNIPYYETSAKEDYNVDNAFLSVAKLALEHERDQDIYFQAVADPVPETEPRSGCAC

SEQ ID NO: 44297 - DNA, 598 bp, Panicum virgatum
  misc_feature: Ceres CLONE 2020169-R
  misc_feature: Encodes the peptide sequence at SEQ ID NO. 44298
aagaaggggtacatcccgctcacgacctacctccgcacctacaagatcggcgactacgtcgacgtcaaggtgaacggcgccgtgcacaagggcatgccgcacaagttctaccacggccgcaccgggcgcgtctggaatgtcaccaagcgcgccatcggcgtcgagatcaacaagcaggttaatggacgcatcatcagcaagcggatccatgtccgtgtcgagcatgtgcagccatcaagatgcacggaagagttccgcctgcggaaggtcaagaacgaccagctcaaggcggatgccaaggcccgtggtgaggtgatcagcaccaagaggcagcccttgggtcctaagcctggcttcatggtcgagggtgctacaattgagacagtcactcctattccttatgatgtggtcaatgacctcaagggtggttactagagagaacggttgtatcttgatcagttcaagcgacctagcatcaatgcttatctgaatctttttttggtactggctagttctttttttgttcgctggatgctggtgttataaacctatgtggttattactggttaacattaaagattttgctatggttgattgc

SEQ ID NO: 44298 - protein, 144 aa, Panicum virgatum
  misc_feature: Ceres CLONE 2020169-R
  misc_feature (1)..(80): Pfam Name: Ribosomal_L21e Pfam Description: Ribosomal protein L21e
  misc_feature: Functional homolog of the protein sequence given in SEQ ID NO 50444
  misc_feature: Useful for making plants with modulated flowering time
KKGYIPLTTYLRTYKIGDYVDVKVNGAVHKGMPHKFYHGRTGRVWNVTKRAIGVEINKQVNGRIISKRIHVRVEHVQPSRCTEEFRLRKVKNDQLKADAKARGEVISTKRQPLGPKPGFMVEGATIETVTPIPYDVVNDLKGGY

SEQ ID NO: 44299 - DNA, 697 bp, Panicum virgatum
  misc_feature: Ceres CLONE 2020169
agcttccgcgccccgcccccgccgcaacaaccagctcggccgcctccccccgctcctccacctccacggctccaccgcaggccaagctcactaaaggagggcaagggcgcaccaactccgggcggagcccaaaccctcaacccccccccccccccaccgggccaccgcgccgctcccctacgcccatccgcgcccatggcctccccctcccgctcccccgccgcctcgcgccgcggccgcagcgtgcggcagtctcccttcttccgcgacctcgcctgcccgatcccgtcccaccgcggcgtctcccgcttcgcgtcggccgcgtcccccgccgcggccccctccgccacgccgccgccgccgcccatcttcaccctcgacgaccgctacgcctccgaggacttctccccggaccccaccgcctccgacctacttcccctggcttcgtccccttccccccgcgccgccgccagccgctcgccgtcatgggaccggccccggggccggacatcgctctcggcaccgggatcccccatggatggggtcgtggagccggcccggaaggaggtgcttgctttgcctccacccgcgagccctggcagcccgcctcctgctacgacagcggaggcgcagtcgccggtgccccctgcgcaagcaccggttaggacggagccggtggctaacggaggggaggctg

SEQ ID NO: 44300 - DNA, 723 bp, Panicum virgatum
  misc_feature: Ceres CLONE 2020173
  misc_feature: Encodes the peptide sequence at SEQ ID NO. 44301
ggctcttgtgccattgcttcaaagacccaaccccatctgctcctgctcctcacggccccgtcgatccatcggcgatgacgccaggaagctccgccgccggatcgggcgtcgtcgttcctcggaacttcagactgctagaagagcttgagcgtggggagaagggcattggagatggtacagtgagctatggcatggatgatgcagatgacatctacatgagatcgtggactggcactatcattggcccacataataccgtccatgagggtcgcatctaccagctgaagttgttctgtgacaaggactaccctgagaagccaccatctgttagatttcattcaagaataaacatgacatgtgttaatcatgagactggagtggttgacccaaagaagttcagtgtactggctaactggcagcgggagtacacaatggagtacattctgacccagctcaagaaagagatggcctccccacataaccgcaaactagtgcagcctccagaaggaacattcttctgaaatagctatttgttgccccatttgcggattcaacagcagaatctcatggccatccatggtgactccaaaaacatcttcacttggtagctatgattgatttctagtatgtgtgcctactatctgttgaccgctgcgatagcgtacgagtgaactttccttaaaatctttctggtggttgctaaagaaatggaatgaaacggtt

SEQ ID NO: 44301 - protein, 148 aa, Panicum virgatum
  misc_feature: Ceres CLONE 2020173
  misc_feature (19)..(140): Pfam Name: UQ_con Pfam Description: Ubiquitin-conjugating enzyme
  misc_feature: SWISSPROT Homolog: EC 6.3.2.19 Ubiquitin--protein ligase
MTPGSSAAGSGVVVPRNFRLLEELERGEKGIGDGTVSYGMDDADDIYMRSWTGTIIGPHNTVHEGRIYQLKLFCDKDYPEKPPSVRFHSRINMTCVNHETGVVDPKKFSVLANWQREYTMEYILTQLKKEMASPHNRKLVQPPEGTFF

SEQ ID NO: 44302 - DNA, 495 bp, Panicum virgatum
  misc_feature: Ceres CLONE 2020176
  misc_feature: Encodes the peptide sequence at SEQ ID NO. 44303
atttctctccctctcatctctctaccttatcctttcctttggagtgctggggagcgcaggccgccgctgcggggcgcgcaagccgccgccggccgccgagcggcggcgactctcgcgtagacgccgctaaagtctccgccggcgaccggacacgcaggattggtcgctggcgaccggccacgcaggacggctgcgtcggcgtcggtgcattcggggctgcagcctccgccaagccgtgggggttatcgtcggccaccttctcaaggctgtccaccggcgccggcggcaggaggcacttcgagatggtgcggtgcgatgccggtgtggagacccaggcgcaggcgatggccaaggcagccagcgtcgatgcgcatgagtagttcaagatctctgcctactatgagtctcttgccattcgtctgtcctcaaatctatagctactttttcctcttttgttggatttgcatattcaatccaatagaaaagaaactaagc

SEQ ID NO: 44303 - protein, 125 aa, Panicum virgatum
  misc_feature: Ceres CLONE 2020176
  misc_feature: SWISSPROT Homolog: EC 1.2.1.70 Glutamyl-tRNA reductase
FSPSHLSTLSFPLECWGAQAAAAGRASRRRPPSGGDSRVDAAKVSAGDRTRRIGRWRPATQDGCVGVGAFGAAASAKPWGLSSATFSRLSTGAGGRRHFEMVRCDAGVETQAQAMAKAASVDAHE

SEQ ID NO: 44304 - DNA, 663 bp, Panicum virgatum
  misc_feature: Ceres CLONE 2020179
  misc_feature: Encodes the peptide sequence at SEQ ID NO. 44305
tggcgttcagctgcggcgatggctgccgctggctgttctgccgcgcattgtgcgcggtggctgatcgatgaagggtgatcggagataatggtggtggtgatgcgtgcaggtgctcaaggcgcagatggacgccaagagcaaggggttcacggacgtgctgtacctcgactcggtgcacaagcggtacctggaggaggtctcgtcgtgcaacgtgttcgtcgtcaagggcggcgtcgtcgccacgccggccaccaagggcaccatcctgccggggatcacgcgcaagagcgtcatcgagctcgccagggaccgcggatacaaggtggaggagcggctcatctccatcgacgacctgatcgacgccgacgaggtgttctgcaccggcacggcggtggtggtggcgccggtgtcggcggtgacgtaccaggggcggaggcacgaattcaggaccggcccggacacggtgtcgcaggagctgtacacgactctgacgtccatccagatgggcctggccgaggacaacaagggatggacagtggcagtagattaaggcgacggcatggggtgccagggaagggccgcgacattcatatagtatttcttgctgcttattattaggttagccattgtgagcagctattggtattattgtcatcacccatc

SEQ ID NO: 44305 - protein, 141 aa, Panicum virgatum
  misc_feature: Ceres CLONE 2020179
  misc_feature (1)..(123): Pfam Name: Aminotran_4 Pfam Description: Aminotransferase class IV
  misc_feature: SWISSPROT Homolog: EC 2.6.1.42 Branched-chain-amino-acid transaminase
  misc_feature: Functional homolog of the protein sequence given in SEQ ID NO 51371
  misc_feature: Useful for making plants with modulated nitrogen use efficiency
  misc_feature: Functional homolog of the protein sequence given in SEQ ID NO 51372
  misc_feature: Useful for making plants with modulated biomass
  misc_feature: Useful for making plants with modulated flowering time
MDAKSKGFTDVLYLDSVHKRYLEEVSSCNVFVVKGGVVATPATKGTILPGITRKSVIELARDRGYKVEERLISIDDLIDADEVFCTGTAVVVAPVSAVTYQGRRHEFRTGPDTVSQELYTTLTSIQMGLAEDNKGWTVAVD

SEQ ID NO: 44306 - DNA, 584 bp, Panicum virgatum
  misc_feature: Ceres CLONE 2020179-R
  misc_feature: Encodes the peptide sequence at SEQ ID NO. 44307
atgtctgggcgcggcaagggcggcaaggggctgggcaagggcggcgcgaagcgtcaccgcaaggtcctccgcgacaacatccagggcatcacgaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagacagtcaccgccatggacgtcgtctacgcgctcaagcgccagggccgcaccctctacggattcggcggctgaggggcgccgccgccgccgcccggtggccgtgccaaaagtcttgggtcgcggtcaagaaatcgcggaggaggcgagattgttctggtccatatatgctctgtttcgtaggcttaccagtagtgctaaatattgttggttggcggtttggatcattctagagccgtggtcgagtagtactgtagtagtatgtgaagctgtatggcaaagttctcctgcatatgctatctgttctgaacttcagatatatgaatccggtgccttgccgtgtttat

SEQ ID NO: 44307 - protein, 103 aa, Panicum virgatum; identical to SEQ ID NO: 12044
  misc_feature: Ceres CLONE 2020179-R
  misc_feature (25)..(94): Pfam Name: Histone Pfam Description: Core histone H2A/H2B/H3/H4

SEQ ID NO: 44308 - DNA, 682 bp, Panicum virgatum
  misc_feature: Ceres CLONE 2020183
  misc_feature: Encodes the peptide sequence at SEQ ID NO. 44309
aagagaggacgtcccgaagggagagagagaaagaggcacgcgcagcatccattccttgccgctgccgccgcacactcccattgcagagccccaccccgcgcaaaagcagagcagccactttcccctcccgctccccatctccgtcctcctcccatggcgagatcgacgcgcggcgcgctcctcctcctcctcgcgctgctggcgctggcggcggcggcccgcgcgggcgacgtgccggcggcggcgctgggctgggagctcggggtggtgggcgccgcggaggacgaggagttcggcttccccgccggcggcggctccgtggcgcgccgggtgctgcagggcgggtccgggtacatcagctacggcgcgctgcggcgggacaacgtgccgtgctccgtgcggggggcctcctactacaactgccgccccggcgcgcaggccaacccctactcgcgcggctgctccgccatcgcccgctgccgcggctgatccctcgcccgcctgcttcggcaccggcgaccgccgggaggaagaggagaaggttcatcccgttaatccctcgccgttcagcagaaaaaaaaggaaactgttcatctgccccttttaatcaattgttattgttattagtgctggtattatttgtcttgtcgtccatgcttagccgaggatgattggtggtggt

SEQ ID NO: 44309 - protein, 111 aa, Panicum virgatum
  misc_feature: Ceres CLONE 2020183
  misc_feature (45)..(111): Pfam Name: RALF Pfam Description: Rapid ALkalinization Factor (RALF)
MARSTRGALLLLLALLALAAAARAGDVPAAALGWELGVVGAAEDEEFGFPAGGGSVARRVLQGGSGYISYGALRRDNVPCSVRGASYYNCRPGAQANPYSRGCSAIARCRG

SEQ ID NO: 44310 - DNA, 727 bp, Panicum virgatum
  misc_feature: Ceres CLONE 2020209
  misc_feature: Encodes the peptide sequence at SEQ ID NO. 44311
gtaccagcagcagctcgaggcgcgagtcagaggcgagctagcagccactagagcctcgagagcggagggagtgcgggatggcgagaatggcgctggcggcggcgctggtggcggtggcggtggctggcgtgctcgccgggggcgcgggggcgcagctggtggaggggttctacgcgagctgctgcccgcaggcggagaagatcatcaagaactacgtggcggagcacgtcccccgcgtgcccaccatcgccgccaccctcctccgcacccacttccacgactgcttcgtcaggggctgcgacgcgtcgctgctgctcaacgcgacgggcgggaaggaggcggagaaggacgcggcgcccaacaagacgctgcgcggcttcgccttcatcgaccgcatcaaggccatcatcgagaaggagtgccccggcgtcgtctcctgcgccgacatcctcgcgctcgccgcccgcgactccgtcgtcgtcaccggcgggccgtcctggagcgtgccgacggggcggcgcgacggcacggtgtccctcaagcaggaggcgctggacaatatccccgggcccaccatgaacttcacccagctcctccagtccttccagaacaagagcctcagcctcgctgacctcgtctggctctcaggggctcacaccatcggcatcgggcactgcaacaccttcagcgagcgcctctacaacttcaccggccgcggcggccccgg

SEQ ID NO: 44311 - protein, 216 aa, Panicum virgatum
  misc_feature: Ceres CLONE 2020209
  misc_feature (43)..(215): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51685
  misc_feature: Useful for making plants with altered carbohydrate content
  misc_feature: Functional homolog of the protein sequence given in SEQ ID NO 50377
  misc_feature: Useful for making plants with altered cell wall content and/or composition
  misc_feature: Functional homolog of the protein sequence given in SEQ ID NO 50564
  misc_feature: Useful for making plants with modulated phosphate use efficiency
  misc_feature: Functional homolog of the protein sequence given in SEQ ID NO 50230
  misc_feature: Useful for making plants with modulated nitrogen use efficiency
MARMALAAALVAVAVAGVLAGGAGAQLVEGFYASCCPQAEKIIKNYVAEHVPRVPTIAATLLRTHFHDCFVRGCDASLLLNATGGKEAEKDAAPNKTLRGFAFIDRIKAIIEKECPGVVSCADILALAARDSVVVTGGPSWSVPTGRRDGTVSLKQEALDNIPGPTMNFTQLLQSFQNKSLSLADLVWLSGAHTIGIGHCNTFSERLYNFTGRGGP

SEQ ID NO: 44312 - DNA, 712 bp, Panicum virgatum
  misc_feature: Ceres CLONE 2020212
  misc_feature: Encodes the peptide sequence at SEQ ID NO. 44313
atccctctccgcctccgaccgagagccctccctccctccatcttcctccccacccggcgattgagaaaggtgtccccggctagtaggtagaatgctgctgagctcccccttggtgtccccggcgctgcgggtctctccgcagctgcagccggggaatggctgtcgcctccggatcgaggcggcgaggcagctgacggggcgggtggtgacgaccaaggcggacaagacggtgggcgtggaggtggtgcgcctggcgccgcatcccaagtacaagcgccgagagcgtatcaagaagaagtaccaggcgcacgaccccgacaaccagttcaaggtcggcgacgtcgtcgagctccgaagctcccgccccatctccaagaccaagcacttcatcgccgttccgctcccgccccgcgacacccgccgcaagtcgcagctcctcccgccgctccagtcgcagcaggccgccgaagacgacgaccagcagccgccgccctccacggcacagtgaccgacccgccgacccgaccgccattattcctattcccttgcctctgcggagccaaccactctacaagttgtgtaatttggccaaaatttcccctacctactttacttattattattgcgtctgcgtatgttttgccgtttccctttatctcgcaaccaccaccatcatcgtcatcatatagagcttgtgtttgattggttttta

SEQ ID NO: 44313 - protein, 138 aa, Panicum virgatum; identical to SEQ ID NO: 42082
  misc_feature: Ceres CLONE 2020212
  misc_feature (36)..(104): Pfam Name: Ribosomal_S17 Pfam Description: Ribosomal protein S17

SEQ ID NO: 44314 - DNA, 258 bp, Panicum virgatum
  misc_feature: Ceres CLONE 2020230
  misc_feature: Encodes the peptide sequence at SEQ ID NO. 44315
atggtcatgcagagcctgggcgccatctgcggcgccggcggcgtccaaggctgccagcacgggctgtgcatgcgcaaccgcggcggtgccaacgtcgtctcacctggatacaccaatggcgacgggcttctcattaacatcgatggcaccttcatcctcgtctacaccgtcttctccgccaccgacgccgctacgaacatcacgcactcccactacccgatccttgctcccctcacaattgtgttcgccgtgttcctg

SEQ ID NO: 44315 - protein, 83 aa, Panicum virgatum
  misc_feature: Ceres CLONE 2020230
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MQSLGAICGAGGVQGCQHGLCMRNRGGANVVSPGYTNGDGLLINIDGTFILVYTVFSATDAATNITHSHYPILAPLTIVFAVF

SEQ ID NO: 44316 - DNA, 762 bp, Panicum virgatum
  misc_feature: Ceres CLONE 2020242
  misc_feature: Encodes the peptide sequence at SEQ ID NO. 44317
ctctttcctcgggcagctgccatcaagaggtcaacagtcagccaagatggcagagcttgccgctgacattcccaagctgtttggcaagtacagcttcgaggatctcaacgtgaacgacctggccctgcaggactacattgcagtgaagcagcgctcagccatctatgtgccacacacagcgggccgctaccagaagaagcgcttccgcaaggcacaatgccccattgtggagaggctcgtcgcctccctgatgatgcacggccgcaacaacggcaagaagctgatggcggtccgcatcgtcaagcacgcctttgagatcatcgccttgttgacagaccagaaccccatccaggtgctggttgacgccattatcaacagcggtccacgtgaggatgccactcgcattggctctgctggtgtggtacgccgccaggctgtggatatctcccctctgcgccgtgtcaaccagtccatctggctgctgaccaccggcgcccgcgaggccagcttccgtaacatcaagaccattgctgagtgcttggctgatgagctcaccaacgctgccaaggggtcttccaacagctatgctatcaagaagaaggacgagatcgagcgcgttgccaaggctaaccgttaaacagctgcatacaggcacacagcagattctcctccctgtcacgtgcatgacttggaggagtgctcatgggctggtgcattgggacaggtggtttacagtgccgcactgatgtgcaggcaggctgc

SEQ ID NO: 44317 - protein, 196 aa, Panicum virgatum
  misc_feature: Ceres CLONE 2020242
  misc_feature (41)..(196): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
MAELAADIPKLFGKYSFEDLNVNDLALQDYIAVKQRSAIYVPHTAGRYQKKRFRKAQCPIVERLVASLMMHGRNNGKKLMAVRIVKHAFEIIALLTDQNPIQVLVDAIINSGPREDATRIGSAGVVRRQAVDISPLRRVNQSIWLLTTGAREASFRNIKTIAECLADELTNAAKGSSNSYAIKKKDEIERVAKANR

SEQ ID NO: 44318 - DNA, 571 bp, Panicum virgatum
  misc_feature: Ceres CLONE 2020242-R
  misc_feature: Encodes the peptide sequence at SEQ ID NO. 44319
tcctgatgctactaagggttctgaccatctgaaacaagtctttggcaagcagatgggcttgagcgatcaggacattgttgccctctctggtggccacaccttgggaaggtgccacaaggagcggtctggttttgaggggccctggactagaaaccctttggtctttgacaactcttacttcaaggaacttctgagtggtgacaaagagggcctccttcagctcccaagtgacaaagccctgctgagcgaccctgtcttccgccctctcgtggagaaatatgctgcggatgagaaggctttctttgatgactacaaggaggcccacctcaagctctctgaactggggttcgctgatgcataaaatggcgtatcctagactactacgtgctgctgcttgtatgggatcgtgtaatcttgttttgcatctggagtcagtgtgaaccagcagattaagtatcttctctgtaataaatttgttaccaagtcagtgtttggctagactctgatgctgtatcactgaaactacaagatctatgatctaccttatgaatgcagtacgttctgttacctc

SEQ ID NO: 44319 - protein, 119 aa, Panicum virgatum
  misc_feature: Ceres CLONE 2020242-R
  misc_feature: SWISSPROT Homolog: EC 1.11.1.11 L-ascorbate peroxidase
  misc_feature: Functional homolog of the protein sequence given in SEQ ID NO 50942
  misc_feature: Useful for making plants with modulated heat sensitivity
  misc_feature: Functional homolog of the protein sequence given in SEQ ID NO 50943
  misc_feature: Useful for making plants with modulated water use efficiency
  misc_feature: Functional homolog of the protein sequence given in SEQ ID NO 50852
  misc_feature: Useful for making plants with altered carbohydrate content
  misc_feature: Functional homolog of the protein sequence given in SEQ ID NO 50941
  misc_feature: Useful for making plants with altered cell wall content and/or composition
PDATKGSDHLKQVFGKQMGLSDQDIVALSGGHTLGRCHKERSGFEGPWTRNPLVFDNSYFKELLSGDKEGLLQLPSDKALLSDPVFRPLVEKYAADEKAFFDDYKEAHLKLSELGFADA

SEQ ID NO: 44320 - DNA, 664 bp, Panicum virgatum
  misc_feature: Ceres CLONE 2020244
  misc_feature: Encodes the peptide sequence at SEQ ID NO. 44321
agggcagcagtggcgtctcaagggctgtcatgggcaactctgcttctcgcggacgatcgaagccggggcagggccatgcgtccaaggtagcacctccttctccagctggaatgcagagccagcagatggccttcaagtggagcatcgatggattctgctcgctcctcgacaagggtgaaggatggacctactccagagtgtttgagatcatgggcctgaactggtacctgaaactgaatccaagggacaagaggggcggtgaagacgaggagcacgtctctcttcagcttgaactggcgagaagctcagtcaagcttgataccatcgttgtggcctctttcaagttgctgatatatgatcagtcgtacggaaagcacagcgagcatcaagtaagccacagtttccagacagcaagcacaagcgctggggcctcatacgtgatccccctggaaacgctgaaaaagcagtcctctggcttcctcgtcaacaacagctgcgtctttggtgtcgagttcatcaaggttgccacttctaaagccaacgttacatcagatacgctgtttgtccagaagacgagcatcttcaatgagtccaaagtttacacttggaacatcgaggacttcttttcgctgaagaacccgggtgactctccggagtttgaagt

SEQ ID NO: 44321 - protein, 211 aa, Panicum virgatum
  misc_feature: Ceres CLONE 2020244
  misc_feature: SWISSPROT Homolog: EC 3.1.2.15 Ubiquitin thiolesterase
MGNSASRGRSKPGQGHASKVAPPSPAGMQSQQMAFKWSIDGFCSLLDKGEGWTYSRVFEIMGLNWYLKLNPRDKRGGEDEEHVSLQLELARSSVKLDTIVVASFKLLIYDQSYGKHSEHQVSHSFQTASTSAGASYVIPLETLKKQSSGFLVNNSCVFGVEFIKVATSKANVTSDTLFVQKTSIFNESKVYTWNIEDFFSLKNPGDSPEFE

SEQ ID NO: 44322 - DNA, 563 bp, Panicum virgatum
  misc_feature: Ceres CLONE 2020244-R
aatccattcatccaaacacctcccacctcgcctctgccgtccgactgccccttcttgcgtgcttgatactcgcatcagtcaatcatcatgagctaccaagcaggctacccgccgccgggcaccgccgcgtaccctccgccggggcagcaggcctactacggcgcgcccccgccgcaggcctacgtcgcgccgccgccggcgtacccgccgtcccagcaggacgccggtgcgtacggccagcagcagccggagaccaccagccgcggcggcgacggcttctggaaaggatgctgcgccgccatctgctgctgctgcgtcctcgacatgtgcttctgaggacgacggccggcgacggggaagagatccaacgccgccatggtcgaccaggcctcgctgatcgatcgagctgctctgctatctagctagctgtgttgttaattacatttacatatatacatcttgatagagtcattagtcttcgttaagctgttgtggcttgtaattcttctatttttatgatggaaaatatattataaataaatgatcccatgttattccatgat

SEQ ID NO: 44323 - DNA, 662 bp, Panicum virgatum
  misc_feature: Ceres CLONE 2020259
  misc_feature: Encodes the peptide sequence at SEQ ID NO. 44324
aggacatcgtgcgtctggagcagatggtcttcccagagcacgcgtcgccagcgcggtccctccgcgacgagctgaggcgccggaacttcggcctgatctactcgacgcccggcgccggcggcgaggaggtcgccggggacgccgtgtacacccgcaacaccgccctctgcgccaccatcatagagctcgccgtgagggagagctgcaggcgacagggccacggcgaggttctgctgcgggcggccgtggagcggtgccgggggaggagggtgcagcgggtgatcctccacgtcgacccggcgagggcggccgccgtcgcgctgtaccggaaggccgggttccaggtcgacgccaccgtcgagggctactacgcgccgcagagggacgcctaccggatgttcatggatctccagtgatcaggagccgagcaagaaaagggcgtcgctcatcctcgtcgtcagagatttgagttcgatcggtggctctgatgctcctcccaatgtcaataaaatgccctgatgaattctgattctgcgaatgctttttatccatgaccccctagttccaaactgcagggtctgtacaaacgatccgttcagttcagaggatgaaattcacaaaatcctcgcttggtaatggaagacatctcacaatttcagccg

SEQ ID NO: 44324 - protein, 137 aa, Panicum virgatum
  misc_feature: Ceres CLONE 2020259
  misc_feature (36)..(114): Pfam Name: Acetyltransf_1 Pfam Description: Acetyltransferase (GNAT) family
DIVRLEQMVFPEHASPARSLRDELRRRNFGLIYSTPGAGGEEVAGDAVYTRNTALCATIIELAVRESCRRQGHGEVLLRAAVERCRGRRVQRVILHVDPARAAAVALYRKAGFQVDATVEGYYAPQRDAYRMFMDLQ

SEQ ID NO: 44325 - DNA, 593 bp, Panicum virgatum
  misc_feature: Ceres CLONE 2020268-R
  misc_feature: Encodes the peptide sequence at SEQ ID NO. 44326
accaatcctcttccaacgcttcctcctcctccaaattccatctccgagcggtcgcggcgagagaagcttccggtttcggcgatgtcggggcgcggcaagggcggcaaggggctgggcaagggcggcgccaagcgccaccgcaaggtgctccgcgacaacatccagggcatcaccaagccggccatccggaggctggccaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgccccctctacggcttcggcggctaggtcggttccccttctggtggcgaaggcgaactacatgcggtgggctgtgtgttctggtctagtgtagtcagtgttctctgtatcgaactatcgatgctgtgtcgtggtggttgtactctgctcttcgagtaggtgttcgaatttctactccgtctgctgtaatatctagttgctttaatcaatgcaaaatccttggttct

SEQ ID NO: 44326 - protein, 103 aa, Panicum virgatum
  misc_feature: Ceres CLONE 2020268-R
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRPLYGFGG

SEQ ID NO: 44327 - DNA, 665 bp, Panicum virgatum
  misc_feature: Ceres CLONE 2020268
atttttcgcgcgtagcgggggccaacagagcaggagctgccgacgaagatggagaccgaagagggccgcggcttgttcgatgtgtcgggcctaggggcggtggtgagctgcgtggggctggcagggtggttcgtgggcagtctgtacctgtggcccgacgcccaccggatagaccgcaacagccccgtcgtgatcaggcggcgcttcgcaagcgtgggtctcgtgtgcgtgaccgctgtcatgtacctctacttctggtctcacgaccgggatctcggcaaggtcatggaatggatgggcgtgcgcaccaccggcatgctccaggcagcagtgattccgttgctgctgacgatggtgctctttgctgggccgctggcgatgagctactacgatgagtggttgcatcatctgcagcgcggcaccatgactcagtacttgcgcgaacagctaaaggccgacgtcgcctccctcatcttctggcgaaactatgtcgtgggtccgttcacggaggaatgggtgttccgctcgtgcatgtgcccgttgctcatctgcggcggcttcagctggactcagactatcttcttgtctcctttcttttttggcattgcgcacatgcatcacatcatccagcatctgcacaagcagggcaccgagctcaaggacgc

SEQ ID NO: 44328 - DNA, 676 bp, Panicum virgatum
  misc_feature: Ceres CLONE 2020276
  misc_feature: Encodes the peptide sequence at SEQ ID NO. 44329
aactaacgctaaaaaagtaacagtttctgtactttattgctcgcgcttcggttcatcccgaaacacacacaccacccccaagtctcacccaaaccccagcatcaccatcatggcgacccccagcaagaagtctgcgtcgaagaaggcgagcggcagcaaggtgacgtcgcagagcaagcgcgcggggctcatcttcccggtgggccgcatcgcgtcgaagctgcgcaagggccgctacgcggcgcgcgtgtcgtcgtcggctgcggtgtacctggcggcggtgctggagtacacggtggctgagatcctcgagctgtcggcgaaggcggtcgtgcagcgcgggaaggggtcgcgcatcacgccgcgcgcgctgacgctcgcggtgcgccacgacgcggacctcggcagcctgctgaaggacgtgacgctgtcgcgcggcggcgtcgtgcccaaggtggagaaggcgctcgaggcgaagaaggccaagcgcgcgggcaagaaggcgtcggcgacgcccaaggtgtaaggaggatccctcccaggttctctcaacgcaccgcaccaagcccccaccacacccccccataaaaacgcagagctacctcggaaagcccccgtcatcatcagaacgtgattgacctccagtgcgcatcaatgaatgaaagcggcgacggcg

SEQ ID NO: 44329 - protein, 138 aa, Panicum virgatum
  misc_feature: Ceres CLONE 2020276
  misc_feature (21)..(95): Pfam Name: Histone Pfam Description: Core histone H2A/H2B/H3/H4
MATPSKKSASKKASGSKVTSQSKRAGLIFPVGRIASKLRKGRYAARVSSSAAVYLAAVLEYTVAEILELSAKAVVQRGKGSRITPRALTLAVRHDADLGSLLKDVTLSRGGVVPKVEKALEAKKAKRAGKKASATPKV

SEQ ID NO: 44330 - DNA, 629 bp, Panicum virgatum
  misc_feature: Ceres CLONE 2020286
  misc_feature: Encodes the peptide sequence at SEQ ID NO. 44331
tctctttctcccaatctttttttgagatctttaataactagtcaaaatgggtcgtatgtatacttctggtaagggtatctctggtagtgccctcccctatcgtcgcactcccgcctcttgggtcaagactacccccgaggaagtcgttgagcaaatctgcaagaacgccaagaagggtctttctcctgctcaaattggtgtcctcctccgtgactccaacggtattcctcaagttaagtccatcactggtaacaagattctccgtattcttaagtccaacggtcttgctcctgaggtccctgaggatttgtaccatcttatcaagaaggccgtctccatccgtaagcatttggaacgtaacagaaaggataaggactccaagtaccgtttgattcttattgagtctcgtatccaccgtcttgctcgttactacaagactgctggtcaactccctcctacctggaaatatgagtctgccactgcttctgctatagttgcctaaatgcatcacttgtgtgcttgcgtttcctttccaaaaaggtcctcgattttactttcaagaatgtctcaactgtatctttttccgttaaagtgttcaagaaagttatcattaaaaacatttgctttgc

SEQ ID NO: 44331 - protein, 151 aa, Panicum virgatum
  misc_feature: Ceres CLONE 2020286
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Functional homolog of the protein sequence given in SEQ ID NO 50384
  misc_feature: Useful for making plants with modulated nitrogen use efficiency
MGRMYTSGKGISGSALPYRRTPASWVKTTPEEVVEQICKNAKKGLSPAQIGVLLRDSNGIPQVKSITGNKILRILKSNGLAPEVPEDLYHLIKKAVSIRKHLERNRKDKDSKYRLILIESRIHRLARYYKTAGQLPPTWKYESATASAIVA

SEQ ID NO: 44332 - DNA, 669 bp, Panicum virgatum
  misc_feature: Ceres CLONE 2020287
  misc_feature: Encodes the peptide sequence at SEQ ID NO. 44333
agtccatcaaaagaattgctctcaacatctctaacaaccaaatcatatatggctagaacaagcagcatgtcgtattccctctggtccttcttgctcctagcacttgctgctgccctgtgcacgcgctgcgcagccaccgacgacgacgtcgacgacgcgagcaacggcagcacggacaccgacgccagccgccgcgcgcgcgccgcggccacggttgccgagatcctgtcggtgcacaacacagcgcggcaggcggtcggggtgccgccgctggtctggagcccccagatcgccgggtatgccaagggcttcgcgcactcgcggcgcggggactgcgtgccccggcggtcgccgcggttctacttcggcgagaacatcttcatcgggaagggccggcactggaacgccacggcgctggcggcgccgtgggtggcggagggccagtggtacgactacgagaccaactcgtgcgccgcaccgccaggcgccgggtgcctgcggtacacgcaggtggtgtggcgcaacaccacgcaggtcgggtgcgccaggatcgtgtgcgactccggcgacaccctgctcgcatgcgactacttcccgccggggaactacggcaccggcaggccatactgatcctacgtcgtctcggctgatcatgcgtgtctcgaccgg

SEQ ID NO: 44333 - protein, 193 aa, Panicum virgatum
  misc_feature: Ceres CLONE 2020287
  misc_feature (60)..(181): Pfam Name: SCP Pfam Description: SCP-like extracellular protein
MARTSSMSYSLWSFLLLALAAALCTRCAATDDDVDDASNGSTDTDASRRARAAATVAEILSVHNTARQAVGVPPLVWSPQIAGYAKGFAHSRRGDCVPRRSPRFYFGENIFIGKGRHWNATALAAPWVAEGQWYDYETNSCAAPPGAGCLRYTQVVWRNTTQVGCARIVCDSGDTLLACDYFPPGNYGTGRPY

SEQ ID NO: 44334 - DNA, 468 bp, Panicum virgatum
  misc_feature: Ceres CLONE 2020291
  misc_feature: Encodes the peptide sequence at SEQ ID NO. 44335
attttttccggccccatcttcctcgcgcggcgcctgccccccctgccggttagaagcgtgcgaagaagaatcgcggagagatggcccgtaccgagcaaaccggtcgaaagtacacgggaggaaaggatcccaggaaacaacttggaactaaagatgcccacaggtcagccccgaccgctggaggagtgaagaaacccgcaccgctaccgccctggagactgatggcctccatgagatccgaaagtaccaaaatatctctgatctgtgtgatcaggaagctgcccttccgaatgcttgttacggaaattgcacaggacttcaagactgatctgcgtttccagagccatgctgtgcttgccctccaggaggctgcccaggcgtaccttgttggtctgtttgacgacaccaacctgtgcaccatccatgctaagcgtgtgaccatcatgcgaaaggacattcagctggcca

SEQ ID NO: 44335 - protein, 129 aa, Panicum virgatum
  misc_feature: Ceres CLONE 2020291
  misc_feature (59)..(129): Pfam Name: Histone Pfam Description: Core histone H2A/H2B/H3/H4
MARTEQTGRKYTGGKDPRKQLGTKDAHRSAPTAGGVKKPAPLPPWRLMASMRSESTKISLICVIRKLPFRMLVTEIAQDFKTDLRFQSHAVLALQEAAQAYLVGLFDDTNLCTIHAKRVTIMRKDIQLA

SEQ ID NO: 44336 - DNA, 423 bp, Panicum virgatum
  misc_feature: Ceres CLONE 2020293
  misc_feature: Encodes the peptide sequence at SEQ ID NO. 44337
acattcttctagtgaaaccaggattaccatacttggatatcatccgacttcttcgggataattcagcactgccgattgctgcttaccaggtttcgggcgagtactcgatgatcaaagctggcggggcgctgggcatgatcgacgagcagaaggtgatgatggagtcgctcatgtgcctgcggcgcgccggcgctgacgtcatcctgacctacttcgcccgtcaggccgcgggcgtcctgtgcggcatgggatccaagtaggtcaaccctggagaaaggccgcggagcgtcacgcgaccatcctgtacccctccaattggttgctagtattagtcgaacttgcaaatatcgtgctgaggatgttttgaacttggattacctgaggcctcgaacaagtagtgtacacgcgtgaatgatttgtgtc

SEQ ID NO: 44337 - protein, 85 aa, Panicum virgatum
  misc_feature: Ceres CLONE 2020293
  misc_feature (1)..(79): Pfam Name: ALAD Pfam Description: Delta-aminolevulinic acid dehydratase
  misc_feature: SWISSPROT Homolog: EC 4.2.1.24 Porphobilinogen synthase
ILLVKPGLPYLDIIRLLRDNSALPIAAYQVSGEYSMIKAGGALGMIDEQKVMMESLMCLRRAGADVILTYFARQAAGVLCGMGSK

SEQ ID NO: 44338 - DNA, 509 bp, Panicum virgatum
  misc_feature: Ceres CLONE 2020297
  misc_feature: Encodes the peptide sequence at SEQ ID NO. 44339
agtggttcaacgggaccaaggggttcggcttcatcacccccgacgacggcggccaggacctcttcgtccaccagtcctccatcaaggccgacggctaccccaacgtcaaggatggcgagaccgtcgagttcaccgtcggcgccgacagagacggccgcgccaaggccctcgacgtctccgcgcctggcggcgggccgctcgccggcggggaacgccccgacggcggctacggcggcggcggcggcggctacggtggaggaggtggcggcgaccgcggctacggcggcggcggcggcggctacggtggtggcggcgaccgcggctacggcggcggcggcgaccgcggctacgggggaggaggcggcggctatggtggtgggggcgaccgctgctacggcggcggcggcgggggtggtgggcgtggctgcttcaagtgcggcgaggacggccacctggctcgcgactgctcgcacaacggcggtggcggcggctacggaggaggcggcggc

SEQ ID NO: 44339 - protein, 168 aa, Panicum virgatum
  misc_feature: Ceres CLONE 2020297
  misc_feature (1)..(61): Pfam Name: CSD Pfam Description: 'Cold-shock' DNA-binding domain
  misc_feature (140)..(157): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
WFNGTKGFGFITPDDGGQDLFVHQSSIKADGYPNVKDGETVEFTVGADRDGRAKALDVSAPGGGPLAGGERPDGGYGGGGGGYGGGGGGDRGYGGGGGGYGGGGDRGYGGGGDRGYGGGGGGYGGGGDRCYGGGGGGGGRGCFKCGEDGHLARDCSHNGGGGGYGGGG

SEQ ID NO: 44340 - DNA, 714 bp, Panicum virgatum
  misc_feature: Ceres CLONE 2020299
  misc_feature: Encodes the peptide sequence at SEQ ID NO. 44341
aataaagaagttacagccgcagatctgccatttctagcttccttcaatacctatggagacatccaagctagtggtggttgttttgctcgcgctggccatggcggccgtgcggccttccagcgctcagaactcgcctcaagactacctcacgccccacaaccgggcccgcgccgccgtcggcgtcggcgcggtgacctggagcacgaagctgcagcagttcgcggagaggtacgccgcgcagagggccggcgactgccggctgcagcactcgggcgggccgtacggggagaacatcttctggggctccgccggcgccgactggaaggcggcggacgcggtgaggtcgtgggtggacgagaagcagtggtacaactacgccgccaacagctgcgccgccggcaaggtgtgcggccactacacgcaggtggtgtggcgtgccaccaccagcatcggctgcgcgcgcgtcgtctgcaacaacaaccgcggggtcttcatcacctgcaactacgagccccgcggcaacataatcggacagaagccctactgatgatcgctaaactatatatcttctggctcatggattacgtggcgtgggctcatgggactttcttccattatacgaataataattaataaggcatgcactgagtaaataaagggtcagtaggccgtgtgctacctccatctcataataaagccaataaaggagttttc

SEQ ID NO: 44341 - protein, 164 aa, Panicum virgatum
  misc_feature: Ceres CLONE 2020299
  misc_feature (32)..(152): Pfam Name: SCP Pfam Description: SCP-like extracellular protein
  misc_feature: Functional homolog of the protein sequence given in SEQ ID NO 50414
  misc_feature: Useful for making plants with modulated biotic stress sensitivity
METSKLVVVVLLALAMAAVRPSSAQNSPQDYLTPHNRARAAVGVGAVTWSTKLQQFAERYAAQRAGDCRLQHSGGPYGENIFWGSAGADWKAADAVRSWVDEKQWYNYAANSCAAGKVCGHYTQVVWRATTSIGCARVVCNNNRGVFITCNYEPRGNIIGQKPY

SEQ ID NO: 44342 - DNA, 732 bp, Panicum virgatum
  misc_feature: Ceres CLONE 2020301
  misc_feature: Encodes the peptide sequence at SEQ ID NO. 44343
gaaattctccagccgaagaaggacaaaaaatctcacgcctgcacaccccacacctctcgccctctcgccgtcgccgtcgccgtccatggagtccgtcgcggccgccgcaaatggccccgggcgcgagcccaccggccttgcgccgcacgggctctccatctcaccgctctccaaggacgcggccatggggatagtggtgagcgctgccacggggagcggctggacgacgggatcgggcatggaggggccgccaacggcgagcagagccggtggggcggacaggccagaggtgtcgacgctcccttggtcgctcttcacaaaatcgccgcggcgccggatgcgggtggccttcacctgcaacgtgtgtgggcagcgtacaaccagggccatcaatcctcatgcctacaccgatggaactgtgtttgttcagtgctgtggttgcaatgtattccataagttggtcgacaacctgaacctgtttcatgagatgaagtgctacgttggtccagacttccgctacgaaggagatgctccattcaactactttgacaataacgaggatggcgatactatcttccctctctaaaccctctcccttatgttccagtgcatgatgttgttctaatttgctcgtgtagctgtatgtaataagcagatgaaccttcctgaacttgtaatatgatacagatgtatataattgtttgtacttaactagtgcagagcttgtgctgc

SEQ ID NO: 44343 - protein, 166 aa, Panicum virgatum
  misc_feature: Ceres CLONE 2020301
  misc_feature (85)..(148): Pfam Name: zf-DNL Pfam Description: DNL zinc finger
MESVAAAANGPGREPTGLAPHGLSISPLSKDAAMGIVVSAATGSGWTTGSGMEGPPTASRAGGADRPEVSTLPWSLFTKSPRRRMRVAFTCNVCGQRTTRAINPHAYTDGTVFVQCCGCNVFHKLVDNLNLFHEMKCYVGPDFRYEGDAPFNYFDNNEDGDTIFPL

SEQ ID NO: 44344 - DNA, 592 bp, Panicum virgatum
  misc_feature: Ceres CLONE 2020308-R
  misc_feature: Encodes the peptide sequence at SEQ ID NO. 44345
gctttggctgagctacctccaactcaccctattaggcttggcttggcacttaacttctcagtgttctactatgagattctcaactcacctgatcgtgcctgcagtcttgcaaagcaggcttttgatgaggccatctcggagctggacaccctgagcgaggagtcctacaaggacagcactttgatcatgcagctccttcgtgataacttgaccctatggacatccgacatctcggaggaccctgctgaggagatcagggagccgctgaagcatgactcgagcgaggggcagtgaagcaggctttacgtgccctagaaactagtagctagtgtttgctgctgtctaatgacactatgcaatatgatctggaccctggtttcttcggcgcgatgcttgtagccgtgctatgactattgtcgggaaaattctgggggctccccatatgagatgttgccgggcaaggcctcgatgtgtcccacttgtagtaggtgggggacactggagccgggtttggttgggtagggaagccaaactgttggtgtcacttgtatttttaccttttcgtcctgtttattgtgagtggtcctgcgtc

SEQ ID NO: 44345 - protein, 97 aa, Panicum virgatum
  misc_feature: Ceres CLONE 2020308-R
  misc_feature: The sequence is a functional homolog of SEQ ID NO 789 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 801 in the 11/479,226 US patent application
  misc_feature: The sequence is a functional homolog of SEQ ID NO 786 in the 11/479,226 US patent application
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application
  misc_feature: The sequence is a functional homolog of SEQ ID NO 404 in the 10/374,780 US patent application
  misc_feature: The sequence is a functional homolog of SEQ ID NO 68 in the 11/375,241 US patent application
  misc_feature: The sequence is a functional homolog of SEQ ID NO 864 in the 10/225,066 US patent application
ALAELPPTHPIRLGLALNFSVFYYEILNSPDRACSLAKQAFDEAISELDTLSEESYKDSTLIMQLLRDNLTLWTSDISEDPAEEIREPLKHDSSEGQ

SEQ ID NO: 44346 - DNA, 746 bp, Panicum virgatum
  misc_feature: Ceres CLONE 2020308
gggagagcgcggggatgcgcacctggttcctgttgtggtgggcgatggcgaagcgcgcggcgtcctcggcctcggcccgctcgcggagcgcggcgagcacgccccgtacgagcccgctctcgtccccgccgaggtggaacccggagaccgccgcggcggcggaggccaggaggagcgcggcggcgaagagggcggcgcggcgcggcgccatcgtgagccgagctgcctacctaacctgcctacccaccagccggttggttggctggttcgcgtcggcggcgtgtggcgcttggctgctgctccggctgggtgcccgtgctcgtgctctcgctttgcttgggatggtggggaaagcgagctgccgcggggtggaccggtggtgggggcaggttggcgtggaggcggcagcgacgcgtgatccgatcggagccgtcagcgcttcgggatcgggcggcggggtcccgacgcggaggccggtttgtcctcttccgggctatgggccgagcccaactgcccaagcgtgtcggttcgagccgccgagaaggccgccgcgggttgttgccttcgtctccgtcggcggcgccaccgcgtcacgggctcacggcactgcgatgtccacctctcagttcaagtgttcaacccacggtccccttctagtacatccgaagcttctctttatctcgaagcggtaagttgtcagcacggggccgctagggatacataacctcatcagatatgcatacagg

SEQ ID NO: 44347 - DNA, 718 bp, Panicum virgatum
  misc_feature: Ceres CLONE 2020312
  misc_feature: Encodes the peptide sequence at SEQ ID NO. 44348
gagctacagtgccaccatcctctcctcctctcccgctgacacccaatcatcctccccaccagcaccagccgccgccgccgcctcctccgccagggtccgggtccgggtcggccttcttcccggccgccgcggcaagccccttccgcttcgctgcgcatcctcaggaatggagcccatcgctggcactgccctctaccctctgcaccgctgcaaaaccatttacctggtcaggcatgcccagggcattcacaatgtcgccggcgagaaggatttcaatgcctacatgtcacaggacctgtttgatgcgcagctaactcctctcggctggagccaagttgatagtctgcgggagcacgtgaagaaaagtggacttgcaaaaaagatcgagctggttattacttcccctttactgaggactatgcaaactgcagtgggggtctttggcgatgaaaactatactgatggtgtaagtgctccaccactaatggttgaaaatgctgggcacagtggacgtccggcggtttcaagtttgaactgcccaccatttcttgcagttgaaacctgcagagagcacttgggtgtccatccctgtgacaagaggaggagcataacagaataccggcctctctttcctgctattgatttttcattgatagagaatgatgaagatgttctctgggaaccagatgttagagaagcaaatgagtctgtcgcgctg

SEQ ID NO: 44348 - protein, 183 aa, Panicum virgatum
  misc_feature: Ceres CLONE 2020312
  misc_feature (17)..(178): Pfam Name: PGAM Pfam Description: Phosphoglycerate mutase family
MEPIAGTALYPLHRCKTIYLVRHAQGIHNVAGEKDFNAYMSQDLFDAQLTPLGWSQVDSLREHVKKSGLAKKIELVITSPLLRTMQTAVGVFGDENYTDGVSAPPLMVENAGHSGRPAVSSLNCPPFLAVETCREHLGVHPCDKRRSITEYRPLFPAIDFSLIENDEDVLWEPDVREANESVA

SEQ ID NO: 44349 - DNA, 671 bp, Panicum virgatum
  misc_feature: Ceres CLONE 2020312-R
  misc_feature: Encodes the peptide sequence at SEQ ID NO. 44350
cccagaactccttcagttcctcactaccagcgctgcctttgctcactcgccgtccattcctcttccctctcgagcaagctcgtcagcatgtcgacggtgtcccttgaccagaagcttgccctcgccaagcgctgctcgagagaagccaccctcgctggagccaaggcagcagctgtagccaccgtcgcctccgcgatccccaccctggcgagcgtgcggatgctgccgtgggccaaggccaacatcaaccccaccggccaggcactcatcatctccacagtcgccggcatggcctacttcatcgcggcggacaagaagatcctctcgctggcgaggcggcactcgttcgagaacgcccccgagcacctcaggaacacctcctaccagggcaccggccgtccccacccggccttctccaggccctgatcggctcgcaagcacatttaagacccgtgctgccctgcgctctagcctcatctagatatgtataccgtgtgtgtatgcttgctgcaataataagcaggcctctgcagagcaggccggcaggtagctgcctgctctaagcttattagcatgggaagcttctgcagtgtggcgtagtctttgaatatatgcgtccatgccgtgtactattactctgtcgcggtaatgaaatactactagttcttgtc

SEQ ID NO: 44350 - protein, 112 aa, Panicum virgatum; identical to SEQ ID NO: 40485
  misc_feature: Ceres CLONE 2020312-R
  misc_feature (8)..(86): Pfam Name: ENOD93 Pfam Description: Early nodulin 93 ENOD93 protein

SEQ ID NO: 44351 - DNA, 637 bp, Panicum virgatum
  misc_feature: Ceres CLONE 2020319-R
  misc_feature: Encodes the peptide sequence at SEQ ID NO. 44352
cgtgcacaagaagatccccgtcctgctccaccacggcaagcccatctccgagtccctcatcatcgtccagtacgtcgacgagccctggtcctccgccgcgccggccatcctcccggccgatccgtacacccgcgccgtccatcggttctgggcacagtacatcgacgacaagcttcctccggcgatccgcactctcaggggattggacgacggcgacaaggagcaagcggcggggcagctgtccgccgccctgcagctgttggaggaggccttcgtggagctcagccaggggaagagctacttcggcggcgacggcgtcgggtacctggacatcgccctggtgtcgtacgtcgggtgggtgcgggcgctcgagaagatcgccggggtcgcgctgctgtaccaagccaaggtccccaacctggcggcgtgggctggccggctctgcgcgcacgctgcggtggcggacgcgatccctgacgccgacaagttcgtggagttcagcgtcaagttttccaagcctatcaacactggtgccaagtgagcgaaagcggtctgatgtggccgcttaagggtcgttactttcggtgcgcacgtgtgaccgtgtctatcaataaaatgattgtgtattcgatcttcc

SEQ ID NO: 44352 - protein, 179 aa, Panicum virgatum
  misc_feature: Ceres CLONE 2020319-R
  misc_feature (49)..(151): Pfam Name: GST_C Pfam Description: Glutathione S-transferase, C-terminal domain
  misc_feature: SWISSPROT Homolog: EC 4.4.1.5 Lactoylglutathione lyase
VHKKIPVLLHHGKPISESLIIVQYVDEPWSSAAPAILPADPYTRAVHRFWAQYIDDKLPPAIRTLRGLDDGDKEQAAGQLSAALQLLEEAFVELSQGKSYFGGDGVGYLDIALVSYVGWVRALEKIAGVALLYQAKVPNLAAWAGRLCAHAAVADAIPDADKFVEFSVKFSKPINTGAK

SEQ ID NO: 44353 - DNA, 706 bp, Panicum virgatum
  misc_feature: Ceres CLONE 2020319
atccctcgacgccggtggccaagccatgggagcggagcttgacccgtcggctatggtggagtttgaccccgacggctatggaggcgcgtgcggtcccgatcgctggccgccgctcgctggctgctcgtgggcgcgtgcggcccctgccgccggctgccactcgcaggcgcgggcggacgcgcgcggcccccgccgccggccgctagccctactacaggcgcgggccttggaggagctcggggagaggcgctggcgggcctggatgcctggacaccgcagtgactcggtgcgcctggacgccgccgccacctcgggggctcgcgagcgccatgctggagctgcggcgggatcggcgagcagggaggcacagcagccgccggagctcgcggcccgcgagcaggtggagcgtggcggccggaacgcgcggtctacaagcagggggagcgcggcggcggcggcggcgcggtcacctgcaggcaggcgggcggcgcgggacggtgggagagggcatgggagagagggcgggaccacgtgggaaaaggactggcgagcggcggggcgtcggcaagatgcctaacggctttcacgggatgccgaaggatccacgactttagctgctctgttgggagcaagatttagcgtcatttctcattttttacctatccatggtgatttgcatgatctgttggagatgctcttattaagt

SEQ ID NO: 44354 - DNA, 616 bp, Panicum virgatum
  misc_feature: Ceres CLONE 2020327
  misc_feature: Encodes the peptide sequence at SEQ ID NO. 44355
attggagagtgagctatcaggtggtagaacccacttcgttgagacatgtggtttgccaatcagtacttatttcagtgctttgaagttattatggttaatggaaaatgttgatgctgtcaaggatgcagtccggactggtgacgcgttatttggcacaatagatacctggttgatctggaaccttacaggaggtgttgctggtgggcagcatgtcacagactgctcaaatgcatctcgtacaatgctcatgaatctgaagacacttgattgggataagccaacacttgatgcattaggaatttctgcagctattttaccaaaaataatcagtaattcggagaaaattggtgtggttgtcaatgggttccccttggcaggtgtccccatctcagggtgcctaggagatcagcatgctgctatgcttgggcagctctgccaaaagggtgaagcgaaaagcacctatggtactggtgccttcatccttctcaacacaggggaagagcctacagaatcctcccatggtcttcttagcaccattgcttacaagcttggcccaactgcacccactaactatgctcttgaaggatccattgcaattgcaggagcagcagttcag

SEQ ID NO: 44355 - protein, 204 aa, Panicum virgatum
  misc_feature: Ceres CLONE 2020327
  misc_feature (1)..(142): Pfam Name: FGGY_N Pfam Description: FGGY family of carbohydrate kinases, N-terminal domain
  misc_feature: SWISSPROT Homolog: EC 2.7.1.30 Glycerol kinase
LESELSGGRTHFVETCGLPISTYFSALKLLWLMENVDAVKDAVRTGDALFGTIDTWLIWNLTGGVAGGQHVTDCSNASRTMLMNLKTLDWDKPTLDALGISAAILPKIISNSEKIGVVVNGFPLAGVPISGCLGDQHAAMLGQLCQKGEAKSTYGTGAFILLNTGEEPTESSHGLLSTIAYKLGPTAPTNYALEGSIAIAGAAV

SEQ ID NO: 44356 - DNA, 651 bp, Panicum virgatum
  misc_feature: Ceres CLONE 2020328
  misc_feature: Encodes the peptide sequence at SEQ ID NO. 44357
aacgaacgctaaaaaagtaacagtttctgtactttattgctttttcggaatgtctgcccccaaggacaccaacgcccccgccaccgccgccgccgacgacgacgacgtgcctgccctcgaggacgcgtcgaacgtcgttgcggacaacacggccgccgcgggcagcaagggctcgaagcgctacgccaaggccatgtcgaagctcggcctgaagccggagcccaacgtgctgcgcgtgcagatccgcaagtcgcccggcctggcgttcggcatcgcgaagcctgaggtgtaccgcttccccggcacgaacacgttcgtgatcttcggcgagacgcagttcgaggagatgggctcggatgtgcacaaggctgctgccgccgtgacgtctgcgacgtcggaggcgaagcctgctggcgccgccgctgccgaggaggaggagggtgaggtggacgcgtccgggctgcaggagaaggagatcgacattgtgatgacgcaggcgaacgtgagccgtgcccgcgctgtccgtgcgctgaagaacaacaacggcgacatcgtcaactcgatcatggagctcaccatgtaagttgccttcttccgaatcttcaagcagcgggaaaagcatacagcatcccttcctctctccatacctag

SEQ ID NO: 44357 - protein, 193 aa, Panicum virgatum
  misc_feature: Ceres CLONE 2020328
  misc_feature (56)..(115): Pfam Name: NAC Pfam Description: NAC domain
TNAKKVTVSVLYCFFGMSAPKDTNAPATAAADDDDVPALEDASNVVADNTAAAGSKGSKRYAKAMSKLGLKPEPNVLRVQIRKSPGLAFGIAKPEVYRFPGTNTFVIFGETQFEEMGSDVHKAAAAVTSATSEAKPAGAAAAEEEEGEVDASGLQEKEIDIVMTQANVSRARAVRALKNNNGDIVNSIMELTM

SEQ ID NO: 44358 - DNA, 516 bp, Panicum virgatum
  misc_feature: Ceres CLONE 2020345
  misc_feature: Encodes the peptide sequence at SEQ ID NO. 44359
gcccccaccagctccaagcactccaaggctaaggcacccgcggccagcgaggccgacgcacccggcccggccggcgacggcgtcgccgccgataccgcggctgctggaaggaccgtggcaggcggcatcatggcggccgtgctgggcctcgccgccctcctcgcctagagacacggacgccgaacgcgcgcgcgcgcgagcggcacggccgggtccgcctccggccgccgggacgacgcgccacgccacacgcccacaacgacagaattatgccgccgccgtgccggacggctcgactcgacgcctggccggagctcgcgtgccaccccgtttccgcgccgtgttcctgtccatttttttctctctaacaggctgggcgggaccacacgcctctgctgtgtgtcgttccactcacgtacctcggattccttcttcttcttcttcttttttctgtactgcagcagctgctgctgctccggtgctaccccattgagatgatttatttatatctttatt

SEQ ID NO: 44359 - protein, 55 aa, Panicum virgatum
  misc_feature: Ceres CLONE 2020345
  misc_feature: Functional homolog of the protein sequence given in SEQ ID NO 50275
  misc_feature: Useful for making plants with altered carbohydrate content
APTSSKHSKAKAPAASEADAPGPAGDGVAADTAAAGRTVAGGIMAAVLGLAALLA

SEQ ID NO: 44360 - DNA, 696 bp, Panicum virgatum
  misc_feature: Ceres CLONE 2020353
  misc_feature: Encodes the peptide sequence at SEQ ID NO. 44361
aaccgcttcagagggaggcggaaatttcccctccctcgatcgactccagcgtccccttcctaggatcggccccaattccgcgtcgcccaacaatcaatcgcaatccacccccaccccccccccccccccccctcttcgagtcgccccccctttggatttcgccggattcgatgaagaagatcttcggcgccaagaagaacaaggacccgccgcccaccatcgaggacgcaaccgaacgaatcaccaagcgcggcgacaccgtcgatgagaagatcaagaagctcgatgccgagctcgcgcgctacaaggagcagatcaagaagacgcgcccgggccccgcgcaggaggccgtcaaggcacgggccatgagggtcctcaagcagcggaggatgtatgaaggacagcgtgacatgctgtacaaccaaacatataatcttgaccaagttgcttttgcagcggagggacttaaagatgctcaacaaactatgactgcaatgaaggttgccaacaaagatctgaaaggaatgatgaaaactgtcaagctcgaagatatagatagcatgcaagatgagatgatggatcttatggacgtgagcaatgagatacaagaaactcttggtagaagctacaacgtccctgatgatattgacgaggaagaacttatgggtgaacttgatgctctggaagctgatatgg

SEQ ID NO: 44361 - protein, 175 aa, Panicum virgatum
  misc_feature: Ceres CLONE 2020353
  misc_feature (12)..(174): Pfam Name: Snf7 Pfam Description: Snf7
MKKIFGAKKNKDPPPTIEDATERITKRGDTVDEKIKKLDAELARYKEQIKKTRPGPAQEAVKARAMRVLKQRRMYEGQRDMLYNQTYNLDQVAFAAEGLKDAQQTMTAMKVANKDLKGMMKTVKLEDIDSMQDEMMDLMDVSNEIQETLGRSYNVPDDIDEEELMGELDALEADM

SEQ ID NO: 44362 - DNA, 635 bp, Panicum virgatum
  misc_feature: Ceres CLONE 2020355
  misc_feature: Encodes the peptide sequence at SEQ ID NO. 44363
gtggggcgccggtgcgtgcccaaaacaagcaagcgcagcgtagaggcgccaacgcgcgaggagcggtgggaagtgggatggcggcggccatggacatggaggacgacgaggacatctggggggacgccgccagcagccccagcgcggttccgccgcagccgctcgccgcggccgcggcctccccttgcggcgccttcatctccacgcagctcagcctcagctcccgcctccacctcctctccaccgcgggcggctcctccgccggcatctacgccgcggacggcgggcgccgccacatggacctcggcgccggcttccgcaatgccgccgcgtccccggcgcccttcttctccgcctacaaccccgacgccggcgccgcccgcagcgcgctcgaggacgagatgtgcctcggccccggcgcggcggcggccgcctgggccggggccggggccggggccggaggctccgaccgccgcaagaagcgcatgatcaagaaccgcgagtccgcggcgcgctcccgcgcgcgcaagcaggcctacgtccgcgagctggagcaggaggtgcagctcctgcagcaggagaacgagagcctccgcgtcaagtacgagcagctgagggcgtccgtggaggtggcg

SEQ ID NO: 44363 - protein, 181 aa, Panicum virgatum
  misc_feature: Ceres CLONE 2020355
  misc_feature (124)..(180): Pfam Name: bZIP_1 Pfam Description: bZIP transcription factor
MDMEDDEDIWGDAASSPSAVPPQPLAAAAASPCGAFISTQLSLSSRLHLLSTAGGSSAGIYAADGGRRHMDLGAGFRNAAASPAPFFSAYNPDAGAARSALEDEMCLGPGAAAAAWAGAGAGAGGSDRRKKRMIKNRESAARSRARKQAYVRELEQEVQLLQQENESLRVKYEQLRASVEV

SEQ ID NO: 44364 - DNA, 693 bp, Panicum virgatum
  misc_feature: Ceres CLONE 2020361
  misc_feature: Encodes the peptide sequence at SEQ ID NO. 44365
cggagctgataaagcgcgggcaagcctcacccacctcatctcactccagagtccagacttccagagccagccagccgcttaatttgatttgaacaaccagcggcttaatttgattaagcgatcgatctcggttggagttcttggagcgcgcgtcgtgggcccacgtacgttcatggacggcaagcttggcgtgcaccaccacagcggcatctccaagccgccggtgcaccaccaccacggcggcaagaggggcgccgggaggcacggcggcggcggcggcggcggcggaggggggagtaagcaggggatcaaggtggtgtacatctccagccccatgaagctcaccgccagcgccgaggagttccgtgccgtcgtgcaggagctcaccggccgcgactccaacatcgccgaccacgacctcgccggcgcctactacgcgggcgcgccgtcgtcgtcgtcctcctcctcctcctcctcgtcctacgcatcgttcgggcgcgtgtccccgacgggggccggcgcggcaggcggcgccgcacgcgctctgtcgccgacgatggccacgggggcgagcgtcggcgcgggacgggcggccgagtacggcgccgcgatggccgcgccgccgccattccagggcatgtacgatcaaactgccgggagcttgctttacggcctggactactggtagggacg

SEQ ID NO: 44365 - protein, 171 aa, Panicum virgatum
  misc_feature: Ceres CLONE 2020361
  misc_feature (50)..(80): Pfam Name: VQ Pfam Description: VQ motif
MDGKLGVHHHSGISKPPVHHHHGGKRGAGRHGGGGGGGGGGSKQGIKVVYISSPMKLTASAEEFRAVVQELTGRDSNIADHDLAGAYYAGAPSSSSSSSSSSSYASFGRVSPTGAGAAGGAARALSPTMATGASVGAGRAAEYGAAMAAPPPFQGMYDQTAGSLLYGLDYW

SEQ ID NO: 44366 - DNA, 562 bp, Panicum virgatum
  misc_feature: Ceres CLONE 2020365
  misc_feature: Encodes the peptide sequence at SEQ ID NO. 44367
tccggcgtgcggggtgacgagtcgggcctggaggacgaccctttccccgaggaagggcctgtggatctggatgagggaggtgaaggagaaatcggcgccggaggcgacgaggaggaggaggacgtctccggcctcgccggcttcctcgaatcggagatactgtccggatccatcgccgaggatgctatcgataaggaggaggaggaggaggaaggggatatggcgaataataagcggaaacaggactcccgatctgacggagatggtggcgacggcagtggcagcgagggggagcagaacaagaggatgaggagggaggagaggaggaggcaggcgaaagggaaatccgtggcgcttcagatcgacgcgggcgtgttcaagatcctaccgccggagctgttcctgcagatcttcaagttcctctcctccgaggacctcatctcctgcgcccttgtttgccgtttcatgaatgctgccgcgtccgacgagagcctctggcgccgactgtattgcatgaggtggggactggcctcccctgcctgattcggggagtgcgcatgga

SEQ ID NO: 44367 - protein, 180 aa, Panicum virgatum
  misc_feature: Ceres CLONE 2020365
  misc_feature (124)..(171): Pfam Name: F-box Pfam Description: F-box domain
  misc_feature: SWISSPROT Homolog: EC 1.14.11.27 [Histone H3]-lysine-36 demethylase
SGVRGDESGLEDDPFPEEGPVDLDEGGEGEIGAGGDEEEEDVSGLAGFLESEILSGSIAEDAIDKEEEEEEGDMANNKRKQDSRSDGDGGDGSGSEGEQNKRMRREERRRQAKGKSVALQIDAGVFKILPPELFLQIFKFLSSEDLISCALVCRFMNAAASDESLWRRLYCMRWGLASPA

SEQ ID NO: 44368 - DNA, 683 bp, Panicum virgatum
  misc_feature: Ceres CLONE 2020366
  misc_feature: Encodes the peptide sequence at SEQ ID NO. 44369
tgagtaccaaaaccacctgcaaagtgcaaacccatcgaaacactctgctctgcttgtagctagctagcagccatggcttctactacttgttgccttagcctgttagtgctggtagcgctggcctcggtggcgtcggcgcagctgtcgtcgacattctacgacacgtcgtgccccagggccctggccaccatcaagagcgccgtcaacgcggcggtggccaaggaggctcgcatgggggcgtccctgctcaggctgcacttccacgactgctttgtccaaggctgtgatgcgtccattctgctggcggggaacgagcagaacgatcctccgaatttaactctgagaggcttcgacgtcatcgccaacatcaaggcgcaggtggaggccatctgcaagcagaccgtctcctgcgccgacatcctcgccgtcgccgcccgcgactccgtcgtagcgctgggaaggccgtcatggagtgttccgctggggagacgggactcgcccaaagctgcaagcacgagcacggtaaatcagtttctgatcccccctacagctagcctcgccgaactgattaaagggtacggcgacttgggcctcaacccaaccgacatggttgccctctcaggtacggtgcatgcatagtatctgttccaatcacaagtactcttccgtgacttttgttaagt

SEQ ID NO: 44369 - protein, 188 aa, Panicum virgatum
  misc_feature: Ceres CLONE 2020366
  misc_feature (40)..(187): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
  misc_feature: Functional homolog of the protein sequence given in SEQ ID NO 50229
  misc_feature: Useful for making plants with altered cell wall content and/or composition
MASTTCCLSLLVLVALASVASAQLSSTFYDTSCPRALATIKSAVNAAVAKEARMGASLLRLHFHDCFVQGCDASILLAGNEQNDPPNLTLRGFDVIANIKAQVEAICKQTVSCADILAVAARDSVVALGRPSWSVPLGRRDSPKAASTSTVNQFLIPPTASLAELIKGYGDLGLNPTDMVALSGTVHA

SEQ ID NO: 44370 - DNA, 696 bp, Panicum virgatum
  misc_feature: Ceres CLONE 2020394
  misc_feature: Encodes the peptide sequence at SEQ ID NO. 44371
tgatcccaaacacacattctagctattcaacaagctacctagcttctaacacttgtaagctatagctagctgatagcatggcgccatccaagcttgccctgttcctcgccctgacgacagtcctcgccttcgcggcggacgtcgtccatggctgcgcgccgtactgtcctaccactacaccgccggtcgttcctccgccgccagtcgtgccgacgccgtccggtggtggtggatcttgcccgatcaacgcgctgaagctgcaggtgtgcgctaacgtgctgaacctactgaagctcaacatccctgggttggggaacgaccagtgctgcccgctgctgcaggggctcgtcgaccttgacgccgccgtctgcctctgcaccgccatcaaggccaacatcctcggcatcaacctcaatgtgcccatcgacctgagcctcctcctcaaccactgtggcaaggtctgccctgcagacttcacctgccccctttaagtgactggttgatgaaacaacctacaatacgtccaggcatcatctgatcatgtctcgatctccttgtactcaacctgtgttgcaagtctgtgttggttttacatctgcatgcatgcatatggtctctttctctttgggtccgggttatcgctcgggtgagctctgtgcaaactgtccgttgttgtcgttcatacaaacatatatc

SEQ ID NO: 44371 - protein, 137 aa, Panicum virgatum
  misc_feature: Ceres CLONE 2020394
  misc_feature (54)..(135): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MAPSKLALFLALTTVLAFAADVVHGCAPYCPTTTPPVVPPPPVVPTPSGGGGSCPINALKLQVCANVLNLLKLNIPGLGNDQCCPLLQGLVDLDAAVCLCTAIKANILGINLNVPIDLSLLLNHCGKVCPADFTCPL

SEQ ID NO: 44372 - DNA, 732 bp, Panicum virgatum
  misc_feature: Ceres CLONE 2020397
  misc_feature: Encodes the peptide sequence at SEQ ID NO. 44373
agggtttttatcctcttctccagccgccgccgcgccaccggccgctcctccatcccttctgccaatggcgaccactcacgcgatcagcaagaagcggaagttcgtggcggatggcgtgttcttcgcggagcttaacgagatgctcacccgtgagctcgccgaggacggctactccggcgtcgaggtccgtgtcacccccatgcgcaccgagatcataatccgcgccacccgcacccagaacgtcctcggcgagaagggcaggaggatcagggaactgacttctgtggttcagaagcgcttcaacttcccggagggcggcgtcgagctctatgccgagaaggtgaacaaccgcggcctctgcgccattgcccaggctgagtcactccgctacaagctcctcggtggactcgccgtcagaagggcatgctatggtgttctacggtttgtcatggagagtggtgccaaaggctgtgaggttattgttagtgggaagctcagggcccaacgtgctaaatccatgaagttcaaggatggatacatgatctcttctggccatcctgtcaacctatatattgactcagctgtgaggcatgttctcctgagacaggagatcaggttcttttccttgtctatctcaaagacaccacgcgctggtgctgtggagtgagacgcttggatgatttgcaatgtgatgttatctccagtatgtttaggagtcgctaactgctgtac

SEQ ID NO: 44373 - protein, 200 aa, Panicum virgatum
  misc_feature: Ceres CLONE 2020397
  misc_feature (106)..(190): Pfam Name: Ribosomal_S3_C Pfam Description: Ribosomal protein S3, C-terminal domain
  misc_feature (47)..(104): Pfam Name: KH_2 Pfam Description: KH domain
  misc_feature: Functional homolog of the protein sequence given in SEQ ID NO 51097
  misc_feature: Useful for making plants with modulated biomass
  misc_feature: Functional homolog of the protein sequence given in SEQ ID NO 51096
  misc_feature: Useful for making plants with modulated water use efficiency
MATTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQEIRFFSLSISKTPRAGAVE

SEQ ID NO: 44374 - DNA, 703 bp, Panicum virgatum
  misc_feature: Ceres CLONE 2020398
  misc_feature: Encodes the peptide sequence at SEQ ID NO. 44375
aaggcggctggccggacgggaggagcagagagcagagcacccagagccaggaggaagaagaggaaggcgaagcgaaggtccgagcctccgaggatgccgtgcctgaacgtgtcgacgaacgtcaacctggagggggtggacacctctgccatcctcggcgaagcctccacggccgtcgccaacatcatcggcaagccagaggcctacgtgatggttgttctcaagggttcagtgcctatggcatttggaggtacccaggagcctgcagcttatggtgagctggtttccattggagggctgaaccctgatgtcaacaagaagctgagtgctggcattgcttctattctggagtcaaagctgtccgttcccaagtcccgcttctacctcaagttccacgattcaaagcgctcggactttggttggaatggctccaccttctagattcgaggtccatgggtgtggctccaccgctccagtgaaggaagatcgtcttccctaatgtcttgtccattgcataatggcctaataaggactctgttgtaagatgtcagttaatttgtgctgaactgaagtgaaaactgtcatgcggaactggggcacagacttgttcaatgcaacctagcatattcgtgcacaaaaaaaaaaaaaaaatcagtctcagcaggatagagaggcagaggcggagaaggcggctggccggacg

SEQ ID NO: 44375 - protein, 115 aa, Panicum virgatum
  misc_feature: Ceres CLONE 2020398
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase
MPCLNVSTNVNLEGVDTSAILGEASTAVANIIGKPEAYVMVVLKGSVPMAFGGTQEPAAYGELVSIGGLNPDVNKKLSAGIASILESKLSVPKSRFYLKFHDSKRSDFGWNGSTF

SEQ ID NO: 44376 - DNA, 669 bp, Panicum virgatum
  misc_feature: Ceres CLONE 2020403
  misc_feature: Encodes the peptide sequence at SEQ ID NO. 44377
atcacgacccaattcatcgtcgcctcggtgcctccgccggccgccgccgcagcgcgccggcgagcgtacgaaggggggcgaatcctcccgcgcctcgcgcgtgcctccagagcctgcgacggaggggggcgccagccatggccctccggccgtcaacctcctgccaccgcgccgcgcccttcgctccagccgccgccgcctcggcgcgcccccggagggggaccctgtgcctcgcggcagccagcaggcctgccgccgcgctgcggacccgccccgacgcggcaggccggaggaggtgtgagtgcttcgacctccatcaccagatagttccttacgcggaggctttcgcttggcagaagtccattgttaagaggaggatagggttgctggccagtggcgaggatccctcggacaccttgattgctttacaacatccaccggtttatacgttgggctctgacagcaacagggaatacctccattttaacagggaagatgctccttttgaggtccatcagattgaccgtggtggggaagtgacgtatcatggccctggacagcttgttatgtacccgattctcaatttgcggtaccacaaagaggatcttcattggtactttaggtcacttgaagaagtgatcatccgtgcactgaaatccgcattcttca

SEQ ID NO: 44377 - protein, 177 aa, Panicum virgatum
  misc_feature: Ceres CLONE 2020403
  misc_feature (105)..(176): Pfam Name: BPL_LipA_LipB Pfam Description: Biotin/lipoate A/B protein ligase family
  misc_feature: SWISSPROT Homolog: EC 2.3.1.181 Lipoyl(octanoyl) transferase
MALRPSTSCHRAAPFAPAAAASARPRRGTLCLAAASRPAAALRTRPDAAGRRRCECFDLHHQIVPYAEAFAWQKSIVKRRIGLLASGEDPSDTLIALQHPPVYTLGSDSNREYLHFNREDAPFEVHQIDRGGEVTYHGPGQLVMYPILNLRYHKEDLHWYFRSLEEVIIRALKSAFF

SEQ ID NO: 44378 - DNA, 722 bp, Panicum virgatum
  misc_feature: Ceres CLONE 2020404
  misc_feature: Encodes the peptide sequence at SEQ ID NO. 44379
agcgtcttccccaacctgcacgagctctcgtctccggcggcggaagcggaaggaagcaggcggccaccatggtgaagggacgcacggggcagcgcgtcaggctctacgtccggggcactatcctcggatacaagaggtctaagtcgaaccagtacgagaacacgtcgctggtgcagatcgagggggtgaacaccaaggaggacgtcgcgtggtacgccggcaagcgcttggcgtacatctacaaggccaagaccaagagcagcgagacccgctacaggtgcatctggggcaaggtcacccgcccgcacggcaactccggcgtcgtccgcgccaagttcaggtccaacctcccgccggagtccatgggacgcaaggtcagagtgttcatgtacccgagcagcatctaaggttttgttggagtagggatggccatgattatttcttacttatcttgagttgaaaattccatgttttggtgaaccactgctgtgttggcaacttagtttgttcatgtactgtgaacatgtgtaagttttgccaaaatttgttgtctaaaggatgaaccattatcgtaatgttatgccagcaccatagcttattttcagcatcagatgccttgccatttttttttattatcttcaatttcctacggcaatattttccctgtggtcagtttgccatgttcatgctccataatatatattatgtatcaaataacgtgc

SEQ ID NO: 44379 - protein, 112 aa, Panicum virgatum
  misc_feature: Ceres CLONE 2020404
  misc_feature (12)..(106): Pfam Name: Ribosomal_L35Ae Pfam Description: Ribosomal protein L35Ae
MVKGRTGQRVRLYVRGTILGYKRSKSNQYENTSLVQIEGVNTKEDVAWYAGKRLAYIYKAKTKSSETRYRCIWGKVTRPHGNSGVVRAKFRSNLPPESMGRKVRVFMYPSSI

SEQ ID NO: 44380 - DNA, 694 bp, Panicum virgatum
  misc_feature: Ceres CLONE 2020408
  misc_feature: Encodes the peptide sequence at SEQ ID NO. 44381
accgatcggggtgagaaccaagaaagcaaagggggaaaacggcttggcggttcggctgcacagcacgcagacgcctcccgggcagcatgattgctccccgcccccggcgtctgctcctcctgccggtcgcgctcctccttctcctcctcgccgccgccggcggcgccttgtcgccggcggccgcggagggggcgaagaaggtctccctggtgctctactacgagtcgctgtgcccctactgctcgcggttcatcgtgaaccacctcgccgggatcttcgaggacgggctcatcgacgccgttgacctccggctcgtcccctacggcaacgcccgcgtcggctccaacggcgacatctcctgccagcatggtccatacgagtgcctgctcaacactgtggaagcttgcgccatcgacgcctggccgggtttggacgtgcatttccgtttcatctactgcgtggaggacctggtggtgaagcgccagtacaaggagtgggagtcctgcttccagaagctggggcttgacccgaagcccgtaactgaatgctacaaaagcgaacagggtcacaagcttgagctcaagtacgcgaaccagaccgacgctcttgtgccgccgcaccggtacgtcccgtgggtggtcgtcgacgggcagccactgcttgaggactacgagaacttcgaggcttacgtctg

SEQ ID NO: 44381 - protein, 202 aa, Panicum virgatum
  misc_feature: Ceres CLONE 2020408
  misc_feature (39)..(148): Pfam Name: GILT Pfam Description: Gamma interferon inducible lysosomal thiol reductase (GILT)
MIAPRPRRLLLLPVALLLLLLAAAGGALSPAAAEGAKKVSLVLYYESLCPYCSRFIVNHLAGIFEDGLIDAVDLRLVPYGNARVGSNGDISCQHGPYECLLNTVEACAIDAWPGLDVHFRFIYCVEDLVVKRQYKEWESCFQKLGLDPKPVTECYKSEQGHKLELKYANQTDALVPPHRYVPWVVVDGQPLLEDYENFEAYV

SEQ ID NO: 44382 - DNA, 603 bp, Panicum virgatum
  misc_feature: Ceres CLONE 2020410
  misc_feature: Encodes the peptide sequence at SEQ ID NO. 44383
ggctcaagagaaggctagagaaacaacatatcgacaaagattccaaatgccagagctgcaaggcctcatccaggagcaaaaccccccaatttacctgtgcggtcttcacgtcagcgaggccatacacgtcctcaactacgagctcaacaaccggagaaagatcgcgcggtctactggtcgccgacttcaggccatcatcatatccagtgcccgcacccctgcaaggctgacagctgccgtggagcagtacctcctggaacacggccttcagtacactcaggcgcagccaggcctcttccgtgtcctgctgcagtgacgaaacaggacgggaaggtctaggtgatgttcacgaacaagatcagatgaaaagaaaaaaaaaagttgacttgtacttttgtatatggcagaggtggctagcagaatagaagcgttaagatagctcatgtaatattcgaatatcaggctttttgtcagcaaatgtatacatcgtaaaatttgcgggatttaggggtctaggggatatgttctttcacaatcgttcacccacaatcttgtatgcatgtcgtgctgcaatatgcttatgatcgtctgcctgtgatgttc

SEQ ID NO: 44383 - protein, 104 aa, Panicum virgatum
  misc_feature: Ceres CLONE 2020410
  misc_feature (30)..(104): Pfam Name: Smr Pfam Description: Smr domain
AQEKARETTYRQRFQMPELQGLIQEQNPPIYLCGLHVSEAIHVLNYELNNRRKIARSTGRRLQAIIISSARTPARLTAAVEQYLLEHGLQYTQAQPGLFRVLLQ

SEQ ID NO: 44384 - DNA, 686 bp, Panicum virgatum
  misc_feature: Ceres CLONE 2020442
  misc_feature: Encodes the peptide sequence at SEQ ID NO. 44385
ttgatatgtgccatcgatacctgaaagaaaggaagcagtttggagttccactggcagctttccagctgaaccaagagaaacttgtccggatgctcggtaacatccaatcgatgcttcttgttggctggcgcctatgcaagctttacgagtcggggaaaatgacaccaggccacgccagtctaggaaaggcttggacctccaggacggcccgcgaggtggtttccctcggccgggagttgttgggtggaaatgggattctggccgatttcctggtggcaaaggcgttctgcgacctggagcccatctactcttacgagggcacgtacgacatcaacagcctggtgaccggcagggagatcaccgggatcgcgagcttcaagccggccgcgttagcgaaggcccggctgtgatttctacggctagaagaaacggcacacggatgtgccggttcttctcgtgccggcaactgtgcagaagcaaataaaaaaaaatcaggtcctgctcgatgctcgtgttgccatggttggtggtacacgagacgggagcagctgcggtgtgacctgacgcggacgagacggcgttccctgcaagtgcctggaaaccggcggtcaatgttggctgctcgatgctcgtgatgtgagttggctgctcgatgctcgtgatgtgagagaggactcgtagcgagt

SEQ ID NO: 44385 - protein, 135 aa, Panicum virgatum
  misc_feature: Ceres CLONE 2020442
  misc_feature (1)..(120): Pfam Name: Acyl-CoA_dh_1 Pfam Description: Acyl-CoA dehydrogenase, C-terminal domain
  misc_feature: SWISSPROT Homolog: EC 1.3.3.6 Acyl-CoA oxidase
DMCHRYLKERKQFGVPLAAFQLNQEKLVRMLGNIQSMLLVGWRLCKLYESGKMTPGHASLGKAWTSRTAREVVSLGRELLGGNGILADFLVAKAFCDLEPIYSYEGTYDINSLVTGREITGIASFKPAALAKARL

SEQ ID NO: 44386 - DNA, 677 bp, Panicum virgatum
  misc_feature: Ceres CLONE 2020444
  misc_feature: Encodes the peptide sequence at SEQ ID NO. 44387
atctctagggtttgggattttagccgccgccgccgctcctcacgtccttgagaagtcgcagccgacgtagtcctcgccggatccgatggccgtgactttctctgagcttcacaccgccgacggcctcaaggacctcgaggcgcacctcgccggcaagacctacgtctccggggatgccatcagcaaggacgacattaaggtgtttgcggcggtgccgtcgaagcctggtgccgagttccccaatgctgcccggtggtacgagaccgtcgccgcggctgttgcctccagattccctggcaagggtgttggtgtgaatctgcctggagccggatcggctcctgcggctgaggttgccaaggatgatgatgatgacttggatcttttcggtgatgaaactgaggaggacaagaaggctgcagatgagcgtgcggctgccaaggcctctgccaagaagaaagaaagtggcaagtcctctgtcctgatggacgtgaagccgtgggacgatgaaactgacatgaagaagcttgaggaggctgttcgcagtgtccagatggagggtctcacttggggagcttcaaagcttgtgcctgttggttatggtatcaagaagatgacaatcatgttgaccattgtggacgacctcgtgtcagttgacagtctgattgaggaccacctca

SEQ ID NO: 44387 - protein, 197 aa, Panicum virgatum
  misc_feature: Ceres CLONE 2020444
  misc_feature (128)..(197): Pfam Name: EF1_GNE Pfam Description: EF-1 guanine nucleotide exchange domain
MAVTFSELHTADGLKDLEAHLAGKTYVSGDAISKDDIKVFAAVPSKPGAEFPNAARWYETVAAAVASRFPGKGVGVNLPGAGSAPAAEVAKDDDDDLDLFGDETEEDKKAADERAAAKASAKKKESGKSSVLMDVKPWDDETDMKKLEEAVRSVQMEGLTWGASKLVPVGYGIKKMTIMLTIVDDLVSVDSLIEDHL

SEQ ID NO: 44388 - DNA, 654 bp, Panicum virgatum
  misc_feature: Ceres CLONE 2020460
  misc_feature: Encodes the peptide sequence at SEQ ID NO. 44389
atcctctttcctcctcctcccctcctcccgaagacctaaccaaaccctcgctcctaccacctgccgccgctcgcgccgccgcctgcgccagacgcaactaatatgagtcggtaccctgaagtgaagtgggctcacaggatcgacaaggtttacatcatcgtacagttatctgatgcaaaggatgctaaggtcaatttggatccagatggtgtcttcacattctctggcagtgctggtacaaacttatatgaattgaaactagatctgaatgacaaagtgaatgtggaggctaacaagataagtgtgggtgtcacgtccatattctgtatcatataaaaaactgatgccaaatggtggaagaagcttgttcgggatgatcaaagggcacctcactttgtgaaagttgattgggacaaatgggtggatgaagatgatgacggtggtgatgtcaacttggatgggatggacttctcgaattttggtggcatgggcggtatgggcggcatgggtgatatggctggtctgggcggcatgggtggcatgggtggtctgggcggcatgggtggtctgggcggcatgggtggtatgggtgaatttgaggatgagagtgatgatgaagaagaagtatcaaagcctcaagctgcggagaaggct

SEQ ID NO: 44389 - protein, 77 aa, Panicum virgatum
  misc_feature: Ceres CLONE 2020460
  misc_feature (5)..(77): Pfam Name: CS Pfam Description: CS domain
MSRYPEVKWAHRIDKVYIIVQLSDAKDAKVNLDPDGVFTFSGSAGTNLYELKLDLNDKVNVEANKISVGVTSIFCII

SEQ ID NO: 44390 - DNA, 712 bp, Panicum virgatum
  misc_feature: Ceres CLONE 2020465
  misc_feature: Encodes the peptide sequence at SEQ ID NO. 44391
agagttcagcaacgccggggcacacaagcaaagccggccaaccatgtccgagtccggcggcatgccaccccagcgccacatcgagcaccacggcccccagaaattccgccgccgccgcgtcgtcctctacctcgccttcgccgccctcgccctgctcctcgtcgccgcggcggccgccatcgccctgctcgccgtcctccgcccgcgggaccccgtcacggagctcctctcggtcaccgtcacgggcgccctcccgcgcgtcgtcccgctccccaccgtctccgtgcagctcaacctcacgttcctcctcgtggtccgcgtgcggaacccgaacccggccgcgttccgccacggccccgccgccacgtcgctctactaccgcggcgcggccgtgggctacggcgaggtcccggccgggaccgtgccgagccggggcggggccaccgtgcggatgaacatgacggtgcaggcggaccgggtcgtggcggccgccgggatcgggggcctcgtcgcggacgtggtggccggcgagatggagttcgaggcgaggaccgaggtgccgggcacggtcacgctcctcgggatcgtgaagcgcggcgtcgaggccaggtcggtgtgccgcgtcgtcatcggcgtcgccgacgtcagcgttcggggtcaggagtgccacaacgaggccaggctgttagaagtcgttgatctcgacgatcgt

SEQ ID NO: 44391 - protein, 222 aa, Panicum virgatum
  misc_feature: Ceres CLONE 2020465
  misc_feature (49)..(192): Pfam Name: Hin1 Pfam Description: Harpin-induced protein 1 (Hin1)
MSESGGMPPQRHIEHHGPQKFRRRRVVLYLAFAALALLLVAAAAAIALLAVLRPRDPVTELLSVTVTGALPRVVPLPTVSVQLNLTFLLVVRVRNPNPAAFRHGPAATSLYYRGAAVGYGEVPAGTVPSRGGATVRMNMTVQADRVVAAAGIGGLVADVVAGEMEFEARTEVPGTVTLLGIVKRGVEARSVCRVVIGVADVSVRGQECHNEARLLEVVDLDD

SEQ ID NO: 44392 - DNA, 672 bp, Panicum virgatum
  misc_feature: Ceres CLONE 2020475
  misc_feature: Encodes the peptide sequence at SEQ ID NO. 44393
agcccgacgcgcaggcagcgagccaagtaaaccgtccgaggcgagccccacctccgcgttcacacgcggagaggcgggcgattacaagggcaatccaatccctccctcctctcgtttcgattcgcgccatggaggcgcaggcgcaggacagggcggaggaggccgaggccgccgcgcggcagcacgcggtgggggcggggggcgcggcggcggcggcgggggtggcgatgggcgcgatccccatgcacgggttcatggtcccgaagccggagccggtggagtacttcggcgggatggcggtggtgcgcagcaagccgccgccgcggaaccgcgaccggcacaccaaggtggagggccgcgggcggcggatccgcatgccggcggcgtgcgcggccaggatcttccagctgacgcgggagctagggcacaagtccgacggcgagaccatccggtggttgctgcagcagtcggagcccgccatcatcgccgccaccggcaccggcacggtcccggcgatcgcgaccaccgtcgacggcgtcctccgcatccccacgcagtcgtcctcctccagcccctcgtccctcgccatggtcgacggcgaggagtcctccgccaagcgccgccggaagctgcagcccacgcgcgccgcggcgggcgcgtccccgctcgccc

SEQ ID NO: 44393 - protein, 181 aa, Panicum virgatum
  misc_feature: Ceres CLONE 2020475
  misc_feature (48)..(174): Pfam Name: TCP Pfam Description: TCP family transcription factor
  misc_feature: The sequence is a functional homolog of SEQ ID NO 941 in the 11/479,226 US patent application
  misc_feature: The sequence is a functional homolog of SEQ ID NO 1391 in the 10/374,780 US patent application
  misc_feature: Functional homolog of the protein sequence given in SEQ ID NO 51691
  misc_feature: Useful for making plants with modulated low light sensitivity
  misc_feature: Useful for making plants with modulated nitrogen use efficiency
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
MEAQAQDRAEEAEAAARQHAVGAGGAAAAAGVAMGAIPMHGFMVPKPEPVEYFGGMAVVRSKPPPRNRDRHTKVEGRGRRIRMPAACAARIFQLTRELGHKSDGETIRWLLQQSEPAIIAATGTGTVPAIATTVDGVLRIPTQSSSSSPSSLAMVDGEESSAKRRRKLQPTRAAAGASPLA

SEQ ID NO: 44394 - DNA, 708 bp, Panicum virgatum
  misc_feature: Ceres CLONE 2020480
  misc_feature: Encodes the peptide sequence at SEQ ID NO. 44395
gtttccgcttcttttctgtgtgttcgatcaggtggtttcgatgggtggcagcggaacgctgatctcggtttatcccgaggagctcaccttcttgtttgagctggacaaggcctgctattgcaatctcaaggtggtgaacaacagcgagcaccatgtcgcattcaaggtcaagacgacatcgccgaggaagtatttcgtccggccgaacgcgagcatcgtccagccatgggattcttgcacgataacgattacgctccaggcacagaaggagtacccaccagacatgcactgcaaggataagttcttgattcagagcacgaaggtgcctgccagtaccgatatggacgagatcccccctgatactttcaacaaggaagctgataaggttatcgaggaaatgaagcttaaggttgtttacacattacctagtggaggctcagacgactctagtgtttcatctttgggaagcaggagcttcaaagcagcgtctgatgatttgacactgctgaagaacgcaagcattgaagagatccagacaattcagcgcctgaaggatgaaagagataacatgcttcagcaaaatcagcaaatgcaacgtgaattggatgtgctccggaggcgtcggagccgcaaaggcgacacgggtttctccttgacgttcgccgcgttcgctggcctaataggtgtcctggtcggactcctgttgac

SEQ ID NO: 44395 - protein, 222 aa, Panicum virgatum
  misc_feature: Ceres CLONE 2020480
  misc_feature (7)..(115): Pfam Name: Motile_Sperm Pfam Description: MSP (Major sperm protein) domain
MGGSGTLISVYPEELTFLFELDKACYCNLKVVNNSEHHVAFKVKTTSPRKYFVRPNASIVQPWDSCTITITLQAQKEYPPDMHCKDKFLIQSTKVPASTDMDEIPPDTFNKEADKVIEEMKLKVVYTLPSGGSDDSSVSSLGSRSFKAASDDLTLLKNASIEEIQTIQRLKDERDNMLQQNQQMQRELDVLRRRRSRKGDTGFSLTFAAFAGLIGVLVGLLL

SEQ ID NO: 44396 - DNA, 587 bp, Panicum virgatum
  misc_feature: Ceres CLONE 2020481
  misc_feature: Encodes the peptide sequence at SEQ ID NO. 44397
agctagggttttcggctccgatctcgcgccgccgccacgactctcggacggacggaggaggaagctacagctctgcagccatggtgaacgttccaaaaaccaagaagacctactgcaagaacaaggaatgcaagaagcacaccctgcacaaggttacccagtacaagaaaggaaaggatagcctttcagctcaagggaagcgtcgttatgaccgcaaacagtcaggatatggtggtcagacaaagcctgttttccacaagaaggccaagacaacgaagaagattgtgttgaagctgcagtgccagagctgcaagcactactctcagcacgcgatcaagaggtgcaagcactttgagattggtggcgacaagaagggcaagggaacttctctcttctaagctgatgttaaaacttgttctaggccccaatttgtcttgcaggaattaccattaggaatgttttatgctatccttagtgaggtacatgggaacccactactggggcgtatcaagatatatcttgtgctttgtatctgcatcaactgttttgtcagataaatttggtacaatatagtttgtacaagacag

SEQ ID NO: 44397 - protein, 105 aa, Panicum virgatum
  misc_feature: Ceres CLONE 2020481
  misc_feature (19)..(95): Pfam Name: Ribosomal_L44 Pfam Description: Ribosomal protein L44
MVNVPKTKKTYCKNKECKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 44398 - DNA, 708 bp, Panicum virgatum
  misc_feature: Ceres CLONE 2020486
  misc_feature: Encodes the peptide sequence at SEQ ID NO. 44399
gacgggattgaatcaatcatgccgaggagtccgcagctaagtctgagcggctgcagctcgctcttctctctgtccagcaccagcacgagccgcgacaacgacagcgctgccgcggcgcccgtgccgccaccgccgccgtctctccacccgctgcccccaggccgccctcttctgtcgctcagcgtcggcggcggtggggaggaggaacaggatgatgaggaggagtacctgctgggcggcctggatctgcagctgactggggccggcggcagcaacagcagcggctgctgcgacggcgacgacgagcgcaagaacatccggatgatgaagaacagggagtccgcgctccgctccagggcaaggaagagggcgtatgtgcaggagctggagaaggaggttcgtcgcctggtgaatgagaacctcaagctcaagaggcagtgcaaacaactccaagtggagatggctgcactgatccagccaagcagcagcaggagtaacccccacatcagaagagctgcctcctccactcagctctagctccttacttgttatgtttccttgcaaaatttaagtatcttcgtcttcattagctacaactccttggactgtggtacaaggagcgtaaaaataatcatcctcttgccaatgcctcgattatgtcagttgcatctactacagcttctgctgatccagcacctgctctttccc

SEQ ID NO: 44399 - protein, 172 aa, Panicum virgatum
  misc_feature: Ceres CLONE 2020486
  misc_feature (93)..(156): Pfam Name: bZIP_1 Pfam Description: bZIP transcription factor
  misc_feature: The sequence is a functional homolog of SEQ ID NO 933 in the 10/374,780 US patent application
MPRSPQLSLSGCSSLFSLSSTSTSRDNDSAAAAPVPPPPPSLHPLPPGRPLLSLSVGGGGEEEQDDEEEYLLGGLDLQLTGAGGSNSSGCCDGDDERKNIRMMKNRESALRSRARKRAYVQELEKEVRRLVNENLKLKRQCKQLQVEMAALIQPSSSRSNPHIRRAASSTQL

SEQ ID NO: 44400 - DNA, 491 bp, Panicum virgatum
  misc_feature: Ceres CLONE 2020505
  misc_feature: Encodes the peptide sequence at SEQ ID NO. 44401
tatcatgaaatcggtcattccagtcattatggctggtattatagccatctacggcctggtcatatcagttctaatcgtcaacaaaatggacgagaatagatactcgctctacaagggctttcaccacttgggcgctggtctaagcgtcggtttgtcgggtttggcggccggttttgccatcggcatcgtcggagatgcgggcgttcgaggcacagctcaacagccacgtctctacgtcggcatgattttgattctcatcttcgccgaggtcttgggtctctatggcttgatcgcttctattattttgatcaccacgcctggcgagtcgatctgctaagcgattgatcggagaaggaattttatatttcagattattttatcgtaatcgacttggatattggatatcgttttaaataaatgctttactattcatatttatttcgcttttttgggttttttatatttaatttaataaattttattaaaatttt

SEQ ID NO: 44401 - protein, 111 aa, Panicum virgatum
  misc_feature: Ceres CLONE 2020505
  misc_feature (40)..(105): Pfam Name: ATP-synt_C Pfam Description: ATP synthase subunit C
  misc_feature: SWISSPROT Homolog: EC 3.6.3.14 H(+)-transporting two-sector ATPase
IMKSVIPVIMAGIIAIYGLVISVLIVNKMDENRYSLYKGFHHLGAGLSVGLSGLAAGFAIGIVGDAGVRGTAQQPRLYVGMILILIFAEVLGLYGLIASIILITTPGESIC

SEQ ID NO: 44402 - DNA, 691 bp, Panicum virgatum
  misc_feature: Ceres CLONE 2020515
  misc_feature: Encodes the peptide sequence at SEQ ID NO. 44403
gatgacctccttgtttaagccacggggaactgaagatgatggcctcattcgggaatcactgattgacttctatactagctctggaaagcgaaaacctgaccatgttattattttcagggatggagttagtgaaagccaatttacccaggtcataaacattgaactcgatcagatcattgaggcatgcaagtttctcgatgagaagtggtcgcccaagttcactgtgattgtagctcagaagaaccatcataccaagttttttcagactggatctccagataacgttcctccgggtactgttgtggacagcaaagtgtgccatcctaggaactttgacttctacatgtgtgcacatgctgggatgattggaacaacaaggccgacgcattatcatgttctccacgatgagataggcttctctgctgatgacatgcaggagtttgttcattcgctctcttatgtgtatcaaaggagcacaacggccatctccgtagttgctccaatttgctatgcccatctcgccgcagcgcaggtcggttcgttcctgaaatttgaggagatgtcagatgcctcctccagccagggagggcatacctcggtgggcagtgcacccgtgccagagctgccacgtctgcatgagaaagtcaggagctctatgttcttctgctaatgcgctcaaactgtagcacac

SEQ ID NO: 44403 - protein, 222 aa, Panicum virgatum
  misc_feature: Ceres CLONE 2020515
  misc_feature (1)..(183): Pfam Name: Piwi Pfam Description: Piwi domain
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
MTSLFKPRGTEDDGLIRESLIDFYTSSGKRKPDHVIIFRDGVSESQFTQVINIELDQIIEACKFLDEKWSPKFTVIVAQKNHHTKFFQTGSPDNVPPGTVVDSKVCHPRNFDFYMCAHAGMIGTTRPTHYHVLHDEIGFSADDMQEFVHSLSYVYQRSTTAISVVAPICYAHLAAAQVGSFLKFEEMSDASSSQGGHTSVGSAPVPELPRLHEKVRSSMFFC

SEQ ID NO: 44404 - DNA, 682 bp, Panicum virgatum
  misc_feature: Ceres CLONE 2020518
  misc_feature: Encodes the peptide sequence at SEQ ID NO. 44405
ctctgtcgccgtctgacgcgactggttaccagttcctcgagcgccgagcgccgaggcagaccagatctgtggctccccaaaggcttcgacgcttcgtacgcagcctcaacagtcaacgccggtaggctccaccagaggttctgtggctccgaagtatggccggccacttcgtcctcaacaccggcgccaagatcccgtctgtcgggctcggcacctggcaggccgaccccgccgtcgtcggcgaagccatctacgccgccgtcaaggcaggttacaggcacatcgactgtgctcaagcataccacaacgaaaaggaggtcggattgggtctcaagaaagcgctcgacgagggcatagtgaagcgtgaggttctcttcatcacctccaagctctggaacaccaaccatgcgccagaggacgtcccagttgcgctggacggcacgctgaaagccctgcagacggattacgtggatctttacctcgtccactggccggtgagcatgaagaaaggcgccgggtttggcccgcaaagcattatcccgtcagatattccggcgacctgggcggcgatggagaagctgtacgacgccgggcaagcgcgcgccatcggcgtcagcaacttctcgagcaagaagctggcggacctgctcgccgtggcgcgcgtgcccccggccgtcaacca

SEQ ID NO: 44405 - protein, 175 aa, Panicum virgatum
  misc_feature: Ceres CLONE 2020518
  misc_feature (7)..(175): Pfam Name: Aldo_ket_red Pfam Description: Aldo/keto reductase family
  misc_feature: SWISSPROT Homolog: EC 1.1.1.21 Aldehyde reductase
MAGHFVLNTGAKIPSVGLGTWQADPAVVGEAIYAAVKAGYRHIDCAQAYHNEKEVGLGLKKALDEGIVKREVLFITSKLWNTNHAPEDVPVALDGTLKALQTDYVDLYLVHWPVSMKKGAGFGPQSIIPSDIPATWAAMEKLYDAGQARAIGVSNFSSKKLADLLAVARVPPAVN

SEQ ID NO: 44406 - DNA, 611 bp, Panicum virgatum
  misc_feature: Ceres CLONE 2020525
  misc_feature: Encodes the peptide sequence at SEQ ID NO. 44407
acagccaaaagccaacaacaaccgccgccacacccaccaccaaattcccaatcagccgcttcccaagctcggccgccgactccacccgctcgatcccgtgatggcgcccaaggccgagaagaagcccgccgagaagaagccggcggaggagaaggccgagaagcgcgtgccgggctccggcaaggagggcggcgagaagaaggggaagaagaaggccaagaagagcgtcgagacctacaagatctatatcttcaaggtcctcaagcaggtgcacccggacattggtatctcctccaaggccatgtctatcatgaactcgttcatcaacgacatcttcgagaagctcgcccaggaggccgcccgcctcgcgcgctacaacaagaagcccaccatcacctcccgggagatccagacctcggtgcgcctcgtcctccccggagagctcgccaagcacgccgtctctgagggcaccaaggccgtcaccaagttcacctcctcttagattgccgcacggttttcttttcctccgatgtttagcgcagtgttaggttgctcgtggaacaatgtagaattgtttacgttagctgaatgataatcaatggccattgtgg

SEQ ID NO: 44407 - protein, 133 aa, Panicum virgatum
  misc_feature: Ceres CLONE 2020525
  misc_feature (40)..(110): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAEKKPAEEKAEKRVPGSGKEGGEKKGKKKAKKSVETYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 44408 - DNA, 700 bp, Panicum virgatum
  misc_feature: Ceres CLONE 2020538
  misc_feature: Encodes the peptide sequence at SEQ ID NO. 44409
actccccgcacgagaatcagaactgaagatggaaggcgcgattgatgctcaggctggtggcgtcgaggccccggtggctcccctctccgatgtgacgaagaaggtcggcaagtgccgaatgtacgaggccgagtaccccgagctggacgatctcgtgatggtgcgcgtcaatcgcatcaacgaaatcggcgccttcgtatcgctgctcgaatacaacgacaaggagggcatcatcctgctctccgagttgtcgaggaggcgcatgcgctcgatcaacaagcacatccgagtgggcaagaaggaggtgctgcaagtgctgagggtggacaaggagaagggctacatcgatctctcgaagaagctgctcaaggaggaggacatcgtcgagtgcactcagcggtaccagaagtcgaagaccgtacacagcatcatggcccacgtcgccgagctgcagacgggcgacaacatcctcactctcgaggacctgtacaagcgcatcgggtggcctctgtacgagacgtacacccatgcgtacgacgcgttcaagaaggctgccgctggcgaagacatcttcgagggcctcgacgctcccgccgagatcaaggacaacatcctcaagacgattcagcatcgcctgggcagccagcccgtcaagatccaggccgacatccaggtgacgtgcttctcctacgagggcatc

SEQ ID NO: 44409 - protein, 223 aa, Panicum virgatum
  misc_feature: Ceres CLONE 2020538
  misc_feature (36)..(111): Pfam Name: S1 Pfam Description: S1 RNA binding domain
  misc_feature (152)..(223): Pfam Name: EIF_2_alpha Pfam Description: Eukaryotic translation initiation factor 2 alpha subunit
MEGAIDAQAGGVEAPVAPLSDVTKKVGKCRMYEAEYPELDDLVMVRVNRINEIGAFVSLLEYNDKEGIILLSELSRRRMRSINKHIRVGKKEVLQVLRVDKEKGYIDLSKKLLKEEDIVECTQRYQKSKTVHSIMAHVAELQTGDNILTLEDLYKRIGWPLYETYTHAYDAFKKAAAGEDIFEGLDAPAEIKDNILKTIQHRLGSQPVKIQADIQVTCFSYEG

SEQ ID NO: 44410 - DNA, 449 bp, Panicum virgatum
  misc_feature: Ceres CLONE 2020538-R
tcaagcaccaccaacgtctcctccatcgattccatggctcctcgtcgaacaccgagccccggaggtaccccgccgtcgagcgccgcccgtcgctgccgcacgtcatcgtcgccagcctcgccggcgcctcctcgtcgacccgaacccctacgccatcatccccacgcgcgggaacacatcgctcgcccacctgcgcaccgccgcgggcccgggacacgccggcgcgcgtgcgggcacgcacgcgacgtgccgggcctgccagctgcgggaggaagaaggccctggcaattttgcactcagccccctcctttttcccttaattacgtgcgctgttgattgagtcttggtattcttaggtacagccccctggtagctagggttaattgcgtttaaatcctatatttatgcatatacatgagtgaactttgaaattcaatataaaatcacag

SEQ ID NO: 44411 - DNA, 590 bp, Panicum virgatum
  misc_feature: Ceres CLONE 2020550
  misc_feature: Encodes the peptide sequence at SEQ ID NO. 44412
ttcagtacttctttgctattggtggtctgttagtgtgccaatatcatcactatgagttttgaagttggctgtatgatcagtgaaggtctgtggtttttcattgatatacctgattcggtgaaggtttggaatatgcaaacagcagcagaaatgaatcttactggatcaagtgggaaagtctatgcactcattgttgccactgagttaatctttgctgcaacacagggtttgtacacagaggacgagtaactgcataaaatggaaggggaacttaaagcaaggctgcatagaatgcttactacaaaggtcagcatgtacgtcaccatgtatgattcagatcaaatggaaccaagcagttcagaaagagattgagattaaaagtccacgaaggcatgttcatctactgataggtggcacgattatttgtaaatttctagctactcaagctagcctgctaaagaaggcacagaacaaaatgtagaaatgccaatgatcaagcccatgtcaatggttcaatgtattggttgcttcttcttgaatatttgtccaattataaacattttagttgagtttcagaagttcagaaacat

SEQ ID NO: 44412 - protein, 65 aa, Panicum virgatum
  misc_feature: Ceres CLONE 2020550
  misc_feature: Functional homolog of the protein sequence given in SEQ ID NO 51692
  misc_feature: Useful for making plants with altered terpenoid content
MSFEVGCMISEGLWFFIDIPDSVKVWNMQTAAEMNLTGSSGKVYALIVATELIFAATQGLYTEDE

SEQ ID NO: 44413 - DNA, 587 bp, Panicum virgatum
  misc_feature: Ceres CLONE 2020559
  misc_feature: Encodes the peptide sequence at SEQ ID NO. 44414
atcgccatcctcgttagaaactcatgcctccaaaagcagatccatccgtcatccaagtcatcaccgttcgagttactggaggtacagtaggtaaccctgcatctcttgcaccaaaagttggtccactcggtttatcaccaaaaaaaattgctgatgatatcgcaaaagtcaccaaagattggctgggacttcgtatcacagtcaagctcacaattcaaaacagacaagcagctatcgaagtcattccatctgcatccgctttgatcattaaagctttgaacgaaccaaaagttgatttaccaaaaggaaccccaactcctcacaaaggaaatatcacctttgaggatgttgttaatgtagccaaagttatgagaccaagatcaatggctcgtgatttcaagggaaccgtaaaagagatccttggaactgctgtctctgttggttgtactgttgataactcagatcctaaagatattctcaaaaaagttgaagctggagagtttgataaagctttggaaggacaaaagtaaattctaaaaagttttaaaaaatgacagctgtctgaagcagagaaataaaaaggaggc

SEQ ID NO: 44414 - protein, 168 aa, Panicum virgatum
  misc_feature: Ceres CLONE 2020559
  misc_feature (12)..(70): Pfam Name: Ribosomal_L11_N Pfam Description: Ribosomal protein L11, N-terminal domain
  misc_feature (75)..(143): Pfam Name: Ribosomal_L11 Pfam Description: Ribosomal protein L11, RNA binding domain
MPPKADPSVIQVITVRVTGGTVGNPASLAPKVGPLGLSPKKIADDIAKVTKDWLGLRITVKLTIQNRQAAIEVIPSASALIIKALNEPKVDLPKGTPTPHKGNITFEDVVNVAKVMRPRSMARDFKGTVKEILGTAVSVGCTVDNSDPKDILKKVEAGEFDKALEGQK

SEQ ID NO: 44415 - DNA, 718 bp, Panicum virgatum
  misc_feature: Ceres CLONE 2020564
  misc_feature: Encodes the peptide sequence at SEQ ID NO. 44416
acccgctctggcgatcgtctcggccgaagctttcctttccccgccgcgatcactagccccgctataaatcccccgcccccgcccgtcccatcccttcccaggcaagcaggcgagcaagctcgaggcgacagaggcaagccaagaaaagcagcagcagcagcagccagccagccaagctcgccgcggctcttcttgctcgcctccgttccgttcccgagcttccacaagggatggagatgaagaagatcgcctgcgccgtcctcgtcgccgcctcggccaccgtggcgctcgccgcggacgccccggcgccggcccccaccagcgggtcctccgccgtcgcgcccgccgtcggcgccgcgctcggggccgccgtggcctccttcttcgcctactacattcagtgagccgccgccgccggccggccggcccggggtgaggaggaagagaccaggggggtgacatggcggcgccgattccgaacaccgcgcgcgcgttacgatgcgtgcgtgggtttcgatttgacacggctttgtcttctctctccttgatttaacgaattgatcgatgtcgctgatgcaccagtttgatttggtgccttgctatttgttctccgatcccttcgagggagagggaccgacacctgtaccattgcttgccatttgtttggatcaattcaacaattcgatttaatcatcgcgtcgatgcgtgcttaacctgc

SEQ ID NO: 44416 - protein, 57 aa, Panicum virgatum; identical to SEQ ID NO: 36286
  misc_feature: Ceres CLONE 2020564
  misc_feature: Functional homolog of the protein sequence given in SEQ ID NO 50462
  misc_feature: Useful for making plants with altered carbohydrate content
  misc_feature: Functional homolog of the protein sequence given in SEQ ID NO 51521
  misc_feature: Useful for making plants with altered cell wall content and/or composition

SEQ ID NO: 44417 - DNA, 698 bp, Panicum virgatum
  misc_feature: Ceres CLONE 2020570
  misc_feature: Encodes the peptide sequence at SEQ ID NO. 44418
aaccgccagccacgctcacgcaacggcgcagccatggcgggcggagccgccgctacgcccgccgacgccgcctccagctgcgaggtggacctcggcaaccttatggcgtacgacccgtcgcaccacgtcgccgccgccgccgcctccagggaggagctgaggcaggtgtgcctgctaaaggcgacggagctggcgcaagcggtggccaactcccttttcgcgctgccgcccagcgaggaccgcgacggcccaatcgtccacctcccgccgccaaccatccgacttccgcgcgagaagcatctaccgaagccaaagccacccaccaagtgggagctctttgcaaaggcgaaagggattaccaagcgcaagaagaacaagcgcgaatgggacgagcaaactcaatcctggaaacagacttacggctatgaccgtgttaatgatgacaaagatgttccgatcattgatgccaaatccactgacgagcctggtgtcgatccttttgcacaaagaaggcaagagaagaagaagcgtgtagaaaagcaagaaaagaacagactggagaacttaaagaaagctgcaaaagttggcgctttgccaagtcatatacaacttgctgcaaaggctttgcccatcacaggaactaaagctgatcttccgaaaaaatctagaaaagaggatcttgagaatgttgctggcat

SEQ ID NO: 44418 - protein, 221 aa, Panicum virgatum
  misc_feature: Ceres CLONE 2020570
  misc_feature (6)..(182): Pfam Name: RRS1 Pfam Description: Ribosome biogenesis regulatory protein (RRS1)
MAGGAAATPADAASSCEVDLGNLMAYDPSHHVAAAAASREELRQVCLLKATELAQAVANSLFALPPSEDRDGPIVHLPPPTIRLPREKHLPKPKPPTKWELFAKAKGITKRKKNKREWDEQTQSWKQTYGYDRVNDDKDVPIIDAKSTDEPGVDPFAQRRQEKKKRVEKQEKNRLENLKKAAKVGALPSHIQLAAKALPITGTKADLPKKSRKEDLENVAG

SEQ ID NO: 44419 - DNA, 629 bp, Panicum virgatum
  misc_feature: Ceres CLONE 2020585
  misc_feature: Encodes the peptide sequence at SEQ ID NO. 44420
ccttcgcgcaccgctccaccctacccccccgccgccgcccccgcctgccgccgcaaccgccaccgtcgccatggcccggatcaaggtccacgagctccgggtgaagaacaaggcggagctgctggcgcagctcaaggagctcaagtccgagctctccctcctccgcgtggccaaggtcaccggtggagcccccaacaagctctccaagatcaaggtggtgcgcacctcgatcgcgcgcgtgctgacggtgatctcgcagaagcagaaggccgcgctgcgggaggcgtacaagaagaagaagcggctccccctcgacctccgccccaagaagacccgtgccatccgccgtcgcctcaccaagcaccaactttctctgaagacggagagggaaaagaagcgtgacaagtacttcccgatgaggaagtatgctatcaaggcctaggtcagaactgtgcgatgttgtgcttagcatatcatctgctgcttctttccccaggaagcgttttaagttttgatttatatggacatttgctgtgggttgaaagtacggtgtatttcgtctgttaccactcaaatgcctagtttggtttaaggcagttcaagtgacactggaatcatgtttggtgtgg

SEQ ID NO: 44420 - protein, 123 aa, Panicum virgatum
  misc_feature: Ceres CLONE 2020585
  misc_feature (6)..(64): Pfam Name: Ribosomal_L29 Pfam Description: Ribosomal L29 protein
MARIKVHELRVKNKAELLAQLKELKSELSLLRVAKVTGGAPNKLSKIKVVRTSIARVLTVISQKQKAALREAYKKKKRLPLDLRPKKTRAIRRRLTKHQLSLKTEREKKRDKYFPMRKYAIKA

SEQ ID NO: 44421 - DNA, 705 bp, Panicum virgatum
  misc_feature: Ceres CLONE 2020598
  misc_feature: Encodes the peptide sequence at SEQ ID NO. 44422
attcagcaagtacccaaaagcgccaggcgaagcaggaggaggagcggcagccggagctccggaatgggggaaagagcagctgggtctctcccggtggctaacgtgcaggtgctcgcggaggcttgcaacggcggggtcgatgaccagcagcaggtgcccgagaggtacctcagcaaggatcccagctctgaggaggtcgtcaccggcggcgacggttcttgcgcgattccggtcatcgacctccgcaagctgcaggacccgcagtcgtcgtcggcggagtgcgcaaagctggcgtctgcctgtctgaactggggattcttccagctcatcaaccatggactcccagaggaagtgactggaaacctgatgaatgacgtggtcgagttcttcaagcagacgctccaagacaagaaggaatgctcacagcaagtcggcagcctcgaaggctatggccaggccttcgtcgtgtctgacgaccagaagctggactgggcagacatgctctacctgcaggtccatccaaccgagtccagggacctgcggttctggcctactcgccctgcatccttcaggcattccgcagacgtgtactcctcgaaggccaggcagctagcgtatcgcctgctggagttcatggccaggggcgccggcgccgagccggcgtcgctgcgagccgtgttcgaagggcaacccagggcatgaggg

SEQ ID NO: 44422 - protein, 212 aa, Panicum virgatum
  misc_feature: Ceres CLONE 2020598
  misc_feature: SWISSPROT Homolog: EC 1.14.11.19 Leucocyanidin oxygenase
MGERAAGSLPVANVQVLAEACNGGVDDQQQVPERYLSKDPSSEEVVTGGDGSCAIPVIDLRKLQDPQSSSAECAKLASACLNWGFFQLINHGLPEEVTGNLMNDVVEFFKQTLQDKKECSQQVGSLEGYGQAFVVSDDQKLDWADMLYLQVHPTESRDLRFWPTRPASFRHSADVYSSKARQLAYRLLEFMARGAGAEPASLRAVFEGQPRA

SEQ ID NO: 44423 - DNA, 679 bp, Panicum virgatum
  misc_feature: Ceres CLONE 2020604
  misc_feature: Encodes the peptide sequence at SEQ ID NO. 44424
atcgagcaccctccaatcttcaaggcgtcgcagcaggcaaggcatcgatcgatcacaccagcagcgcgtgccgcgtagagagatcgagagagagagagagagagagagagagagagagagagagagagagagagagagagagaggagtctcaccggagaagggaggaatcgtcatcgccaccgccaccgccaccgccaccgccatgggcaaggtccgctccttcttctcccgcagcggcaagcgcggcgccggtccgtcctcgccgtcctcctccgcggcgggcagcgcgccgtcgtcgccgtccccgaggaagtcgtcggcgtcggcgccggcggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctcgcgcgcgtcctgcgcgggctcgggggaggcgc

SEQ ID NO: 44424 - protein, 158 aa, Panicum virgatum
  misc_feature: Ceres CLONE 2020604
  misc_feature (53)..(81): Pfam Name: efhand Pfam Description: EF hand
  misc_feature (89)..(117): Pfam Name: efhand Pfam Description: EF hand
  misc_feature (127)..(155): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPAAPAAETKDEMERVFRKFDANGDGRISRSELAALFEGVGHAATDDEVSRMMEEADADGDGAISLPEFAALVRSADADADAVEEDLRHAFMVFDADGNGLITPAELARVLRGLGGG

SEQ ID NO: 44425 - DNA, 574 bp, Panicum virgatum
  misc_feature: Ceres CLONE 2020604-R
  misc_feature: Encodes the peptide sequence at SEQ ID NO. 44426
tcctccgcgcctccggcaagctccaggtcgtcgtcgcagcagaagctatgtcgggccgcggcaagggaggcaagggcctgggcaagggcggcgccaagcggcacaggaaggtgctccgcgacaacatccagggcatcacgaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagcctggccgccccccgcccgcgccctgtgggtcgcgtgcaggcacctagctagggttcctgatgggttagaggagttgatgtgctgcgttctgtcctgtgcctagctgcgttgtggtgttgacttaatagtaggtgtttatggttgtaatggtgaattggaagcctatcaattgaatgaatcgatgttctgaggcatgattagagttcttcgtcc

SEQ ID NO: 44426 - protein, 103 aa, Panicum virgatum; identical to SEQ ID NO: 12044
  misc_feature: Ceres CLONE 2020604-R
  misc_feature (25)..(94): Pfam Name: Histone Pfam Description: Core histone H2A/H2B/H3/H4

SEQ ID NO: 44427 - DNA, 540 bp, Panicum virgatum
  misc_feature: Ceres CLONE 2020608
  misc_feature: Encodes the peptide sequence at SEQ ID NO. 44428
attgaaacccagtcccctcgaagaccagtccaggagccccgacaacagccagtctgaatgcctcaggaaatcggcgacatcaagaagttcatcgagatctgccggcggaaggacgcctcttccgcccggatcaagaagaacaccaagacccagcagatcaagttcaaggttcgctgccagaggttcctctacaccctggtcctcaaggactcggacgaggccgagaagctcaagcagagcctgccgcccaacctccagatcaaggatgttcctaagaagaacaagaagacctcgtcatgagcgaggggatcctgataatggggaaaagctggtccggcactgagcgcgggtgttttggcacgacggaggcatatgcatttgccggtccgggttggaccgggactcaaccaacggcgtctcggaatggggaaacaacgggaggaactgttgcggtgcttactatgattagccccacggggcggtgtagtcggcgagttccgcagaaatgaattgcattcatcggccaaggcccaacctcag

SEQ ID NO: 44428 - protein, 80 aa, Panicum virgatum
  misc_feature: Ceres CLONE 2020608
  misc_feature (2)..(71): Pfam Name: Ribosomal_L38e Pfam Description: Ribosomal L38e protein family
MPQEIGDIKKFIEICRRKDASSARIKKNTKTQQIKFKVRCQRFLYTLVLKDSDEAEKLKQSLPPNLQIKDVPKKNKKTSS

SEQ ID NO: 44429 - DNA, 611 bp, Panicum virgatum
  misc_feature: Ceres CLONE 2020617
  misc_feature: Encodes the peptide sequence at SEQ ID NO. 44430
tgccagtggaacacaagcgctcccaccagtagtcccagttccagtaccacacacgtgacccacgcgaccgcacggagagaggagcccggccaccggcggcgcgccaaccatgtcgtcccaccagccgccgcgccccgtgcgcttcggcatcctgggctgcgcctccatcgcgcgcaagctcgcgcgcgccatgctgctggcccccggcgccgccgtcgccgccgtggggagccgctccgaggagaaggcccgcctcttcgccgccgacaacggcctcgacgtcgccaccacccgcctccacgggacctacgaggcggtcctcgacgatccggatgtcgacgtcgtctacctcccgctccccaccagcctccacgtgcgctgggccaccgccgccgccgcgcggggcaagcacctgctcctcgagaagcctaccgcgctctgcgccgccgacctcgacgccatcctcgccgcctgcgacgccgcgggggtccagttcatggactccaccatgtggatgcaccacccgcgcaccgccaagatgcgggagctcgtcgacgacaaggacgccatcggcgacatcaaagtgataaacagcgtgttttgctttcgag

SEQ ID NO: 44430 - protein, 167 aa, Panicum virgatum
  misc_feature: Ceres CLONE 2020617
  misc_feature (10)..(133): Pfam Name: GFO_IDH_MocA Pfam Description: Oxidoreductase family, NAD-binding Rossmann fold
MSSHQPPRPVRFGILGCASIARKLARAMLLAPGAAVAAVGSRSEEKARLFAADNGLDVATTRLHGTYEAVLDDPDVDVVYLPLPTSLHVRWATAAAARGKHLLLEKPTALCAADLDAILAACDAAGVQFMDSTMWMHHPRTAKMRELVDDKDAIGDIKVINSVFCFR

SEQ ID NO: 44431 - DNA, 609 bp, Panicum virgatum
  misc_feature: Ceres CLONE 2020625
  misc_feature: Encodes the peptide sequence at SEQ ID NO. 44432
tgttatgaccaagattatcccaaggaacacaacactgcctacctcaaagtcagaagtcttctcaactgctgctgacgggcagaccagtgtggagatcaatgttctccaaggagaaagagagtttgttcgggacaacaagtctcttggtagtttccgacttgatgggattcctcctgccccacgtggtgttccacagattgaagtcaagtttgacattgatgccaacggaatcctctctgtcactgcggtggacaagggcacagggaagaagcaggacatcacaatcactggggccagcacattgccaaaggatgaggtcgagaggatggttaatgaagctgagaaattcgcgaaggaggacaaggagaagagagatgccatcgacaccaagaaccaagctgagtcagttatctatcagactgagaagcaattgaaggagctcggtgataaggtcccaggggatgttaaggggaaggtggagtcgaagctgcaggagctcaaggatgctgttgctggtggctccacacagacgataaaggatgctttgagtgcattgaaccaggaagtcatgcagcttgggcaatcgctctacagccagcaaggtgcccc

SEQ ID NO: 44432 - protein, 202 aa, Panicum virgatum
  misc_feature: Ceres CLONE 2020625
  misc_feature (1)..(198): Pfam Name: HSP70 Pfam Description: Hsp70 protein
VMTKIIPRNTTLPTSKSEVFSTAADGQTSVEINVLQGEREFVRDNKSLGSFRLDGIPPAPRGVPQIEVKFDIDANGILSVTAVDKGTGKKQDITITGASTLPKDEVERMVNEAEKFAKEDKEKRDAIDTKNQAESVIYQTEKQLKELGDKVPGDVKGKVESKLQELKDAVAGGSTQTIKDALSALNQEVMQLGQSLYSQQGA

SEQ ID NO: 44433 - DNA, 722 bp, Panicum virgatum
  misc_feature: Ceres CLONE 2020647
  misc_feature: Encodes the peptide sequence at SEQ ID NO. 44434
actacagcagcagcagcttgttctatccagcacacagtgtgccgagcaagtgagcaataacagatgcccgagaagatggccaggcttggccttgtcatcctgctggtcgcgctgcttggtgccgccgccgtggctgctcaagctccagggtccagctctccgcggctcaggttcggctactacaagcgctcgtgccccaacgcggagtacatcatcagggaggccgtgaggaacgccaccagcgtcaaccccggcctcggcgccggcctcatccgcatggccttccacgactgcttcgtccggggctgcgacgcctccgtcctgctcgacccgacgccggccaacccgcgcccggagaagctcggcccgcccaacttccccagcctccgcggcttcgacgtggtcgacgccgccaaggccgcgctcgagaaggcctgccccggcgtcgtctcctgcgctgacatcgtccagttcgccgcccgcgacgccgccttctttctcagcggctaccgggtcaactacaagctccccgcggggcgtttcgacggccgcgtgtccatcgacaacgagacactcaccttccttcccccgccgttcttcaacctcacgcagctcgtcaacagcttcaaggccaagggcctcagcgtcgacgacctcgtcgtgctctccggctcccacaccatcggccgctcccactgctcctcattcaccaccatcgccac

SEQ ID NO: 44434 - protein, 215 aa, Panicum virgatum
  misc_feature: Ceres CLONE 2020647
  misc_feature (47)..(215): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50376
  misc_feature: Useful for making plants with altered carbohydrate content
  misc_feature: Functional homolog of the protein sequence given in SEQ ID NO 51528
  misc_feature: Useful for making plants with altered cell wall content and/or composition
  misc_feature: Functional homolog of the protein sequence given in SEQ ID NO 50230
  misc_feature: Useful for making plants with modulated nitrogen use efficiency
MARLGLVILLVALLGAAAVAAQAPGSSSPRLRFGYYKRSCPNAEYIIREAVRNATSVNPGLGAGLIRMAFHDCFVRGCDASVLLDPTPANPRPEKLGPPNFPSLRGFDVVDAAKAALEKACPGVVSCADIVQFAARDAAFFLSGYRVNYKLPAGRFDGRVSIDNETLTFLPPPFFNLTQLVNSFKAKGLSVDDLVVLSGSHTIGRSHCSSFTTIA

SEQ ID NO: 44435 - DNA, 682 bp, Panicum virgatum
  misc_feature: Ceres CLONE 2020651
  misc_feature: Encodes the peptide sequence at SEQ ID NO. 44436
gctttccggccgagctcattttttctgcccccgcaccacgcccggctgcgtttcggagatcaggtaggaagcggagccctgctagcgctagcgagtgaggactgaggagccgcgcgaacgagggttttttatccgaatcccatggccggcgccggggcggacggggagcgccggatcggcgtggcgatggactactcggacagctccaagaaggcgctggcgtgggccgtcgacaacctgctccgccacggggacaccctcgtcgtcctccacatcctgcaccacggcggggaggaggccaagcacacgctctgggccaagtccggatccccgctgatccctctctccgagttccgggagcccgaggtgatgaagaactacggcgtcaaagccgacgccgaggtgctcgacatgatcgacacggcggcgcgccagaagctgctcaaggtggtggccaagctttactggggcgacgccagggagaagatctgcgacggcgtcgaggagctcaagatcgactccctcgtcatgggcagccgcggcctcggcccgatccagaggatccttttgggaagtgtgacaaactacgtgctgtcgcacgcatcgtgcccggtgacagtcgtcaaggggaagtaatgacccggccaacctaccagctatatgatcgaggatggtagcatgc

SEQ ID NO: 44436 - protein, 164 aa, Panicum virgatum
  misc_feature: Ceres CLONE 2020651
  misc_feature (8)..(162): Pfam Name: Usp Pfam Description: Universal stress protein family
  misc_feature: Functional homolog of the protein sequence given in SEQ ID NO 50611
  misc_feature: Useful for making plants with altered lignin content
  misc_feature: Useful for making plants with modulated biomass
  misc_feature: Functional homolog of the protein sequence given in SEQ ID NO 50612
  misc_feature: Useful for making plants with altered alkaloid content
MAGAGADGERRIGVAMDYSDSSKKALAWAVDNLLRHGDTLVVLHILHHGGEEAKHTLWAKSGSPLIPLSEFREPEVMKNYGVKADAEVLDMIDTAARQKLLKVVAKLYWGDAREKICDGVEELKIDSLVMGSRGLGPIQRILLGSVTNYVLSHASCPVTVVKGK

SEQ ID NO: 44437 - DNA, 697 bp, Panicum virgatum
  misc_feature: Ceres CLONE 2020652
  misc_feature: Encodes the peptide sequence at SEQ ID NO. 44438
ggctcgaagacgatcagataccgtcctagtctcaaccataaacgatgccgaccagggatcggcggatgttgcttataggactccgccggcaccttatgagaaatcaaagtctttgggttccggggggagtatggtcgcaaggctgaaacttaagctcaaaaccctagccctcgcgccgccgccgccgccgccgccgcccctagcgctcgagctcctcgccacccgcgagctcgcgctgcatcgccgccatgaagttcaacattgccaacccgaccaccggatgccagaagaagcttgagatcgatgacgaccagaaactgcgtctctttttcgacaaaaggatctctcaggaggtcaatggtgatgctctgggtgaggagttcaagggttatgttttcaagatcatggggggttgtgacaagcaaggctttcccatgaagcaaggagtgctaacttctggccgtgttcgccttctgctacacaggggcactccatgcttccgtggttatggtaggcgtgatggtgagcgcaggcggaagtctgtccgtggttgcattgtcagccaagacctctctgttatcaacttggtgattgtcaagaagggtgagaatgatctgcctggtctgactgacaccgagaagcccaggatgaggggacccaaaagggcctccaagatcaggaagctttttcacctgtc

SEQ ID NO: 44438 - protein, 149 aa, Panicum virgatum
  misc_feature: Ceres CLONE 2020652
  misc_feature (1)..(129): Pfam Name: Ribosomal_S6e Pfam Description: Ribosomal protein S6e
MKFNIANPTTGCQKKLEIDDDQKLRLFFDKRISQEVNGDALGEEFKGYVFKIMGGCDKQGFPMKQGVLTSGRVRLLLHRGTPCFRGYGRRDGERRRKSVRGCIVSQDLSVINLVIVKKGENDLPGLTDTEKPRMRGPKRASKIRKLFHL

SEQ ID NO: 44439 - DNA, 689 bp, Panicum virgatum
  misc_feature: Ceres CLONE 2020659
  misc_feature: Encodes the peptide sequence at SEQ ID NO. 44440
tgagacgcgcgccaccgcttccatctcgcgccggccctcctacgccatcacatcaccaccaagccaagccaagccaagccaagccaagcaagcctcgcctccgcattgctccgctcgccatggcgtgcctgctccgtgccacggcgctgctcctcgcgctcgcggcgctggccgccacggcgctcccggcgccggcggcggcgggcggcgtgtccgccggcggggatctcggccacctcgtgatgcggcgcggcgcgcgggcgtgccgcggcaccgtgggcgagtgcatgggctacctcgacgtggacgccgagggcgaggccgacgtggccgggatggccaccggcggcagcaagcgccgggtgctgcagggcggctccgggtacatcggctacgacgcgctgcgccgggacaacgtgccctgctcccagcgcggcgcctcctactacaactgccagcccggcgccgaggccaacccctactcccgcggctgcagcgccatcacccagtgccggggctgatcgcgccctgcacgcgtcttccacctcaaatcatgttgctgctagcttcatggtgatgtttgtcttacgagttcgagagatgggttgcgcagtggagatgtgtctgctctgttctagctgagcttcgccttcagggtgaaagtaaaagtaatttatatacgatcgtgc

SEQ ID NO: 44440 - protein, 133 aa, Panicum virgatum
  misc_feature: Ceres CLONE 2020659
  misc_feature (67)..(133): Pfam Name: RALF Pfam Description: Rapid ALkalinization Factor (RALF)
MACLLRATALLLALAALAATALPAPAAAGGVSAGGDLGHLVMRRGARACRGTVGECMGYLDVDAEGEADVAGMATGGSKRRVLQGGSGYIGYDALRRDNVPCSQRGASYYNCQPGAEANPYSRGCSAITQCRG

SEQ ID NO: 44441 - DNA, 579 bp, Panicum virgatum
  misc_feature: Ceres CLONE 2020667-R
  misc_feature: Encodes the peptide sequence at SEQ ID NO. 44442
gtccttgtggtcgcagcaggggtggcgctggacggcgccgacggcgccggggagtgcgggagggcctccgccgaccgggtggcgctgccggctggcgccgtgcatctcggcggccgacgacccgcagtcgacgccgacgagcagctgctgctcggccgtgcacgccatcgggcagagccccagctgcctctgcgccgtcatgctgtccggcaccgccagggccgccgggatcaagccggaggtcgccattaccatcccgaagcgctgcaacatggccgatcgccccgtcggctacaagtgcggagactacacgctgccctgacgacctcgtgagagaggccgccgcgctggtgattatgaaagagatggacgccaaggaaggctttgtgttggaataatccagtccgcgcgaaccatgaacgtggacgaggggctccagccctatcacactgtgactgtgtgtgcttctcgtactagtactgtgtgttcaacttcgtctaaaattaataagaatggacgtgttgcttgtcaagcccattattggcccattaataaaaatggtgttgtgttgaagaggcc

SEQ ID NO: 44442 - protein, 106 aa, Panicum virgatum
  misc_feature: Ceres CLONE 2020667-R
  misc_feature (29)..(100): Pfam Name: Tryp_alpha_amyl Pfam Description: Protease inhibitor/seed storage/LTP family
SLWSQQGWRWTAPTAPGSAGGPPPTGWRCRLAPCISAADDPQSTPTSSCCSAVHAIGQSPSCLCAVMLSGTARAAGIKPEVAITIPKRCNMADRPVGYKCGDYTLP

SEQ ID NO: 44443 - DNA, 698 bp, Panicum virgatum
  misc_feature: Ceres CLONE 2020667
ctcctctgaggctctgactcccccctccccaaacttctgttcctcgctgcgcggcggcctcggcctcggcctccccgccgcgccggcgagccatggagcggcgctcctccgtccgcttctcgccctccgagattgcaaggatggagaaattggctgccgagagaacggagcaagtcttggatgacaagttctgtcagaagcttgcagaagaatttaatctttctgctggccgagctggaagtaaagtattgcaggctacacaggttcaaggatggtttcttaataagtttccagtatcagccactaaacctacttgtgtacccactgttcctcaagaaaaggcttcaggctcagaagtaaatgtatcagtttctgagaaaaagtctgcagcttctgaagaaaaacttttccctcttgatacaagtatttcaaacaacgaggatgagctttctcctgtttttccattagaaactaaagataagattcctgatcttgaagagctggagtttgaggctaagtcttcaaaggattctgcatggtacgacattgcccttttcttagcacacaggaggaacagaacgggtgaagtagaagtccgggtgaggttcgagggtttcggggcagatgaggatgagtgggtgaatgtgaagaagtgtatccgccagcgttccattcctttggagtcctcgcagtgcaga

SEQ ID NO: 44444 - DNA, 600 bp, Panicum virgatum
  misc_feature: Ceres CLONE 2020670-R
  misc_feature: Encodes the peptide sequence at SEQ ID NO. 44445
gatttcgagtgagcttaaggggggtccatcattgcattggcattcctttctgcaaagagaagctatcggaggaggagagcttttgggcttttgggggtgcgtggtgcgccatgggggaggtgaagcacctgtgcctggtgaagttcaaggagggcgtcgtggtggaggacgtcctcaaaggcatgaccgaccttgtcgcccagatggacatggtcaaatccttcgagtggggccaggacgtgctgaaccaggagatgctgacgcagggcttcacgcacgtcttctcgctcaccttcgcctccgccgacgacctcaccacctacatgggccacgacaagcacgccgcgttcgccgccacgttcatggccgcactcgagaaggtggtcgtcatcgacttccccgtcgtcatcgccaagccaccgccatcggcatgatcgacctgccacagcatctgtcggccattgtacggtgccttttcaggtagcagatcatcgcctatttgcagcggtgatgtactgcgtgtctaagtacgtactatgtactaagctccttattactactcgttctgcctgatgctgtgtcccgtactctaggacgtca

SEQ ID NO: 44445 - protein, 107 aa, Panicum virgatum; identical to SEQ ID NO: 9934
  misc_feature: Ceres CLONE 2020670-R
  misc_feature (4)..(98): Pfam Name: Dabb Pfam Description: Stress responsive A/B Barrel Domain

SEQ ID NO: 44446 - DNA, 723 bp, Panicum virgatum
  misc_feature: Ceres CLONE 2020670
aggaaacccatttctgttggaaaataaatggcacgtgaagctttcttctctctaattgactgtctcatttttatctgttgcgttgtccttgacatgttctttcagcgagcgagcaataccgtgattgcttagacaatgtgctgaacggaccatttagcatcacactgagaaaccgtctgcagtgccatgtaatccgtgatgcagcaaaggatgaactcgtgaccgaggagccaatcttagtgttaaatgaagtcacaatcgaccgaggaatatcatcttaccttacctacctggaatgctactgcgacagttcttttgttacttgtgtacaaggagatggactaatcatttcaactacatctggaagcacagcatattcactagcagctggagggtccatggtccatccgcaggtcccagggatccttttcaccccaatctgcccgcattccttgtcattcagacctttgatactgcctgaatacgtgactctgcgcgttcaagtgccttacaatagcagggggtctgcctgggcatctttcgatggcaaagatcgaaagcagctatcacctggcgacgctctgatctgcagcatatctccttggcctgtgcccacagcctgcctgatggactcaacgaccgatttcctccgcagcatccatgagggcctccactggaacttgaggaaatcccagtcatttgatggcccgcgcgatggatgca

SEQ ID NO: 44447 - DNA, 642 bp, Panicum virgatum
  misc_feature: Ceres CLONE 2020672
  misc_feature: Encodes the peptide sequence at SEQ ID NO. 44448
aagatgctctctcttcctccattaatgtagctccctcctagctgccccgtgctttgcaactccaagaactatgtcctccttgctgcttcaatctccggggcctcgcctcctcccgaccgccccgtcgagccgacggcacctgcaatgtaaagaacatctcttgttgccccggaggcggccaagggtgcggctcggcgcgcgcatggccgagacggcctgggtcgagagcggctgcgatggggcgtcgccggaggtcggcgtttccgtggagagtgacccgattctgggaagggaggagtcgcccggccagagaagggaggcgagcctgtgggagcccgtcgaggcggcgctgaacctgattctgaaaaggatgctaaaccatgaaagaccttcatcagctttgcggtctgatcctgggatgccatcgtcccatacacaatccattttctattttgcgatcgtcctaattctttcattatattactggattgggacaaattatctgaccgtgattcttgggcctgcaactctgtcagtgtcggcctatctgtcatggttacgggtgtcccagcgccttcatacactaaaccaggtcatggtgggagctgctgtaggatctgctttcggtgctctatggtttgt

SEQ ID NO: 44448 - protein, 146 aa, Panicum virgatum
  misc_feature: Ceres CLONE 2020672
  misc_feature (36)..(146): Pfam Name: PAP2 Pfam Description: PAP2 superfamily
  misc_feature: SWISSPROT Homolog: EC 3.6.1.43 Dolichyldiphosphatase
MAETAWVESGCDGASPEVGVSVESDPILGREESPGQRREASLWEPVEAALNLILKRMLNHERPSSALRSDPGMPSSHTQSIFYFAIVLILSLYYWIGTNYLTVILGPATLSVSAYLSWLRVSQRLHTLNQVMVGAAVGSAFGALWF

SEQ ID NO: 44449 - DNA, 491 bp, Panicum virgatum
  misc_feature: Ceres CLONE 2020677
  misc_feature: Encodes the peptide sequence at SEQ ID NO. 44450
atcatccatcatcgaacacacaagaaaaaacatcaatcaaagtgcttacatctttgagaaattctgcaggtatctctgaagaagatgagctcaacagctggcagcaaggggtgcaatgctactcccaagacggagtggcctgagctagtgggatgcacgatcaaggaggcgatggagaggatcaaggcggagcggccgcacctcaatgtcgtgcctgtccctgtaggctcctttgtcacccaagaggttgaccctaatcgcgtccgtctctgggttgacatcgtcgccgaggttcctaaaattggctgaagcatcgaaacgccaagccaccaaataatggcatttgtatgtgttcctatggaccattcatgtgggttaagtaaataaaagcatgtctgtgatggactcttgtatatggttcgcctgtcataagttgtgaattgtgatgattgagttatgaataatacgttggcaacactatcggaatctgc

SEQ ID NO: 44450 - protein, 74 aa, Panicum virgatum
  misc_feature: Ceres CLONE 2020677
  misc_feature (15)..(74): Pfam Name: potato_inhibit Pfam Description: Potato inhibitor I family
MSSTAGSKGCNATPKTEWPELVGCTIKEAMERIKAERPHLNVVPVPVGSFVTQEVDPNRVRLWVDIVAEVPKIG

SEQ ID NO: 44451 - DNA, 622 bp, Panicum virgatum
  misc_feature: Ceres CLONE 2020679-R
  misc_feature: Encodes the peptide sequence at SEQ ID NO. 44452
tctggcctcaagcctggcttccatgggttccatgtgcatgcacttggtgacacaacaaatggctgcatgtcaactggaccgcattacaaccttgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagtgtcgtcgtccccgctgtcaccactcaccactggaccagcctgagcatcctctggatatgtgaaataagagcgcctgatctatgatcggcgtgtttgtgttctcgctcctgtagcacctaccgatgaactgaaacctgtgttggtgtaacgctgtttcacctggacctgtgtttcatacatttcgctttgagaacgcctggaccgatctgtggaaataagaaggcacttgttgtgg

SEQ ID NO: 44452 - protein, 118 aa, Panicum virgatum
  misc_feature: Ceres CLONE 2020679-R
  misc_feature (1)..(118): Pfam Name: Sod_Cu Pfam Description: Copper/zinc superoxide dismutase (SODC)
  misc_feature: SWISSPROT Homolog: EC 1.15.1.1 Superoxide dismutase
SGLKPGFHGFHVHALGDTTNGCMSTGPHYNLAGKEHGAPEDENRHAGDLGNVTAGDDGVANFTVTDSQIPLTGPNSIIGRAVVVHADPDDLGKGGHELSKSTGNAGGRVACGIIGLQG

SEQ ID NO: 44453 - DNA, 696 bp, Panicum virgatum
  misc_feature: Ceres CLONE 2020679
aataactccttctcccttccacattctcttccacctccgttcccctttcttctcctcttcctcctcctcctcctcctcccttcctcttccatggccgtttagctcctcaggatctccccgtctctccacctcttgctagctacccttctgagcttgcacacgcggcaaaggatcgtttcgagagctgaaacttgctggcagacgacacagagagagataatcagagagttctatttttgcaaaggcacacacatatatagttcttctgctggatctcactgccagtctcacagcgaaggttcttctcgggctagcttgtccctagatctgttgctggttgtgttgttgcttggcaggcaaggtatcgttatataggaataggaattagcgcctgttctttggctgtggagggagtgcctgtgaagaaatggaaaggagtgagacggcaagaaattaggatttgagaggtggcggcaggagcatgatgatcccggcgaggcacatgcggccgatgatcagccggagcagcgcggcggcggcgtacgggtcctcgtcggcactgtcactcggtcagccaaacctgctggacaaccacccgcagctccagcaggcgctgctgcagcagcatctgctggaccagatcccggcgacgacggcggagagcggcgacaacatgatgcgcggcggccgaagctc

SEQ ID NO: 44454 - DNA, 647 bp, Panicum virgatum
  misc_feature: Ceres CLONE 2020699
  misc_feature: Encodes the peptide sequence at SEQ ID NO. 44455
gagatggcccgtacgaagcagaccgcccgcaagtccaccggagggaaggccccccgcaagcagctcgccaccaaggcggcgcggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcactatcatgcccaaggacatccagctcgcccgccgcatccgcggcgagcgcgcctaagccgccgccgccgccgccgtaccagtaggggagagggaggaggtcaagatggaatcggcttgttgatctgccccgccccgccgcgcgtagtggatcttgctagtagtgtaaaaacaggtttacaagtcttactttgtgatccgctcctattttggcttcgcttcgagatgaagccagcttgttaaagacttaattcgtgatgttactagcagtaaaaaaattacattgttctc

SEQ ID NO: 44455 - protein, 136 aa, Panicum virgatum; identical to SEQ ID NO: 9871
  misc_feature: Ceres CLONE 2020699
  misc_feature (58)..(132): Pfam Name: Histone Pfam Description: Core histone H2A/H2B/H3/H4

SEQ ID NO: 44456 - DNA, 671 bp, Panicum virgatum
  misc_feature: Ceres CLONE 2020712
  misc_feature: Encodes the peptide sequence at SEQ ID NO. 44457
attaaagctagtagtactgatcgatcggcatcgccggccggagatcgacatgacgacgatgatgaagaagcagcagcaagctgtggtggtgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagctagctagcttatctgtatctatacatacatacatacatacatacatacatacatacatacatacatacatacatatgatcgctcgctcgctcgatcgatcttagtcgtctacgtgtggcttgctgctgttcatccagccgctcgctacgtgtgtgtgtgtgcgcgtatacacacacacacgacggataaataaaagatgcatgggttgcctccgggccgctccctatatagctactttgttgtgtactactagtatcaatcaatcctactttctgatgtcttcactacatgtg

SEQ ID NO: 44457 - protein, 95 aa, Panicum virgatum
  misc_feature: Ceres CLONE 2020712
  misc_feature (30)..(95): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass
MTTMMKKQQQAVVVLLLLLVAAGGASAASCNAGQLTVCASALTSGGKPSAACCSNLKAQQGCFCQFAKNPAFARYINSPTARKVVASCGVALPRC

SEQ ID NO: 44458 - DNA, 606 bp, Panicum virgatum
  misc_feature: Ceres CLONE 2020712-R
cgtgcgtttttttttttcttagcaaaacgacgagtaaatcctttgcgtgttcttgatgaaaacgctaggtacatacatcgcatcgccgccgctagtgtcacaggagactcgacgagcagggtcaaacaggagataacgggataagatgtgtacgtcttgggcatggcacggcacgtcggtcttatccggatatctggatatacatgagctgcacgatccaggagctcgatttttatggtagcacgcagacgctatttttctctctttttttggcagcagtgtacggttcgtaatctgtacagttgctggagctggcagtaccatggatctgacgagaaacaggtgcagggcgcgacaggaagctcttgcaaattgcggcgggcgctgctgccaaggccatgcggtggtcaccttgcggcttttctagtgccaccttgcggcccagctagctgcagctggtggtcagcgtcggcctctagctagtggtggtgatcactgatcagtactcggttgatttggtcggtggccgtaaattttagtcgagttacagtttcatcagtttgtttcagtgtttcagtttgtttcatcagtactagtttaatttat

SEQ ID NO: 44459 - DNA, 671 bp, Panicum virgatum
  misc_feature: Ceres CLONE 2020720
  misc_feature: Encodes the peptide sequence at SEQ ID NO. 44460
ctgtttctcccttctctcggactctcccttgctcttccttccctggcggcgacgactgggcgagcggcgccgccatttgtcacgtctttgccaagccctttgccgacgaagagcatcctccaggtattactctgaatgatggcaactctgaaagatgctgctgctaggaagcctgtactggcaacaattcgtcttattgttccagctggtgctgcccgtcctgcacctccagttggtccagcgctgggtttctatcggctcaatttgatggctttctgcaaggatttcaatgccaggacccagaagtacaaggcagacactccaatgcaagtcacattaactgcttacaaggatagcaccttcgagttcgttgtcaagtcaccctcagtatcatggttcctcaagaaggctgcaggaatagaaacagccagcagtcgcccaggccacagcaatgtgtcatccctcactctccgccacgtgtatgagatcgcgaaattgaagcagtccgaccccttctgcaagcacatgtcgcttgaggcgctgtgcaagtccatcattggcacagctaattccatgggcattgagattgttaaagatttatgagaaggttggcaagccttaaagtcaggaagaattccgtgacatttgtgtgttcctagtttttagtttgg

SEQ ID NO: 44460 - protein, 154 aa, Panicum virgatum
  misc_feature: Ceres CLONE 2020720
  misc_feature (80)..(150): Pfam Name: Ribosomal_L11 Pfam Description: Ribosomal protein L11, RNA binding domain
  misc_feature (16)..(75): Pfam Name: Ribosomal_L11_N Pfam Description: Ribosomal protein L11, N-terminal domain
MATLKDAAARKPVLATIRLIVPAGAARPAPPVGPALGFYRLNLMAFCKDFNARTQKYKADTPMQVTLTAYKDSTFEFVVKSPSVSWFLKKAAGIETASSRPGHSNVSSLTLRHVYEIAKLKQSDPFCKHMSLEALCKSIIGTANSMGIEIVKDL

SEQ ID NO: 44461 - DNA, 610 bp, Panicum virgatum
  misc_feature: Ceres CLONE 2020721
  misc_feature: Encodes the peptide sequence at SEQ ID NO. 44462
cagggtcgctgtcagaggtagggctacaaaatcgggcggcgcgggtcgctcgccgccgtcggcaggcaggaagagtgtggcctcgcagctggtggagctagctactcttctcaggtctcgtttccactcccaggcagtcccggccggtggaggaggaggatggacgaggaagacggctgccaccgccaccacaccatccgggtcgcgtcgtcctccccagttctgttttaaatcaatacaccaagctgccgccgaccgcgccgccggccaagccgccgctgacccggattcatctgcaccaacagatcacagagtcacagagaaacatctcgagatgtcttctcttcagttagaggcctctggtacaagtgagagcactggtaatagttcgtcacaaacaccaaatacttttgcaccaatctgggagtattatgagccggaattggtcaggatagatggtgcactaaaagcaatttgcaagtactgtggaacaaagttgattgcaaatagaaaatcaggtacaaatagccttcgaactaacattgcagagtactgccccaaagtccctagtgatgataggaacagatttgtcgctacaatgaagaaaaag

SEQ ID NO: 44462 - protein, 91 aa, Panicum virgatum
  misc_feature: Ceres CLONE 2020721
  misc_feature (27)..(75): Pfam Name: zf-BED Pfam Description: BED zinc finger
MSSLQLEASGTSESTGNSSSQTPNTFAPIWEYYEPELVRIDGALKAICKYCGTKLIANRKSGTNSLRTNIAEYCPKVPSDDRNRFVATMKK

SEQ ID NO: 44463 - DNA, 476 bp, Panicum virgatum
  misc_feature: Ceres CLONE 2020722
  misc_feature: Encodes the peptide sequence at SEQ ID NO. 44464
ctctttaccaaacacattacaaacatgtctgaccacgaagaagttatcgatactcaagaagtcgaagttgccgttgaggccacctccggtcaaatgtctgttgaagatgctcttcaagaagtcctccgtcgtgctttggttcacgatggtcttgctcgtggtttgaaggaagccgtcaaggctttggacagacgtcaagctcacttggctgttctctgtgagtcatgtaccgagtccgagtacatcaagctcgttgaagctctctgtgctgaacacaacatcaacttgatcaaggtttctgatgccaagaagcttggtgaatgggccggtctctgtaagattgaccgtgaaggtaacgcccgtaaggttgttggttgttcttgtgttgctgtcactgatttcggagaggaatctgaggccatgaacgttctcttggattacttcaagactcgttagatttcttttgcttttttttg

SEQ ID NO: 44464 - protein, 143 aa, Panicum virgatum
  misc_feature: Ceres CLONE 2020722
  misc_feature (28)..(123): Pfam Name: Ribosomal_L7Ae Pfam Description: Ribosomal protein L7Ae/L30e/S12e/Gadd45 family
MSDHEEVIDTQEVEVAVEATSGQMSVEDALQEVLRRALVHDGLARGLKEAVKALDRRQAHLAVLCESCTESEYIKLVEALCAEHNINLIKVSDAKKLGEWAGLCKIDREGNARKVVGCSCVAVTDFGEESEAMNVLLDYFKTR

SEQ ID NO: 44465 - DNA, 737 bp, Panicum virgatum
  misc_feature: Ceres CLONE 2020734
  misc_feature: Encodes the peptide sequence at SEQ ID NO. 44466
ctgtcccggccatatatatcctccgccgccgacgatcgagctagctacagcctagagctgccaccaccgttaattataattacgcaccgcagcaatggcctgcggccactccgcctccgcgctcctgctgctggtggcggtggtggtggccgcctccgccgcctgccgctgctgcctcgccgcgccggcgggggcgctggtgacgcgcgtgccggggttcgcccagcagcagctgccgtcgaagcactacgccgggtacgtgacggtggacgaggcgcacgggcggcgcctcttctactacctggtggagtcggaacgcgaccccgccggggaccccctcgtgctctggctcaacggcggcccgggctgctccagcttcgacggcttcgtctacgagcacggaccattcaactttgagtcaggagggtcagttggaagcctgccaaagcttcatctaaatccatatagctggtccaaggtgtctagtgtgatatacttggactcccctgctggtgttgggctgtcatactcgaagaatgtttcagattatgacaccggcgatcttaagactgctgctgattcacattcttttcttctcaagtggtttcagctctaccctgagttcctgaaaaatcaattttacatagctggagaatcgtatgccggggtttatgtttctaccctttcacatgaagttgtcaaaggaatccacgaaggagttaagccaactataaatt

SEQ ID NO: 44466 - protein, 214 aa, Panicum virgatum
  misc_feature: Ceres CLONE 2020734
  misc_feature (40)..(214): Pfam Name: Peptidase_S10 Pfam Description: Serine carboxypeptidase
  misc_feature: SWISSPROT Homolog: EC 3.4.16.5 Carboxypeptidase C
MACGHSASALLLLVAVVVAASAACRCCLAAPAGALVTRVPGFAQQQLPSKHYAGYVTVDEAHGRRLFYYLVESERDPAGDPLVLWLNGGPGCSSFDGFVYEHGPFNFESGGSVGSLPKLHLNPYSWSKVSSVIYLDSPAGVGLSYSKNVSDYDTGDLKTAADSHSFLLKWFQLYPEFLKNQFYIAGESYAGVYVSTLSHEVVKGIHEGVKPTIN

SEQ ID NO: 44467 - DNA, 716 bp, Panicum virgatum
  misc_feature: Ceres CLONE 2020740
  misc_feature: Encodes the peptide sequence at SEQ ID NO. 44468
gacgaaggcagagcacaggcagcggccggagtcgagatgctcccatgggcggccacggcatcaccagccaccactccggccaccgctgccatctccttagctagtctcctccgcgtcgccgttctccgccctccacggcctctcttccggccgcctccgctgctgctgttgcgtgcgggcctcagggccccgccgcgcgccgcctcttccgacggcaacgtcttctgggaggagccggacgacgggtccgggagcgactatgaggacgaagttgaggaagagaacgagcggaggaggaactcaagtcctccgtccccctcgccgttctccaggctcgaggcggcgcggcagcaagagcaggagctccgaagagtattttgtttgcctagaaatcgagctcctcttgacgccagaagagaaggctatcttggatcaacacgagacccctgatgtcactaaaatatcatcaccgaaatggcatccgcttcatagttatgcgttggcgctgcagatacctctcatggacaagctccttgacagtggagttgacatcaatttacttgataaagatggcttcaccccccttcacaaggcagtcataggcaagaaagaggctgtcattagccatctcctaagaaaaggggcaaatccccatgttagagatagggatggagccacaccattacattatgctgttcaagctggtgcccctgcaa

SEQ ID NO: 44468 - protein, 152 aa, Panicum virgatum
  misc_feature: Ceres CLONE 2020740
  misc_feature (104)..(136): Pfam Name: Ank Pfam Description: Ankyrin repeat
  misc_feature: SWISSPROT Homolog: EC 2.7.11.1 Non-specific serine/threonine protein kinase
MRTKLRKRTSGGGTQVLRPPRRSPGSRRRGSKSRSSEEYFVCLEIELLLTPEEKAILDQHETPDVTKISSPKWHPLHSYALALQIPLMDKLLDSGVDINLLDKDGFTPLHKAVIGKKEAVISHLLRKGANPHVRDRDGATPLHYAVQAGAPA

SEQ ID NO: 44469 - DNA, 661 bp, Panicum virgatum
  misc_feature: Ceres CLONE 2020741
  misc_feature: Encodes the peptide sequence at SEQ ID NO. 44470
tggtcaataagcctgatctgaaggacatacgcatatcttttgaggagtttaaggcgtttgcttatttgcgccgaagattggagccactatcgatggccatcttcgcatatgggaaagtgaatggattgttgacaaaacaggatctaaaacgtgcggcgcagcatgtttgcggggttgacttaactgatagaatggtggacatcattttccatgtgttcgacacaaatcaggatgggaacctgagcttggaagagttcttaagagcattacaaagacgagaaactgatattcgtcaaccaacgatacctggtcctttggggttcctgtcttgctggttcggtggtaggaagtgttcttcacttcgacagatgttgttctgattggttccctctacgagcctcaatataaatgtcatgtgccttttgattgtcatgtcgtggtggagaagataaccgccaagtagtgcactgatgctgaccgttgaaacgatttagctgtaaatatcgtctgggtgggcctagtaactgtaaatagtcttgttttgtgtgtcgtctaagggtctaaggaccgagaatccgttgtgctattctcatcccatatgtaaattgaaccccatatgaccttaaggagtcattgtcaaaggtcttcccttttcacgtgc

SEQ ID NO: 44470 - protein, 125 aa, Panicum virgatum
  misc_feature: Ceres CLONE 2020741
  misc_feature (64)..(92): Pfam Name: efhand Pfam Description: EF hand
VNKPDLKDIRISFEEFKAFAYLRRRLEPLSMAIFAYGKVNGLLTKQDLKRAAQHVCGVDLTDRMVDIIFHVFDTNQDGNLSLEEFLRALQRRETDIRQPTIPGPLGFLSCWFGGRKCSSLRQMLF

SEQ ID NO: 44471 - DNA, 633 bp, Panicum virgatum
  misc_feature: Ceres CLONE 2020747
  misc_feature: Encodes the peptide sequence at SEQ ID NO. 44472
ttcatgccggtcggcgctgggccggccaagaaagatgagtgaccaccgatcaagttgtggtggtgttgtgcttaatttcccgtcgtgcgggtttctacttctatccttgtaataaaatgcagctgctttcagcgttcataaaaaaaaaaaaaaaagcaagcaattccatcaaccaacatcgtttgtagattttgcagcgttgggtacagacccaatcaagaacaagaagctagcagagcaactgagcaagcgatggcgccgcccaaggtgtacggatgggcgatctcgccgttcgtgtcgcgcgcgttgctggccctcgaggaggccggcgtcgactacgagctcgtccccatgagccgccaggacggcgaccaccgccgcccggagcacctcgccagaaaccctttcggtcaggtgccagttcttgaggacggcgacctcacgctcttcgagtcccgggcgatcgcgaggcacgtcttccgcaagcacaagccggagctcctgggcgccggcagcctggagcggtcggcgatggtggacgtgtggctggaggtggaggcgcaccagctgaccccggcggcgggccccgtcgtggtggagtgcgtcttcgcgccgttcctcggccgcgcgcgc

SEQ ID NO: 44472 - protein, 126 aa, Panicum virgatum
  misc_feature: Ceres CLONE 2020747
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MAPPKVYGWAISPFVSRALLALEEAGVDYELVPMSRQDGDHRRPEHLARNPFGQVPVLEDGDLTLFESRAIARHVFRKHKPELLGAGSLERSAMVDVWLEVEAHQLTPAAGPVVVECVFAPFLGRA

SEQ ID NO: 44473 - DNA, 509 bp, Panicum virgatum
  misc_feature: Ceres CLONE 2020753
  misc_feature: Encodes the peptide sequence at SEQ ID NO. 44474
atatggctggtctgggtggcatgggtggtctgggcggcatgggtggtatgggtggtctgggcggcatgggtgatatggctggtctgggtggcatgggtggtctgggcggcatgggtggtatgggtggtctgggcggcatgggtggtatgggaatggatgagtttgaagatgagagtgatgatgaagaggtgtcaaagcctcaagctgcggagaaggctgttgaggctgagaagacggaggcagctgaagccaagacagagactgctcagagcagttgaagaggattctggcatgatccaaaatagattgtatccgcatgttctatggattccacctagcctggaggaaaaccttttacgctgtggcactggctggcaggtcccagtgacttgccaagagaactagcgttggtctttcgactgggcatcctactgtcgcgcccagcatattatggatttctgatattgtttccatgatgctttctttgccaatgctggatttgttttgcc

SEQ ID NO: 44474 - protein, 91 aa, Panicum virgatum
  misc_feature: Ceres CLONE 2020753
  misc_feature: Functional homolog of the protein sequence given in SEQ ID NO 50702
  misc_feature: Useful for making plants with altered lignin content
  misc_feature: Functional homolog of the protein sequence given in SEQ ID NO 51624
  misc_feature: Useful for making plants with modulated biomass
  misc_feature: Functional homolog of the protein sequence given in SEQ ID NO 50144
  misc_feature: Useful for making plants with altered terpenoid content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50143
  misc_feature: Useful for making plants with altered alkaloid content
  misc_feature: Functional homolog of the protein sequence given in SEQ ID NO 50179
  misc_feature: Useful for making plants with modulated nitrogen use efficiency
  misc_feature: Useful for making plants with modulated phosphate use efficiency
MAGLGGMGGLGGMGGMGGLGGMGDMAGLGGMGGLGGMGGMGGLGGMGGMGMDEFEDESDDEEVSKPQAAEKAVEAEKTEAAEAKTETAQSS

SEQ ID NO: 44475 - DNA, 672 bp, Panicum virgatum
  misc_feature: Ceres CLONE 2020759
  misc_feature: Encodes the peptide sequence at SEQ ID NO. 44476
gaagctcaaggcgaaggcgaacgccgagatggctggcacggcgacggccgcgatctcgtcgctgcagtcccttctcgcgcacgtgtggcgagcggcgtgccgggccagggagctcgcgccggagcgggagacgacgtacaccctcctcgtcggctgccgggggcgcgtgcgcggtataccgcaggcctacatgggcaacaccgtgacgctcgccgtggccaagtccacggccggcgacgtcgcgggcagggggctgggctgggcggcgtggctgctgaaccgcgccgtggcggcgttcgacgaggggacggtgagggctgagctcgcgcggtggccgcaggagcccaggttcgtgtacgtggagccgccaggggaggacggcgccgcggccgtggcgaccgggagctcgccgcggttcgacgtgtacggcaacgacttcgggtggggccggccggtggccgtgcgcagcggcgccgggaacaagatggacgggaaggtgacggtgtacgaggggcgcggcggcgcgggcagcatggcgctggaggtgtgcctgtcggccagggcgctgggcaggctcgtcgccgacgaggagttcatggaggccgtcgcgagcgccggcgccgcggcgtgatccaccgagtggatgcaatgttgcgtgatcggatggatgca

SEQ ID NO: 44476 - protein, 209 aa, Panicum virgatum
  misc_feature: Ceres CLONE 2020759
  misc_feature: SWISSPROT Homolog: EC 2.3.1.144 Anthranilate N-benzoyltransferase
KLKAKANAEMAGTATAAISSLQSLLAHVWRAACRARELAPERETTYTLLVGCRGRVRGIPQAYMGNTVTLAVAKSTAGDVAGRGLGWAAWLLNRAVAAFDEGTVRAELARWPQEPRFVYVEPPGEDGAAAVATGSSPRFDVYGNDFGWGRPVAVRSGAGNKMDGKVTVYEGRGGAGSMALEVCLSARALGRLVADEEFMEAVASAGAAA

SEQ ID NO: 44477 - DNA, 700 bp, Panicum virgatum
  misc_feature: Ceres CLONE 2020790
  misc_feature: Encodes the peptide sequence at SEQ ID NO. 44478
atcaaccaggctgcacaaagcacaaacacatcaccatttcgcgggactatccgacctcatttcgtgcataatatccaccgcaactatggcgaacgacgaatacgatttcctattcaaagtggtcctcatcggagactcgggtgtcggaaaatccaacttgcttagccgattcacgcgcaatgagttcaacctagactcgaagtcgaccatcggtgtcgagttcgccacgaggtccatccagatcgacaacaagacgatcaaggcgcagatttgggacacagccggccaggaacgataccgcgccattacgtctgcgtactaccggggtgctgtcggtgcgctactcgtctacgacatcagcaagagcctctcgttcgagaacgtgacccggtggctgaaggagctgcaaggccatgccgacagcaatatcgtcatcatgctcgtgggcaacaagaccgatcagcggcacctgagagccgtcccgacagaggacggcaagaactttgccagcgagaacgggctgtcctttatcgagacatcggccctcgaggccacgaatgtcgacctcgctttccagaacattctgacttccatttaccagattgtgtcgagcaagagcctcgcggaggaaggcgcagacgttggaaagaagtttgacccgagggaaggcaataacatctcgctgagccaggaggggtca

SEQ ID NO: 44478 - protein, 204 aa, Panicum virgatum
  misc_feature: Ceres CLONE 2020790
  misc_feature (11)..(172): Pfam Name: Ras Pfam Description: Ras family
  misc_feature (11)..(125): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50163
  misc_feature: Useful for making plants with altered alkaloid content
MANDEYDFLFKVVLIGDSGVGKSNLLSRFTRNEFNLDSKSTIGVEFATRSIQIDNKTIKAQIWDTAGQERYRAITSAYYRGAVGALLVYDISKSLSFENVTRWLKELQGHADSNIVIMLVGNKTDQRHLRAVPTEDGKNFASENGLSFIETSALEATNVDLAFQNILTSIYQIVSSKSLAEEGADVGKKFDPREGNNISLSQEG

SEQ ID NO: 44479 - DNA, 706 bp, Panicum virgatum
  misc_feature: Ceres CLONE 2020795
  misc_feature: Encodes the peptide sequence at SEQ ID NO. 44480
aaggccgtccccaaatccatctccatcttgttcgattcattcgccgccgccgccgcagctgctagggtttcgatggcatccggcaagggcgagaagaagatgatcactctcaagagctccgacaaggtggaattcgaggtggaggaggcggtggcgatggagtcgcagaccatccgccacatgattgaggataactgcgccgataacagcatcctgatccccaacgttaactccaagctcctctccatagtcatcgagtactgcaccaagcatgcccatgccgccaaacttgaggacgccgcccccgcccccgccaacgccgctatcggcggcgaggacctcaagaaatgggccgccgagtaggtcaagatcgatcaggccactctcatcgacctcatcgaggctgccaacttcctggacatcaagggtttgctggacctgacctgccaggcgatggctgacatgatcaagggcaggagtccggaggagatccgcaagacgttcgacatgatgaacgacttctcccctgatgaggaagaggagatcatcagggacaaccagtgggctctcctgtgatggctgcttcattcattccgtgcttggaagaaacaagtgggcaatgcaaatgctgctagtatttatcagtgctagttctactactctctggtcgtaatggttgtgataaattgcgtttggcgaacctacc

SEQ ID NO: 44480 - protein, 96 aa, Panicum virgatum
  misc_feature: Ceres CLONE 2020795
  misc_feature (9)..(69): Pfam Name: Skp1_POZ Pfam Description: Skp1 family, tetramerisation domain
MASGKGEKKMITLKSSDKVEFEVEEAVAMESQTIRHMIEDNCADNSILIPNVNSKLLSIVIEYCTKHAHAAKLEDAAPAPANAAIGGEDLKKWAAE

SEQ ID NO: 44481 - DNA, 703 bp, Panicum virgatum
  misc_feature: Ceres CLONE 2020800
  misc_feature: Encodes the peptide sequence at SEQ ID NO. 44482
tccaaactccattattggttgatccttgagaagagaggaggaagagaggcagaagcaaaggagagacagcagttcttcagctaggcaggagggcaaagagaggggagatggcgtcgaagaggattcagaaagagctcaaggatctgcagaaggaccctcccacctcgtgcagtgcaggtcctgtgggtgaggatatgttccactggcaggcaacaataatgggtccatctgatagcccatattctggtggagttttcctagttacaatccatttccctcctgattatcctttcaaaccaccaaaggtatggtaactgattaagaatttgagcaatattgtatcaatcctttgtttctgttcattttgtatggctatcatttttgcacttgtattatgtaaaaataaggatatgcatacgctcatttcacatcccaggagcatgaatctggtttatatgcacttgaaaatctacggtgatgtacaagttgttttcccctaaagaaccttttgaaggggttgagagtttattggtttatagttttggaatttctgtcggtgtgctgctttcatttttctagatttgggccatgaactaagaacacttgctgaaacactgaatttaaggaagaactctaagaaagtaagaatcaaagctgtctcatgtaaatttgtttgcagtggtaaatacatggggcataatgg

SEQ ID NO: 44482 - protein, 68 aa, Panicum virgatum
  misc_feature: Ceres CLONE 2020800
  misc_feature (5)..(68): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
  misc_feature: Functional homolog of the protein sequence given in SEQ ID NO 50119
  misc_feature: Useful for making plants with modulated low light sensitivity
  misc_feature: Functional homolog of the protein sequence given in SEQ ID NO 50120
  misc_feature: Useful for making plants with modulated light quality sensitivity
MASKRIQKELKDLQKDPPTSCSAGPVGEDMFHWQATIMGPSDSPYSGGVFLVTIHFPPDYPFKPPKVW

SEQ ID NO: 44483 - DNA, 707 bp, Panicum virgatum
  misc_feature: Ceres CLONE 2020806
  misc_feature: Encodes the peptide sequence at SEQ ID NO. 44484
ccctttccttgcacatcaaataatgtctcgtgtccctagcattctcagccccaccgaagaggatattcaacttctcttgagtgctcaatgtcacattggtaccaagaatgccaacgtccgcatggctccttacatttacaagcgtcgtgctgatggtatcaacttgatcaacatcggtaagacttgggaaaagcttatctttgctgcccgtgtcattgctgctatcgagaaccctcaagacattgttgttgtctctgcccgtccttacggtcaccgtgctgccttgaagtttgctcgctacattggcgctgaagctactgtcggtcgtttcactcccggtactttcactaattacatcacccgttctttccgtgaacctcgcttgatcatctgtaccgatcctcgctccgacttccaagctgtcttggaagcttcctatgtcaacatccccgtcatctctcttgctgacactgatgcctctcttcaatacattgatgttgctatccctaccaacaacaaggccaagcatgctattggtttgatctactggctcttggctcgtgccgtcctccgtcttcgtggtactttggactacaacactccttgggaagtcatggttgatatgttcttctaccgtgaccctgaggaaattgaaagagaaacgaagccgctgatttggaggtgactttgctgccactgccgatgcc

SEQ ID NO: 44484 - protein, 220 aa, Panicum virgatum
  misc_feature: Ceres CLONE 2020806
  misc_feature (18)..(186): Pfam Name: Ribosomal_S2 Pfam Description: Ribosomal protein S2
MSRVPSILSPTEEDIQLLLSAQCHIGTKNANVRMAPYIYKRRADGINLINIGKTWEKLIFAARVIAAIENPQDIVVVSARPYGHRAALKFARYIGAEATVGRFTPGTFTNYITRSFREPRLIICTDPRSDFQAVLEASYVNIPVISLADTDASLQYIDVAIPTNNKAKHAIGLIYWLLARAVLRLRGTLDYNTPWEVMVDMFFYRDPEEIERETKPLIWR

SEQ ID NO: 44485 - DNA, 523 bp, Panicum virgatum
  misc_feature: Ceres CLONE 2020806-R
  misc_feature: Encodes the peptide sequence at SEQ ID NO. 44486
ctggcccgccacggcgctcccggcgccggcggcggcgggcggcgtatccgccggcggggatctcggccacctcgtgatgcggcgcggcgcgcgggcgtgccgcggcaccgtgggcgagtgcatgggctacctcgacgtggacgccgagggcgaggccgacgtggccgggatggccaccggcggcagcaagcgccgggtgctgcagggcggctccgggtacatcggctacgacgcgctgcgccgggacaacgtgccctgctcccagcgcggcgcctcctactacaactgccagcccggcgccgaggccaacccctactcccgcggctgcagcgccatcacccagtgccggggctgatcgcgccctgcacgcgtcttccacctcaaatcatgttgctgctagcttcatggtgatgtttgtcttacgagttcgagagatgggttgcgcagtggagatgtgtctgctctgttctagctgagcttcgccttcagggtgaaagtaaaagtaatttatatacgatggggc

SEQ ID NO: 44486 - protein, 117 aa, Panicum virgatum
  misc_feature: Ceres CLONE 2020806-R
  misc_feature (51)..(117): Pfam Name: RALF Pfam Description: Rapid ALkalinization Factor (RALF)
WPATALPAPAAAGGVSAGGDLGHLVMRRGARACRGTVGECMGYLDVDAEGEADVAGMATGGSKRRVLQGGSGYIGYDALRRDNVPCSQRGASYYNCQPGAEANPYSRGCSAITQCRG

SEQ ID NO: 44487 - DNA, 1506 bp, Panicum virgatum
  misc_feature: Ceres CLONE 2020825
  misc_feature: Encodes the peptide sequence at SEQ ID NO. 44488
aactaacgctaaaaaagtaacagtttctgtactttattgatcccgtaccggtacccccgtccgccatgaaggtcaagaagcgtgatttgcgcaagcgcctgccgcagatccctatcaactacccgggccccgacgtgatccccttcagctacgagtcggagaaggccaaggttgagaacctgtgcaagcgcctcgcggacaacgaggtggagacccgcgacgccgtgctcgccgagctgccgcgctacatccgcgaggtctgcgcgccgttcctcaaggacggcgcgcttgacgccgcggagcgcgaagccgccaaggacgttgacctgactgcgcacgacgcgggcgcgaagctctgggacgctctcctccgcgacccgagcgccgcgaacctcgcgctgcttttcgagaagctgtgcctcggcctgtacttctgcatgtggcacagcgacaagccgctcgtccagcacgagtgcgcgctgaagatcgtgaagctcctcgacgcgcccccgacgccgctgttgaaggatcttttcatccgctcgatgctccgcacgctcgttgcgcactggggcaaaatcgaccagtggcgcatggacaagtacatggcgctcgtgcgcaaactgttctaccaggtcctcctgcacctcgtcgcgacggtgcagaccacccagaagaaggcgaccagcgcggcggtgcagagcagcaacaaggcccccgccgcgtcgccgtccgcgaacaagtcgaagcgcgctcggcaatccgccggcgacgcctccgaggctgcgctgtccaacaaggacgaggacgcaatcgccgagccgtccgtgattgcgcgccacccgacgatgctgcgtgttgcctcgacgttccagacggatgtcatccgatcggagagcgtcggcttgacgatgcacatctgcgacctgtccctgacggagctgctgcgctgcgacgtcgtcgagacgccgctgttcatctctgtgtcgctggcggtgccgttgttcgcgatgcagcgcggcgactacatggagaagcgcgtgatggacaacttcgtcgtccccatcgccgccggccagctcgagcgccgctcgcagcagttctccgtcgagacgtgcgccgtgctcgccgcgcagctggagcagctctccgtgtcgcgcgcgacgcacttcagcgtccgcccgctcatggtcgaggcgcagcgcctcgtcgagaactacgtcgggcttcagacgtcgcccgaactgtacgagccggtgtcgcaccgcgacgagcgcgcgcgcattgccaaggagattcaggcggcagaggacatcaagatgcgcatgagccgccttgccatgaagcacgccgccgccgcgggcaccgtgcgcgccatccggcgcacgaacaaggcctcgcagcccacctccaagcgcagcgctcgctggaagaagtgagagcctccgcactgcctcccctcatcggttaaccgctgcatcattaaagccgctttgtgctaaacgc

SEQ ID NO: 44488 - protein, 457 aa, Panicum virgatum
  misc_feature: Ceres CLONE 2020825
  misc_feature (35)..(334): Pfam Name: Nop52 Pfam Description: Nucleolar protein,Nop52
MKVKKRDLRKRLPQIPINYPGPDVIPFSYESEKAKVENLCKRLADNEVETRDAVLAELPRYIREVCAPFLKDGALDAAEREAAKDVDLTAHDAGAKLWDALLRDPSAANLALLFEKLCLGLYFCMWHSDKPLVQHECALKIVKLLDAPPTPLLKDLFIRSMLRTLVAHWGKIDQWRMDKYMALVRKLFYQVLLHLVATVQTTQKKATSAAVQSSNKAPAASPSANKSKRARQSAGDASEAALSNKDEDAIAEPSVIARHPTMLRVASTFQTDVIRSESVGLTMHICDLSLTELLRCDVVETPLFISVSLAVPLFAMQRGDYMEKRVMDNFVVPIAAGQLERRSQQFSVETCAVLAAQLEQLSVSRATHFSVRPLMVEAQRLVENYVGLQTSPELYEPVSHRDERARIAKEIQAAEDIKMRMSRLAMKHAAAAGTVRAIRRTNKASQPTSKRSARWKK

SEQ ID NO: 44489 - DNA, 657 bp, Panicum virgatum
  misc_feature: Ceres CLONE 2020853-R
  misc_feature: Encodes the peptide sequence at SEQ ID NO. 44490
ctgggccgtttcctgaaggagaaaaatcctgaaattaaggttattggtgtcgagccttcggaaagtaacatactctctggtggaaaacctggtccacataagattcagggaattggggcaggatttgttccaaggaacttggatagtgatgttcttgatgaagtaattgagatatcaagtgatgaagctgttgagacagcaaaacagttggctgttcaggaagggttactggttggaatctcttctggagcggcggccgctgctgccataaaagtttccaagagaccagaaaatgctggaaagctgatagtggttatatttccaagctttggtgagaggtatctttcatccgtcctctatcagtcgataagagaagaatgcgagaacttgcagcctgagccatgagcgagcccttggtcttaacagcgtaataaatgtttctgaaataagatgcttggtcagcatttgtgcctctgagaagtgttacaccactccacttggcatcatttggcactgtcatccttttgccactaggactggaattgatgaggcatgtggagagatatccaggactctccaactgtttcctccttttcctcctttaacaaaacagaaacacttcttacatgtctatacgattcggtctgattttgttgg

SEQ ID NO: 44490 - protein, 134 aa, Panicum virgatum
  misc_feature: Ceres CLONE 2020853-R
  misc_feature: SWISSPROT Homolog: EC 2.5.1.47 Cysteine synthase
  misc_feature: Functional homolog of the protein sequence given in SEQ ID NO 51108
  misc_feature: Useful for making plants with modulated cold sensitivity
LGRFLKEKNPEIKVIGVEPSESNILSGGKPGPHKIQGIGAGFVPRNLDSDVLDEVIEISSDEAVETAKQLAVQEGLLVGISSGAAAAAAIKVSKRPENAGKLIVVIFPSFGERYLSSVLYQSIREECENLQPEP

SEQ ID NO: 44491 - DNA, 696 bp, Panicum virgatum
  misc_feature: Ceres CLONE 2020853
atacactgcaccggggcctcccaatcttcctcgtccgtgctcactcccaggcagcacgagccgagagcgatccaggtcgatcaggctccgtatccgccatcttggccgccgcgccacgatcagatttgcttgattccatcgaagccatcagaggcgaggtaagcaagatcacttcttctataaatgtgtgtgcatcactcccagtcccagctgcgctccgttcttgaaaagttgcagccgccggcagggagtgaggtgaccgacccgatcgcctagtgtcggctgccggcgggcatggtgccggagaggcggcggccgggttcccgtgcgggcggaggcggaatgggcggcggcgggaagctgcagcaggcgcaaggccgggcgccggcggcgcccgggcaggggtacttcacggcggggttggcggcgctgttcctctgcctggccgcgctgctggtgctcctgccgctggtgctgcccccgctgccgccgccgccgctgccgctgctgctggtgccggtggggctcatggccgtcctgctcgcgctggcgctcgtgccgtcctccgacggccggcgcgcgagcggcgccgttgtcgcctcgtcgtgcctgtactgaagaacgcgcatggcacgtgcgcgagggagggagggccggggagctcatcgtgctcgtacatgtaaaaatgtggtgtgt

SEQ ID NO: 44492 - DNA, 577 bp, Panicum virgatum
  misc_feature: Ceres CLONE 2020859-R
  misc_feature: Encodes the peptide sequence at SEQ ID NO. 44493
tcaaacctggacaggaaaaatcacttgctggcattgtcacagagagagattatctccggaaaatcatagtgcaaggacgatcttccaagtcaactaaggttggagacatcatgactgaagagaacaagctgatcaccgtgaagcctggaaccaaggtcctgcaagccatgcagctgatgacagagaaccgcatcagacacatcccggtgatcgaaggcacagggatgctggggatggtctccatcggcgacgtcgtccgtgcggtggtcaacgagcacagggaggagctgaaccggctcaacgcctacatccagggaggctactaggacgacgcccctacctcccagcgaagtccgcctttgatatccaataactcggaccagtgatgatgacgaaataggccgtgtgttcgcggacaatgttgctgaattgcgcaaggtgttttcccccgcgtttactatatgtgtatattgccaaaaggcgggcgtgacagtgcgcctggtgctggggcgcagactatctgacggtggaaacaccggaaataaaaagcgtgccgccgtgtgcttgcttccttcgc

SEQ ID NO: 44493 - protein, 107 aa, Panicum virgatum
  misc_feature: Ceres CLONE 2020859-R
  misc_feature (1)..(89): Pfam Name: CBS Pfam Description: CBS domain pair
  misc_feature: SWISSPROT Homolog: EC 1.1.1.205 IMP dehydrogenase
KPGQEKSLAGIVTERDYLRKIIVQGRSSKSTKVGDIMTEENKLITVKPGTKVLQAMQLMTENRIRHIPVIEGTGMLGMVSIGDVVRAVVNEHREELNRLNAYIQGGY

SEQ ID NO: 44494 - DNA, 671 bp, Panicum virgatum
  misc_feature: Ceres CLONE 2020859
aaagccccgagcgctagccatctgcgctcgcccgcaccgccccgttgttcccgcgctctcgcccctccttcccgcccccctcgctcctccttcctgcctccttgctcctccttcccgcccgttcgccagccagttcgcgcgcgccagtttccccaccaaatcatcgccaacgactccggtagatgcaccaaatcgacgctcctcgatccagcatcggcgccgccggactcgtcatgtcccggccgccgcgtccccgagtggcgcaagccgccgacttcggccacgatgctgcgggttcagctcgggggccggctggtcccgcaaggatttgatgatctagagtccattcgcgtgacggaacggagttcatagacgacctgagcaatggtaagattaaatttctggctgaatggttcacggagacaaggaattgatgatgctaggttctctgagatgaggagttgttgatgttcctggttaacgaatttgtgatggggtatagtgagtagtaatacctagtagggaatagggattgcgcgattgaaactggttcttattcttactgctacccactacttgctactgctactatctgccggtgttgaacatgacattgtgagcatggctgaaaggagaaagggagcactacctgcccctgatgaactagagat

SEQ ID NO: 44495 - DNA, 707 bp, Panicum virgatum
  misc_feature: Ceres CLONE 2020862
  misc_feature: Encodes the peptide sequence at SEQ ID NO. 44496
attctagacgccacacacacaccatctctgccctcagctcctcgccgaaccggaacacccgcacacccacgccacttgtacccatggcgccccggtcggcgcacaagtcgccggtgccgccggccaccggcctcggtctcggcgtcgtcggtggcgtcggaggcgtgggcatgggcccccacttcaggggcgtgcggaagcgcccgtgggggcggtacgccgcggagatccgcgacccggccaagaagagccgcgtctggcttggcacgtacgacacggccgaggaggccgcccgcgcctacgacgccgccgcgcgcgagttccgcggcgccaaggccaagaccaacttcccgttcgcgtccaagtgccccgtcgccgccggcgccggcagccccagcagcaacagcaccgtggagtcgggcggaggcggcggcggctgcggcgtccaggcgcctatgcaggccatgccgctgcccccggccctcgatctcgatctcttccaccgggcggcgtccgtgaccgcggtctcccccggcggcatgcggtttcccttcaaagggttccctgtcgcgcgcccgaccccgaacccctacttcttctacgaacaggcgtccggctaccggatgctcaaggtcgccccgccgccggtcaccgtggccgccgtcgcgcagagcgactccgactcctcgtcggtggtcgatcacacc

SEQ ID NO: 44496 - protein, 207 aa, Panicum virgatum
  misc_feature: Ceres CLONE 2020862
  misc_feature (32)..(83): Pfam Name: AP2 Pfam Description: AP2 domain
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
MAPRSAHKSPVPPATGLGLGVVGGVGGVGMGPHFRGVRKRPWGRYAAEIRDPAKKSRVWLGTYDTAEEAARAYDAAAREFRGAKAKTNFPFASKCPVAAGAGSPSSNSTVESGGGGGGCGVQAPMQAMPLPPALDLDLFHRAASVTAVSPGGMRFPFKGFPVARPTPNPYFFYEQASGYRMLKVAPPPVTVAAVAQSDSDSSSVVDH

SEQ ID NO: 44497 - DNA, 649 bp, Panicum virgatum
  misc_feature: Ceres CLONE 2020872
  misc_feature: Encodes the peptide sequence at SEQ ID NO. 44498
agcagcagccgccgcgcagcagcagcagcagcatccccacccccaccccccacccaaaagcgattccaagcagcagctcctaagaagcggaggggatcgcccgccgattccatctccacccgcgccccgaccacccccgccgctcgcccctttccgaccctagggttgcgggtgcctgggccctggggtgggttccgacccgcgaggcttccccccctagggtgcggcggactcctcgcttcgccgctctctgctgctaggcttaggttagggttcgacgctggggggaggggcgtcctcctcctccgccgcccccgccgccaatgcctcccggcggtaggcgcggcgccaagcagggccccaagtggaccagggaaccccagctcggcgacctcgtcctcgccaagatcaagggatacccggcctggccagccaagatcagcaagcctgaggactggagccagacgccaatgccgcgcaagttcttcgtctacttctatggcaccagagagattgcttttgtacctctggcagatcttcaggagtttacggagaagacaaagaatgatctgttaaatcgagctccaaatattaaagtgcaaagaaaatatgtccaagcttataatgatgccgtggagcagatctgcaa

SEQ ID NO: 44498 - protein, 108 aa, Panicum virgatum
  misc_feature: Ceres CLONE 2020872
  misc_feature (18)..(89): Pfam Name: PWWP Pfam Description: PWWP domain
  misc_feature: Functional homolog of the protein sequence given in SEQ ID NO 50408
  misc_feature: Useful for making plants with modulated flowering time
MPPGGRRGAKQGPKWTREPQLGDLVLAKIKGYPAWPAKISKPEDWSQTPMPRKFFVYFYGTREIAFVPLADLQEFTEKTKNDLLNRAPNIKVQRKYVQAYNDAVEQIC

SEQ ID NO: 44499 - DNA, 681 bp, Panicum virgatum
  misc_feature: Ceres CLONE 2020874
  misc_feature: Encodes the peptide sequence at SEQ ID NO. 44500
tgcagaagcttttacatctgtgacaagtgttatgacgcagaacaacaacttgaagacagggagaggcacccaactaacagtagagacgcacatatgctccatccggttgatattatcggggtgcccaaagatacaaaagatagagatgacatcttagaaagtgagttttttgacaccaggcaggcatttcttagtctttgtcaaggaaaccattatcagtatgacacacttcgccgtgcaaagcattcatcaatgatggtgttgtaccacctacacaatccaactgcaccagcatttgtcactacatgcaatgtctgctgtcatgatattgaaactggtcaaggctggcgatgtgaagtttgtccagatttcgatgtgtgcaatgcttgtttctcaaaaggagcagtcattcatcctcacaatttaacaaaccatccatcagctgcagaccgtgatgcccaaaacgcagaagctcggcaaatgcgtgttcaacagctaaggaagatgcttgatcttctggtacatgcatcaacatgccgctctggtagttgccagtatcctaactgccggaaagtcaagggactattccgtcatgggatgcagtgcaaaacacgtgcttctggaggctgtgtcctttgcaagaaaatgtggtacatgcttcaactccatgcccgagcttgc

SEQ ID NO: 44500 - protein, 226 aa, Panicum virgatum
  misc_feature: Ceres CLONE 2020874
  misc_feature (97)..(142): Pfam Name: ZZ Pfam Description: Zinc finger, ZZ type
  misc_feature: SWISSPROT Homolog: EC 2.3.1.48 Histone acetyltransferase
CRSFYICDKCYDAEQQLEDRERHPTNSRDAHMLHPVDIIGVPKDTKDRDDILESEFFDTRQAFLSLCQGNHYQYDTLRRAKHSSMMVLYHLHNPTAPAFVTTCNVCCHDIETGQGWRCEVCPDFDVCNACFSKGAVIHPHNLTNHPSAADRDAQNAEARQMRVQQLRKMLDLLVHASTCRSGSCQYPNCRKVKGLFRHGMQCKTRASGGCVLCKKMWYMLQLHARA

SEQ ID NO: 44501 - DNA, 686 bp, Panicum virgatum
  misc_feature: Ceres CLONE 2020876
  misc_feature: Encodes the peptide sequence at SEQ ID NO. 44502
acaaattttgctttcttttaatgaccttgatcctgccgccagtgcagcccaccgaatgcgactctctgacatcttccgccgcctcttttctcatttcttctcaacccgctctcccacagaaaccaaggaaactcaccaacaatacacgtcccaatcgcccccttcttcaggcaaaacaatccccaagcttcccaccactaccacaatcaccagcactttagcagccatgcctggcgttacatccgactacggtagcagcagcaagtatgaccagatcccgggtcctctcgggctggcatcggcttcgctgcagggcaaagtcgctctcgtgacgggcgccggccgcggaatcggccgggaaatggctctcgaactcggacgccgcggggccaaggtcatcgtcaactacgccaacagcgactcggccgcgcaagaggtggtcagccagatcaagaagaacgggtcggacgcggcgtgcatcaaggccaacgtgacgctggtcgacgacattgtgcggctgtttgccgaggcgcacaagaagtttggcaagctcgacattgtgtgctccaacagcggcgtcgtgtcgttcggccacgtcaaggatgtcacgcccgaggagtttgaccgcgtcttcaacgtcaacaccccgcgccagttctttgtcgcccgggaggcgtacaagcatc

SEQ ID NO: 44502 - protein, 153 aa, Panicum virgatum
  misc_feature: Ceres CLONE 2020876
  misc_feature (31)..(152): Pfam Name: adh_short Pfam Description: short chain dehydrogenase
  misc_feature: SWISSPROT Homolog: EC 1.1.1.252 Tetrahydroxynaphthalene reductase
MPGVTSDYGSSSKYDQIPGPLGLASASLQGKVALVTGAGRGIGREMALELGRRGAKVIVNYANSDSAAQEVVSQIKKNGSDAACIKANVTLVDDIVRLFAEAHKKFGKLDIVCSNSGVVSFGHVKDVTPEEFDRVFNVNTPRQFFVAREAYKH

SEQ ID NO: 44503 - DNA, 668 bp, Panicum virgatum
  misc_feature: Ceres CLONE 2020893
  misc_feature: Encodes the peptide sequence at SEQ ID NO. 44504
gtaatcgttgccattgagaaccctaaggacatcattgtccagtccgcccgtccctacggccagcgtgccgtcctcaagttcgctcagtacactggtgcccatgctattgctgggaggcacacccctggtaccttcaccaatcagctccagacatccttcagtgagccccgactgctcatccttaccgacccaaggactgatcaccagccaatcaaggagtctgctttgggcaacatccccaccattgccttctgtgatactgactcccccatgcggtatgtcgatatcggcatcccggccaataacaagggaaggaacagcattggatgcctgttctggctcttggcaaggatggttctgcagatgaggggcactatcctccctgggcacaagtgggaagtcatggttgatttgttcttctacagagaccctgaggaagcaaaggagcacgaggaggaagctgctgctgcccctgactttgccgctatcactgattatccagcggctgatcagtggggtggagaccagtggacctctgatgttgctgcaccgcctgttgctgttggtggcactggtgcggagtggggtgctgctccagctccagttcctactggcgatggctgggatccagctggggccccggcacctgtggagggtgctgttcctcc

SEQ ID NO: 44504 - protein, 222 aa, Panicum virgatum
  misc_feature: Ceres CLONE 2020893
  misc_feature (1)..(123): Pfam Name: Ribosomal_S2 Pfam Description: Ribosomal protein S2
VIVAIENPKDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHKWEVMVDLFFYRDPEEAKEHEEEAAAAPDFAAITDYPAADQWGGDQWTSDVAAPPVAVGGTGAEWGAAPAPVPTGDGWDPAGAPAPVEGAVP

SEQ ID NO: 44505 - DNA, 622 bp, Panicum virgatum
  misc_feature: Ceres CLONE 2020919-R
  misc_feature: Encodes the peptide sequence at SEQ ID NO. 44506
aggaggcggagggccgcgagctgggcgggcagaagaagaagccggagaagagctcggtcaaggccgggctccagttcsccgtcggccgcatcgggcgctacctcaagaagggccgttacgcgcagcgcgtgggcacgggcgcccccgtctacctcgctgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcacctcatctcactttgcttttgtgtgtatgtagttccgcatctcaatgtatcgtgtcctccgagcttcggatcctatgtcgtaggtctaggctttagctgtagtggttggtgatggggatatgtatgtttccaaaatttaatgagaagtgggagcggtttgctc

SEQ ID NO: 44506 - protein, 141 aa, Panicum virgatum
  misc_feature: Ceres CLONE 2020919-R
  misc_feature (17)..(90): Pfam Name: Histone Pfam Description: Core histone H2A/H2B/H3/H4
  misc_feature (26)..(26): Xaa is any aa, unknown, or other
EAEGRELGGQKKKPEKSSVKAGLQFXVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAEKAEKAAKSPKKAAAKSPKK

SEQ ID NO: 44507 - DNA, 538 bp, Panicum virgatum
  misc_feature: Ceres CLONE 2020919
acacgccgcacgccgcacgccgccgcttatacgtcgcacccggggagggacggacggaccccccctgctcccacctcttccttctcctccctctcgcctcccggtcccgcgccccccgcctccaccttctccgcgcgccaaggcctccccgcacggcgccggcggtgcatgggcggcgggacgacggcggcggcagcggcgacgaccaccggggcgccatgaccaccgccgccgccgtgaacgcggcggcggtcgcgcagctctgcgccggcgcccggcgccggaagccggcgcaggggccccgggtcgacctgcgctgggcgcgtctgctccgcgtcgccgtcgtcagccgggcgctccgcgtcgtgcgggaccagctgctcgcgtgctcctcctgcggcggcaggggcggccggtaccgccgcctcggcccgcccgcgctggcccccgtcgacaggggcgacgcctgcgtcctcgccggcgccgacgacgccgatgacgcggccgcggacgacgccgagaacgtcgtcagcctcca

SEQ ID NO: 44508 - DNA, 479 bp, Panicum virgatum
  misc_feature: Ceres CLONE 2020927
  misc_feature: Encodes the peptide sequence at SEQ ID NO. 44509
ataacggctcacgggacccccgacaccgaggcaccatcaaatataagggagtaggggagagggagcggagagcggcggcggcggcccgggcgccggaggggaggggaggggaggatgagaggagatggcggccatctgctcctcctacgtcggattccaagtgctgaacaagtcaggttcgaaggacggcaccggcctcggagcgcaagagcacggaaggttgtatcctgtagagactcgtgttaacagcaacaagcgtggcctaggttctacttaactggaactgatccacgcagcggaggatgatgttgaatatgatcccctctagtccaagccggatatgctatccaagaagaaagccgagctagctgtatacaggataaggaagatgcacgtagacgacaatcgattgcacgagaaggacttcgagatggctttctttaaggaattttggcctgataatgtgtataagcagagct

SEQ ID NO: 44509 - protein, 50 aa, Panicum virgatum
  misc_feature: Ceres CLONE 2020927
  misc_feature (6)..(50): Pfam Name: G-patch Pfam Description: G-patch domain
MAAICSSYVGFQVLNKSGSKDGTGLGAQEHGRLYPVETRVNSNKRGLGST

SEQ ID NO: 44510 - DNA, 682 bp, Panicum virgatum
  misc_feature: Ceres CLONE 2020935
  misc_feature: Encodes the peptide sequence at SEQ ID NO. 44511
cactactcaatcaacaacaagcatgcagatcttcgtcaagaccctcactggcaagaccatcacccttgaggtcgagtctagcgacaccatcgagaacgtaaagcagaagatccaggacaaggagggcattcccccggaccagcagcgcctcatcttcgccggcaagcagcttgaggacggccgtaccctcgctgactataacatccagaaggagtcgaccctccacctcgtgctccgtcttcgcggcggtatgcagatcttcgtcaagacccttacgggcaagactataaccctcgaggtcgagtcgtcggacacgatcgagaacgtgaagcagaagattcaggacaaggagggtattcccccggaccagcagcgtttgatcttcgctggtaagcagctcgaggacggccgtaccctggccgactacaacatccagaaggagtctacgctccacctcgtgcttcgcctgcgcggcggcggcaagaagaccaagtgctgcttcggcgagtgctccaagcgcgtggtcctcatcactggcgactgccgcttctgccagtcccagttctgcggctcgcaccgcctccccgaggatcacgcctgccagagcatggactcgtgccgacaggcggcctttgatcggaacaagaacaagctcatgaacgagaagtgcgtcagccagaag

SEQ ID NO: 44511 - protein, 219 aa, Panicum virgatum
  misc_feature: Ceres CLONE 2020935
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (159)..(201): Pfam Name: zf-AN1 Pfam Description: AN1-like Zinc finger
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIENVKQKIQDKEGIPPDQQRLIFAGKQLEDGRTLADYNIQKESTLHLVLRLRGGMQIFVKTLTGKTITLEVESSDTIENVKQKIQDKEGIPPDQQRLIFAGKQLEDGRTLADYNIQKESTLHLVLRLRGGGKKTKCCFGECSKRVVLITGDCRFCQSQFCGSHRLPEDHACQSMDSCRQAAFDRNKNKLMNEKCVSQ

SEQ ID NO: 44512 - DNA, 717 bp, Panicum virgatum
  misc_feature: Ceres CLONE 2020945
  misc_feature: Encodes the peptide sequence at SEQ ID NO. 44513
aaaaccaacaacaccatgggaaatcctgaagagtgggttgagatcctcaagcagtgcaagtacctgcccgagcaggaccttaaggagctctgcgagatggtgaaggagctccttctcgaggaatccaacgtccagcccgtcgcggctcccgtcaccatctgcggtgacatccacggtcagttctatgacttgttggagctcttcaggattggtggtgagatccctcagaccaactacattttcatgggtgacttcgtcgatcgtggctattacagtctcgagaccttcaccctcttgcttgccctcaaggcgaggtggcccgacaagatcacgctcctcaggggtaaccacgagagcaggcagatcacccaagtgtacggcttctacgacgagtgccagcagaagtacggtaacgccaacgcctggaaatattgcacacaagtcttcgactacctcaccctcgccgcgctcgttgatggcaaggtcctttgcgtccacggaggcctttcgcctgacatccgcaccatcgatcagatccgaaccatccccagaaaccaggagattcctcacgagggcgctttctgtgatttgatgtggtccgatcccgaggagattgagacttggcagatcagcccgcgaggtgctggctggctcttcggctccaaggtcacagaggagttcacgcgagtcaacggcctggagcttatctgccgagcc

SEQ ID NO: 44513 - protein, 233 aa, Panicum virgatum
  misc_feature: Ceres CLONE 2020945
  misc_feature (44)..(220): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MGNPEEWVEILKQCKYLPEQDLKELCEMVKELLLEESNVQPVAAPVTICGDIHGQFYDLLELFRIGGEIPQTNYIFMGDFVDRGYYSLETFTLLLALKARWPDKITLLRGNHESRQITQVYGFYDECQQKYGNANAWKYCTQVFDYLTLAALVDGKVLCVHGGLSPDIRTIDQIRTIPRNQEIPHEGAFCDLMWSDPEEIETWQISPRGAGWLFGSKVTEEFTRVNGLELICR

SEQ ID NO: 44514 - DNA, 564 bp, Panicum virgatum
  misc_feature: Ceres CLONE 2020956
  misc_feature: Encodes the peptide sequence at SEQ ID NO. 44515
acaccacagcgcgcaagatgagcagcagcggcggcggcggggcggtgaagacgccgtcggacttcctcaagtccatcaggggccggcccgtcgtcgtcaagctcaactccggcgtcgactaccgaggtattctggcttgtcttgatggatacatgaacatcgcgatggagcaaactgaagagtatgtgaatggtcagctaaagaacaaatatggtgacgcattcataagaggaaacaatgtattgtacatcagtacatccaagcgtacccttacagatggttcgtgagaggtgaaactgttaagatcttcagtgccagtcttgcaactcgaccgattatgagtgaattttatgtattactttcttttccagttgtactgacaggcgacagctatgcttgatgttaatgttagcagcttggaactctgtccacatattttgcactcaagatatgtggtggtaattcgacctgtagagatacagataagactctggtgtcatcaactgaaatgtctgctatctcaaatatttttgtgaatcaaaaagacatcgttgatctttggct

SEQ ID NO: 44515 - protein, 89 aa, Panicum virgatum
  misc_feature: Ceres CLONE 2020956
  misc_feature (15)..(80): Pfam Name: LSM Pfam Description: LSM domain
MSSSGGGGAVKTPSDFLKSIRGRPVVVKLNSGVDYRGILACLDGYMNIAMEQTEEYVNGQLKNKYGDAFIRGNNVLYISTSKRTLTDGS

SEQ ID NO: 44516 - DNA, 686 bp, Panicum virgatum
  misc_feature: Ceres CLONE 2020968
  misc_feature: Encodes the peptide sequence at SEQ ID NO. 44517
aagaccctctctctctctctctctctcctctggtctcgcacccgccgccgccgcccgccgtcgccgctctcgctcgcaccgtcgcatcgccgcaggattcgcaaagatggcggtgccgctgctgacgcagaagatcgtgaagaagcgggtgaagcagttcaagaggccccacctcgaccgctacaagtgcctcaacccaagctggcgcaggcctaagggtattgactcccgcgtcaggcggaagtttaagggatgcaccttgatgcccaacattggatacggctctgacaagaagaccagacactaccttccaaacaagttcaagaagttcgttgtacacaatgtctctgagcttgagctgcttatgatgcacaacaggacgtactgtgctgagattgcccacgacgtctccacccgcaagcgcaaggagattgtcgagcgcgctgcgcagctggacatcgtggtcaccaacaagcttgccaggctccgcagccaggaggacgagtgaaatgttcagtagttgcagttgcagttgcgttagagcagtactgagattgaagatacctttccagtttccaccatttgtatgcttgtgttagacttgttctgtagacgaaattttgctatgagtgaatggcgaaccccatctagttttgacctgacatccataaagtgtgacagtgatt

SEQ ID NO: 44517 - protein, 133 aa, Panicum virgatum
  misc_feature: Ceres CLONE 2020968
  misc_feature (14)..(123): Pfam Name: Ribosomal_L32e Pfam Description: Ribosomal protein L32
MAVPLLTQKIVKKRVKQFKRPHLDRYKCLNPSWRRPKGIDSRVRRKFKGCTLMPNIGYGSDKKTRHYLPNKFKKFVVHNVSELELLMMHNRTYCAEIAHDVSTRKRKEIVERAAQLDIVVTNKLARLRSQEDE

SEQ ID NO: 44518 - DNA, 446 bp, Panicum virgatum
  misc_feature: Ceres CLONE 2020983
  misc_feature: Encodes the peptide sequence at SEQ ID NO. 44519
atgtgaagacaaagatgtcaggcttcttccagacaagcttctactttggttacaccctgatgttctgtcttggattgggaatactttgcggtgctgttggctacatgggctccactctatttgtgaggagaatctacagaaatatcaaatgcgactaaatttctgtaccttgctgatagaggctgttagcaaattatgtcttgccgcagtctggtgcggagtaatacttgattctgattaacttctgaaactacaccggaggtcgctctccctctgtttactcctcttttggcttatctatttcctccatggaactgccctgataaatgtatacctattagttggggaattagtctgaggtgaggactggaaagtacatgtaggttcttttttgtcaggcctcttttggggtcagttgtaggagttcattgatgaatattgctgct

SEQ ID NO: 44519 - protein, 51 aa, Panicum virgatum
  misc_feature: Ceres CLONE 2020983
  misc_feature: Functional homolog of the protein sequence given in SEQ ID NO 50395
  misc_feature: Useful for making plants with altered cell wall content and/or composition
VKTKMSGFFQTSFYFGYTLMFCLGLGILCGAVGYMGSTLFVRRIYRNIKCD

SEQ ID NO: 44520 - DNA, 1310 bp, Panicum virgatum
  misc_feature: Ceres CLONE 2021011
  misc_feature: Encodes the peptide sequence at SEQ ID NO. 44521
atagccatttgcaataccccctcaaactcaaagccagaccatgggcacctactccagcttccaagaagatacagggagcttagaatacaagaagcttaactttggcagcctgtacctttaccacacccagtttggccccaaggctaaccaagaagatataatcgcgcccaagaatgggttaggccggacaatcgccaacaactgggaagtgtatgacggggtcggccctggctccaagcttgttgcccgggcacagggcctgcatatagaggctggtaactggcacaactccttcagcctagtgtttgaggatggaaggttcaaggactcgagttttgagctgatgggaatacactctatgtgggagtgggctattgttggggggactggagatcttgctatggcaaccggtgtcgtaaaaaaggttacgtatgaaagtaacgctgacggaaatattttggagctcaccgtcagagcattctgccctgtgttcaacgagtcaacagttatggagagccctgccctaaagattgggccatgtggtggacctggagggtacgcacaagacatcgaggagggccccaagcgtctggaaagcatcacagttcgaagcggagttgtcgtcgactccattgagttttcttacattgaccatgctggccgaaggcgctctgcagggccatggggcggtcaccgtggcaatccacacacgatccatttggacgccgacgagttcgtcacggaaatggccggaacaatcgacaaattcgacataaacaacgacactgtcataacttcactcaaaatcgtgactaacctgcagacttttggtccatggggtgatgagaacggagctcctttcactatcccggtgcagagtggcagtggcattgtgggcttcttcgggcgcagtggggtgtacctcgacgccattggcgtttatgtgagccccatctgaacggtggcatgaagcttgatacgttccggtgctgggcatccaccagaatgcagccgtaatagtatgggcaacgacgtttgccaatgtattgttttgtccaataaataataggggtctttttcgttagcaatagacttggtgttaggtctgggttctagttttcagagtctgttgagtcttgttcatggtttttcagatctttgccactctcagagtctatccgtcagtctggagggaacgaccgtcagtcaaagtcgtgttcatggttttcaggtcaagctgggccgctatgtctttccgttgctctatttgtaacacttgtttatatgtatgaaataagagcagaaaacat

SEQ ID NO: 44521 - protein, 305 aa, Panicum virgatum
  misc_feature: Ceres CLONE 2021011
  misc_feature (172)..(304): Pfam Name: Jacalin Pfam Description: Jacalin-like lectin domain
  misc_feature (3)..(150): Pfam Name: Dirigent Pfam Description: Dirigent-like protein
MGTYSSFQEDTGSLEYKKLNFGSLYLYHTQFGPKANQEDIIAPKNGLGRTIANNWEVYDGVGPGSKLVARAQGLHIEAGNWHNSFSLVFEDGRFKDSSFELMGIHSMWEWAIVGGTGDLAMATGVVKKVTYESNADGNILELTVRAFCPVFNESTVMESPALKIGPCGGPGGYAQDIEEGPKRLESITVRSGVVVDSIEFSYIDHAGRRRSAGPWGGHRGNPHTIHLDADEFVTEMAGTIDKFDINNDTVITSLKIVTNLQTFGPWGDENGAPFTIPVQSGSGIVGFFGRSGVYLDAIGVYVSPI

SEQ ID NO: 44522 - DNA, 580 bp, Panicum virgatum
  misc_feature: Ceres CLONE 2021020
  misc_feature: Encodes the peptide sequence at SEQ ID NO. 44523
ggtctcgacctcacgatctcccctccttctagacgcttcctccctcctctctctgactctctcgtctcactacagtacaacttaaagaagtcagcacgatgactcgcggcgaccagcgggagcgggaccggcagagggcgcaggcgcggcggccggtggccaaggggcgcgacgacgggctcacgccggagcagcggcgggagcgggacgccaaggcgctgcaggagaaggcggccaggaaggcggcgcaggccgcgggaggcggcgacgccaagggcgcgggcaagaacgccggcaagtagccggtgtcgccggatccggcgttgtgttgtagcggctaggtggtggaatctctgttcatgttgcaagatctgtgtgctccgtggatctagaaaaaaaaatcggaagtgggatgcgatttcttcagtgttggcgcttgcttcgcccagaacatgcattttgcaaaagcacagcaataacggctgatcaggccctgtttggttctccactactatcttactatgatattttgaccattaattattagtattaaataaaagtaatttataaaattaacttt

SEQ ID NO: 44523 - protein, 67 aa, Panicum virgatum
  misc_feature: Ceres CLONE 2021020
  misc_feature (1)..(56): Pfam Name: 4F5 Pfam Description: 4F5 protein family
MTRGDQRERDRQRAQARRPVAKGRDDGLTPEQRRERDAKALQEKAARKAAQAAGGGDAKGAGKNAGK

SEQ ID NO: 44524 - DNA, 342 bp, Panicum virgatum
  misc_feature: Ceres CLONE 2021035
  misc_feature: Encodes the peptide sequence at SEQ ID NO. 44525
accattacagtacgcactccggctgacgcgccccgcactctctcacaaagctcaagcctttcgctcgctcgctcgctcgcggctacatctacaatggcgcgattccagctcgcggccctggccatggccatgctcttcgccgcggcggcggcgcaggccccggacgccaccccgacgcccgcgcccagggcgtcccccccgcaggcgacaactccgccgacggcggcgacggcgacagaccctcagcgcgccagggcgtcacagccaccagcgtcactctgcgacggtccctacagatacctactggaattgaccaccggaaacaacatcagcatgactccg

SEQ ID NO: 44525 - protein, 82 aa, Panicum virgatum
  misc_feature: Ceres CLONE 2021035
  misc_feature: Functional homolog of the protein sequence given in SEQ ID NO 50206
  misc_feature: Useful for making plants with altered carbohydrate content
MARFQLAALAMAMLFAAAAAQAPDATPTPAPRASPPQATTPPTAATATDPQRARASQPPASLCDGPYRYLLELTTGNNISMT

SEQ ID NO: 44526 - DNA, 1216 bp, Panicum virgatum
  misc_feature: Ceres CLONE 2021054
  misc_feature: Encodes the peptide sequence at SEQ ID NO. 44527
agggccgcatctccctcgcgcagctcgctccctgcgagcctgctgcctacttcagtccgcgctcgccggtggctcccctccggccgccgctccgtacgcccgccccgctcggcccgactcgcgcggctcccctccgtccggcagaggacgaagaggccggcgtgtaggagatcgaggacaatggccatcttctcatccgcccaccttgccctccgccggtcactaatggtggcgccacgagctgcatctcttggggagagtcttcggcaagcctcagatggacatttcacgggaaggctgctccatggccaactcctcctgcgctgcttcacctcggatgtatttggacccaacaagagtttccccccttctgggtctgaaattgcttcagaattgaaggcacatcagaatttcaacataatcaattctctccgtcaagatttaaattctaagacacaattcaacttcaataatgcagataatggtgggacagcgttaaagacagctggtggagagaaacctttcaaccttggggggcgctttccatttcctacttcgcgaatgtttaatgaacgtgaacaatattcacagaagaagagagattttatccatgtcttactgaagaaaaataagacctttgtgacggtgacagatgctagtggtaataaaaagactggagcctctgctggttgtttggaggacagaaaaggtcgatcgcgtctctctcgatatgctgctgaagcaactgccgaacatgtcgggcgttctgccaggaagatgggtttaaggtctgttgtcatgaaagtgaaaggggtttcttttttcaagaagaagaagaaagtgatcctgggctttagggaagggtttcgaggggaaagagttagagatcaatctcctatcatgcacatccatgatgtcacccaacttccgcataatggatgccgactcccaaaacaacgccgggtttagttctctgtgaactgaaattaaatttgagtaggaataagttgaatttttgaaggtggtctggaaggcttttgtaagctggcaggtgttccgtctcttggctctctgcaacttgttgggctatacagcctagtttctgtcctacttatgctattcagtgagttatggacaattcttttttatgggtggaatgctgatatataccataaatctgaactgttgtatgataaaacaataatgtgttttgccc

SEQ ID NO: 44527 - protein, 262 aa, Panicum virgatum
  misc_feature: Ceres CLONE 2021054
  misc_feature (143)..(261): Pfam Name: Ribosomal_S11 Pfam Description: Ribosomal protein S11
MAIFSSAHLALRRSLMVAPRAASLGESLRQASDGHFTGRLLHGQLLLRCFTSDVFGPNKSFPPSGSEIASELKAHQNFNIINSLRQDLNSKTQFNFNNADNGGTALKTAGGEKPFNLGGRFPFPTSRMFNEREQYSQKKRDFIHVLLKKNKTFVTVTDASGNKKTGASAGCLEDRKGRSRLSRYAAEATAEHVGRSARKMGLRSVVMKVKGVSFFKKKKKVILGFREGFRGERVRDQSPIMHIHDVTQLPHNGCRLPKQRRV

SEQ ID NO: 44528 - DNA, 703 bp, Panicum virgatum
  misc_feature: Ceres CLONE 2021055
  misc_feature: Encodes the peptide sequence at SEQ ID NO. 44529
atcgcatcgagccgctcgctgctcctagtccccccagccccccgaatccggcgacgccatggccggcacgtgcgcccacgtcgagttcctccgcgcgcagccggcctgggcgctggcgctggccaccgtgggcctcctcgtggccgtccgcgccgccgtccgcctcgcgttctgggtctacgccgcgttcctccgccccggcaagcccctccgccgccgctacggcgcctgggccgtcgtcaccggcgccaccgacggcatcggccgcgccatcgcgttccgcctcgccgccgccgggctcgggctcgtcctcgtcggccgcaacccggagaagctggccgccgtggccgccgagatcaaggccaagcaccccaaggtccccgaggtgcgcaccttcgtgctcgacttcgcctccgaggagctcgccgcgggcgtggaggcgctcaaggaggccatccggggcctcgacgtgggcgtgctcgtcaacaacgccgggctgtcctacccgtacgcgcgctacttccacgaggtggacgaggagctgatgcgcagcctgatccgggtcaacgtcgagggcgtcacgcgggtcacccacgccgtgctccccggcatggtcgagaggaagcgcggcgccatcgtcaacatcggctccggctccgcctccgtcgtgccatctgatccaatgtactccgtctacgccgcc

SEQ ID NO: 44529 - protein, 214 aa, Panicum virgatum
  misc_feature: Ceres CLONE 2021055
  misc_feature (57)..(203): Pfam Name: adh_short Pfam Description: short chain dehydrogenase
  misc_feature: SWISSPROT Homolog: EC 1.1.1.62 Estradiol 17-beta-dehydrogenase
MAGTCAHVEFLRAQPAWALALATVGLLVAVRAAVRLAFWVYAAFLRPGKPLRRRYGAWAVVTGATDGIGRAIAFRLAAAGLGLVLVGRNPEKLAAVAAEIKAKHPKVPEVRTFVLDFASEELAAGVEALKEAIRGLDVGVLVNNAGLSYPYARYFHEVDEELMRSLIRVNVEGVTRVTHAVLPGMVERKRGAIVNIGSGSASVVPSDPMYSVYA

SEQ ID NO: 44530 - DNA, 696 bp, Panicum virgatum
  misc_feature: Ceres CLONE 2021069
  misc_feature: Encodes the peptide sequence at SEQ ID NO. 44531
gtttgaaaaacaaatattatcgatgggatatcaagcttgtggtgcacttgaactatggaactacccaagtttcttgagggacctcataccacataatttggatggtaccaatcgatctgacagagtcgaccttgctgccctagaagtataccgagacagggagagaagtgtaccgaggtacaatgagttcaggaggagactatttctgattccaataaaaagctgggaggatctgacaagtgacaaggatgcaattgaagccataagagcaatatatggagatgacgtagagaaattggatcttcttgttggtcttatggcggagaaaaaaatcaatggatttgccataagtgaaacagcattcaacattttccttataatggcatcaaggaggcttgaagcagatcgattttttacaagcaatttcaatgagaaaacatacacgaagaaggggatgcaatggatcaaaacaactgaaggcctacgagatgtgatgaaccggcactaccctgaaatcactgccaagtggatgaagtcctctagtgctttctctgtgtgggatgcagactactagtgcaaaaataaaagggcccctgtcatatttattactgcatgcaatttggcaagttttatgaagtattatttgtttacagaactatggtatttgttcagtgttaatatagttaaatatgtcag

SEQ ID NO: 44531 - protein, 190 aa, Panicum virgatum
  misc_feature: Ceres CLONE 2021069
  misc_feature (2)..(186): Pfam Name: An_peroxidase Pfam Description: Animal haem peroxidase
  misc_feature: SWISSPROT Homolog: EC 1.6.3.1 NAD(P)H oxidase
FEKQILSMGYQACGALELWNYPSFLRDLIPHNLDGTNRSDRVDLAALEVYRDRERSVPRYNEFRRRLFLIPIKSWEDLTSDKDAIEAIRAIYGDDVEKLDLLVGLMAEKKINGFAISETAFNIFLIMASRRLEADRFFTSNFNEKTYTKKGMQWIKTTEGLRDVMNRHYPEITAKWMKSSSAFSVWDADY

SEQ ID NO: 44532 - DNA, 541 bp, Panicum virgatum
  misc_feature: Ceres CLONE 2021080
  misc_feature: Encodes the peptide sequence at SEQ ID NO. 44533
atcccaagcagcagctagcatcaatggccacctcctcctcctcctcctcgatgaccctcctgctgctggtcctgggcgcctccttggcagccagcgccagcgccgcgaccttcaccatcaccaacaactgcgggttcacggtgtggccggcggcgacgcccgtgggcgggggcacgcagctgaaccgaggcgggacgtggaccgtcaacgtgccggcgggcaccagctccggccgcgtgtgggcgcgcacgggctgctccttcaacggcaaccgcgggagctgccagacgggcgactgcggcggcgcgctcgcctgcacgctgtccggccagccgccgctgacgctggccgagttcaccatcggcggcagccaggacttctacgacatctcggtcatcgacggcttcaacgtcggcatggccttctcctgcagcaccggcgtccatatatatgtagctggatctgtgtacgtatactccgtatacggtataccatatggtatacaatacaatgagattatgttcttgtcatgttggaaagc

SEQ ID NO: 44533 - protein, 172 aa, Panicum virgatum
  misc_feature: Ceres CLONE 2021080
  misc_feature (34)..(169): Pfam Name: Thaumatin Pfam Description: Thaumatin family
MATSSSSSSMTLLLLVLGASLAASASAATFTITNNCGFTVWPAATPVGGGTQLNRGGTWTVNVPAGTSSGRVWARTGCSFNGNRGSCQTGDCGGALACTLSGQPPLTLAEFTIGGSQDFYDISVIDGFNVGMAFSCSTGVHIYVAGSVYVYSVYGIPYGIQYNEIMFLSCWK

SEQ ID NO: 44534 - DNA, 651 bp, Panicum virgatum
  misc_feature: Ceres CLONE 2021089
  misc_feature: Encodes the peptide sequence at SEQ ID NO. 44535
ttctcccaccacaccctttccttcgctcctgtagctcgcaccttgcaagatccaaaaagccggcctcccggcgtttgcttcctcgacacccaagatgacttcgtacgttgtgttccatggaaggaagacaggagtcttctctgattggcaatcttgtttagatcaagtttctggcttcagcaattgctcatacaggagctatccttcgcgtgaagaggctgtggtggacaacctgtcgtacttcggatatggagataactcgacaagcgcgtatgttggtcctgctgctggccacgacctacttccagcagcagctgatgatgcagatccagtacgtgcaccgccaaaagcacgcagctgcctggtcgccttggtctttgctcaattcttggttattgtcgtcatgtttgcctacatctttgcatagatgaagtcgtgcatcccaatggagaagtaggaaccacattttggccaaatcgttatggtggcccctgctatagttagaatgtgttgcatccatgtctagttgtacttctatgtagctactgcattgtccagacgtgtctagtttccttcatcgtgctgttccagcaagtattgaactctctgctttatgtactatcgtgtatgcacctacctaatttggggact

SEQ ID NO: 44535 - protein, 110 aa, Panicum virgatum
  misc_feature: Ceres CLONE 2021089
  misc_feature: SWISSPROT Homolog: EC 3.1.26.4 Ribonuclease H
MTSYVVFHGRKTGVFSDWQSCLDQVSGFSNCSYRSYPSREEAVVDNLSYFGYGDNSTSAYVGPAAGHDLLPAAADDADPVRAPPKARSCLVALVFAQFLVIVVMFAYIFA

SEQ ID NO: 44536 - DNA, 392 bp, Panicum virgatum
  misc_feature: Ceres CLONE 2021090
  misc_feature: Encodes the peptide sequence at SEQ ID NO. 44537
tgagaaattcgagataccagcaaagatcttgttgctgcccgaaccatggactccagagtctgggctagtgacagcagcacttaaactgaggagggaacagataaagagcaaattcaaagatgatttgaacaaactccatcactgaagcagcgacagaaggctgtttggacctatgttttctgaaggtactggaagcagcctggaacagtagaacctactgacctctgaaaggaataagcgagctttgtgtacctctgcttgctaatacatagcttgttcttgtgtcagcagagaatgctcaattttatgtctgttcacgactgtaaatgtagtgtttgtttctccttgtaatacaaactacattccaaaccgtctctccagaggtttaaacg

SEQ ID NO: 44537 - protein, 47 aa, Panicum virgatum
  misc_feature: Ceres CLONE 2021090
  misc_feature: SWISSPROT Homolog: EC 6.2.1.3 Long-chain-fatty-acid--CoA ligase
EKFEIPAKILLLPEPWTPESGLVTAALKLRREQIKSKFKDDLNKLHH

SEQ ID NO: 44538 - DNA, 692 bp, Panicum virgatum
  misc_feature: Ceres CLONE 2021095
  misc_feature: Encodes the peptide sequence at SEQ ID NO. 44539
cctcctacctcgatccctcctccgatcctctcgtcaattccatccctcggctatctacaagctaaggtaacacgtaccatcgcggtcgcggcatcgccgccatgaagcttagcgtgccgttcttcggctcctcctccggcaagaaggtgaccaataagaggacaagatcaaaggacgccaagagcggctccttcggctccaccacgtcgtcctcgtccgacgagggcgcgtccgtcacgacgccgcgcaccgtcctgccgccgccgccggcgtccgcgtccgcgtcgggggccgagagaggaaacccggcggcggcgcccctgacgagggaggacctggagaccgcccttaggcgggtggtctcgagcgaggaggagctggccgagatgctcgccgaggcggcggggtccggggtcctgctggaggagatcgcggccgaggcccaggcggcggcggcggacgaaggcgagctcagggacacgttcgcggtcttcgatgccgacggggacggcaggatctcggccgaggagctcctcgccgtgctcgcctcgctcggcgacgaccgctgctccgtcgaggactgccgccgcatgatcggcggcgtcgacgtcgacggcgacggcttcgtgtgcttcaatgagttcgcgcgcatgatgacgcaaggggtttgatatgtcgggggcgtgtctact

SEQ ID NO: 44539 - protein, 189 aa, Panicum virgatum
  misc_feature: Ceres CLONE 2021095
  misc_feature (123)..(151): Pfam Name: efhand Pfam Description: EF hand
  misc_feature (160)..(188): Pfam Name: efhand Pfam Description: EF hand
MKLSVPFFGSSSGKKVTNKRTRSKDAKSGSFGSTTSSSSDEGASVTTPRTVLPPPPASASASGAERGNPAAAPLTREDLETALRRVVSSEEELAEMLAEAAGSGVLLEEIAAEAQAAAADEGELRDTFAVFDADGDGRISAEELLAVLASLGDDRCSVEDCRRMIGGVDVDGDGFVCFNEFARMMTQGV

SEQ ID NO: 44540 - DNA, 676 bp, Panicum virgatum
  misc_feature: Ceres CLONE 2021104
  misc_feature: Encodes the peptide sequence at SEQ ID NO. 44541
ctttcgaggacacctcacagcgacgccgcctcccgccgccgaactcgcctacggctccgcccgcgccggcagcgccttcgcctcgtcccctctctgcttcagcaccaggcaagagcaaccatggagcatgggtcgctggaggattcgagtgcatcgacgttctccatcatggaggaggaccacaccctcgccaactccgtcagattcgttctcaaccaggacccaagggtggcattttgtggatacagcatccctcatccttctgaaaacaaagttaacataaggcttcagactacaggagatccagccaaggatgttctgaaagattcgttgcaggacctgatggtaatgtgccagcatataagggggacgtttgacactgcagtggctgatttccgggggaacaaaccagcagacgccatggacattgatttgaacaaaaagtagaaggttcttgatgattgttagccaggtggcagaaatgcacagatgtttaatgtgcaactgaattataaactactctagttatatgggatgtagtccttaaacccaaagtgtgaaatgtcattggcattagggttcttgacagtgtgacttcagatttctttgccaatatatggcacccgatcttgtttggagaaaaaattaatgcaatgaccataatttctatttgtgc

SEQ ID NO: 44541 - protein, 108 aa, Panicum virgatum
  misc_feature: Ceres CLONE 2021104
  misc_feature (8)..(83): Pfam Name: RNA_pol_L Pfam Description: RNA polymerase Rpb3/Rpb11 dimerisation domain
  misc_feature: SWISSPROT Homolog: EC 2.7.7.6 DNA-directed RNA polymerase
MEHGSLEDSSASTFSIMEEDHTLANSVRFVLNQDPRVAFCGYSIPHPSENKVNIRLQTTGDPAKDVLKDSLQDLMVMCQHIRGTFDTAVADFRGNKPADAMDIDLNKK

SEQ ID NO: 44542 - DNA, 368 bp, Panicum virgatum
  misc_feature: Ceres CLONE 2021106
  misc_feature: Encodes the peptide sequence at SEQ ID NO. 44543
ctcttattatccttattcataatggctaagcgcacaaagaaagtcggaatcaccggtaaatacggtacccgttatggtgcctctctcagaaagaccgtaaagaagatggaaatcactcaacactccacctacacctgtaccttctgtggtaaggatgctgtcaagcgtactgccgttggtatctggaagtgcaagggttgtaagaagaccatggccggtggtgcttacactgtctccactactgctgctgccaccgttcgttccactgtccgtcgtctccgtgaattggccgagatctaaattaactttacatctttactattactttgcaacaaacgacagtattatttgaataaatatattggacg

SEQ ID NO: 44543 - protein, 92 aa, Panicum virgatum
  misc_feature: Ceres CLONE 2021106
  misc_feature (2)..(91): Pfam Name: Ribosomal_L37ae Pfam Description: Ribosomal L37ae protein family
  misc_feature: Functional homolog of the protein sequence given in SEQ ID NO 50139
  misc_feature: Useful for making plants with modulated cold sensitivity
MAKRTKKVGITGKYGTRYGASLRKTVKKMEITQHSTYTCTFCGKDAVKRTAVGIWKCKGCKKTMAGGAYTVSTTAAATVRSTVRRLRELAEI

SEQ ID NO: 44544 - DNA, 531 bp, Panicum virgatum
  misc_feature: Ceres CLONE 2021112
  misc_feature: Encodes the peptide sequence at SEQ ID NO. 44545
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggagctcgacggccgcaacatcaccgtcaaccaggctcagtcccgcggcggcggcggcggcggcggcggctacggcggcggtcgtcagggtggctacggcggcggcggcggcggcggcggctacggaggcggtggcggctacggtggcggcggtcgccgcgagggcggctaccgtggcggcggtcatcgcgaggtctgctacggtgatggtggctacggcatccgcggtgactccggt

SEQ ID NO: 44545 - protein, 150 aa, Panicum virgatum
  misc_feature: Ceres CLONE 2021112
  misc_feature (10)..(81): Pfam Name: RRM_1 Pfam Description: RNA recognition motif. (a.k.a. RRM, RBD, or RNP domain)
  misc_feature (48)..(138): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
MAAADVEYRCFVGGLAWATDNASLQQAFASYGDVLDSKVITDRETGRSRGFGFVTFSSEQSMLDAIEAMNGKELDGRNITVNQAQSRGGGGGGGGYGGGRQGGYGGGGGGGGYGGGGGYGGGGRREGGYRGGGHREVCYGDGGYGIRGDS

SEQ ID NO: 44546 - DNA, 737 bp, Panicum virgatum
  misc_feature: Ceres CLONE 2021120
  misc_feature: Encodes the peptide sequence at SEQ ID NO. 44547
aaaaaccctagccccgagcagccgcattggccagcacttcacgtcccctgcctccctctcgtcacctggcggcggcggcggcagcggcaggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgaccctgactggtactacaccagggctgcctcaattgcaaggaagatctacctcaggcaaggcattggtgtaggtggattccagaagatctatggtggccgccagaggaatggctcccgcccaccacacttctgcaagagcagtggtgccatttcacgtaacatcctgcagcagttgcagaagatgggcatcattgatgttgatcccaagggtgggcggctcatcacctcccagggaaggcgtgatcttgaccaagtggctggaagagttgctgttgacgcttaagcatctctgttttctgttttgtccgtgttcgatggtatggctacactttatttgcagttttgaactaggacttgtcctgccttggttcagagaatttaagatttgatgcatctagttatggaactgcactatgtttacctcaagtacctaatgcactattggaattcattctggaatgaaagtaagggattgtgcttgtgatgtgcag

SEQ ID NO: 44547 - protein, 145 aa, Panicum virgatum; identical to SEQ ID NO: 12938
  misc_feature: Ceres CLONE 2021120
  misc_feature (7)..(145): Pfam Name: Ribosomal_S19e Pfam Description: Ribosomal protein S19e

SEQ ID NO: 44548 - DNA, 716 bp, Panicum virgatum
  misc_feature: Ceres CLONE 2021134
  misc_feature: Encodes the peptide sequence at SEQ ID NO. 44549
atccacatttccaccccgccgccgccgcccctgtcccgctcgtcctccagaaatggcgacgtcgccgcgcctcctcctcctcgtggtgctactcctcttcgcgtcggcggcggccccctccgccgcggtaaggttagtcgtcggtggcggcaagcgctgggcacccaacgtcaactacaccgactgggcggatgggcacgagttccacgtcggcgactggctcgaattcgactacgagaaggacaggtacgacgtggtccaggtgaacgagacggcgtacgcgaagtgcgacgggggcagcccgatcctcagctacagccgcggccgcagcttcgtcttccgcctcaacaccacgggccggctctacttcatctgcagccgcggctactgctggaacggcatgagggtgtctgtgctcgtccagcccgcgccgccgccggcggcggccatggcgccgtcgtcccacccccgcgccgcgaccggggtctggcggtgggcggctctcactgtcttgataggcttggcggtgccttttcgggtgtgaacggaaaggcgcaagcactggccgttctgcgcggtgccttcctgactgccatggtctacagatgtttgcctaccgtgctatccattttttgcagcttaacgtagtcgtgtttggaaggaaataaataatagagagagaaaatgagccatggtgaactgtcaaggtggtttag

SEQ ID NO: 44549 - protein, 163 aa, Panicum virgatum
  misc_feature: Ceres CLONE 2021134
  misc_feature (36)..(117): Pfam Name: Cu_bind_like Pfam Description: Plastocyanin-like domain
MATSPRLLLLVVLLLFASAAAPSAAVRLVVGGGKRWAPNVNYTDWADGHEFHVGDWLEFDYEKDRYDVVQVNETAYAKCDGGSPILSYSRGRSFVFRLNTTGRLYFICSRGYCWNGMRVSVLVQPAPPPAAAMAPSSHPRAATGVWRWAALTVLIGLAVPFRV

SEQ ID NO: 44550 - DNA, 639 bp, Panicum virgatum
  misc_feature: Ceres CLONE 2021178
  misc_feature: Encodes the peptide sequence at SEQ ID NO. 44551
gaagccgccgcgagaggagagggagaggaggcgaggagggatggggcggaagcgaagccaggctcagccgcgagggtaaggtcagcgtcaccaacaaccccggcgagacggccaccatgaacgtcccccgcagcaggcgccaggacctcgacctcgccgttgacgacttcgacgaggaggagatcgaccccgagctgcgctactccttccagcggaacagcaggtttttgaagagagtttttagtgtggatacacttgtcaagcctcttccccctgtaatggcatacagtgtatctcgtaatgtaaactttttcttccggatcttcacacagttctgggatgaagaaggaattgccaacgcacagaagtcccttggactggggaatgatgatggttcccgccgaatgcgctgattgtagtcaaagtttctgtactgagctcagaactctttgtcctaggcactggagatctgttatatatgcttcaaaagacagctgtggcgtttcttaagtttggattgtaattctgtttattttagtgtttctttcatgtatttctgcttgtaccatatattcaaattcaacatcgtgtactcacagtctgttcccttttctatttgatctcgaacaaaattgggtg

SEQ ID NO: 44551 - protein, 136 aa, Panicum virgatum
  misc_feature: Ceres CLONE 2021178
  misc_feature: Functional homolog of the protein sequence given in SEQ ID NO 50121
  misc_feature: Useful for making plants with modulated nitrogen use efficiency
SRRERRGRGGEEGWGGSEARLSREGKVSVTNNPGETATMNVPRSRRQDLDLAVDDFDEEEIDPELRYSFQRNSRFLKRVFSVDTLVKPLPPVMAYSVSRNVNFFFRIFTQFWDEEGIANAQKSLGLGNDDGSRRMR

SEQ ID NO: 44552 - DNA, 489 bp, Panicum virgatum
  misc_feature: Ceres CLONE 2021181
  misc_feature: Encodes the peptide sequence at SEQ ID NO. 44553
aatcttcagtaacaccaagactcgccatggctgtccaccacattcacatccaccaccaccaccctcaccaccaccacgcccaagagtacgtgatcatctcgcagcatgatcctggtcaggtgctcgacatccaaggtggatccaaggaggcaggagcccagctgatcatctggccccgtcacaacggtcccaaccagcgctggcgctttgaggctgacggtaccatccgcagcgttggctcaggccttgtgcttgatgtcaagggtggtgctgctgagggtcgcgagatcattcagtggggacaccacggtggtcccaaccagcagtggaccatccaccccgatggatcaatccgctgtggtcacctcgccattgatatcaagggtggcagcaaggcccacggtacccatctgattgcctggggtcaccatggtggcagcaaccagaagtggcgcattgagcccgttcactaaatgtgctcgctctttg

SEQ ID NO: 44553 - protein, 148 aa, Panicum virgatum
  misc_feature: Ceres CLONE 2021181
  misc_feature (18)..(142): Pfam Name: Ricin_B_lectin Pfam Description: Ricin-type beta-trefoil lectin domain
  misc_feature: SWISSPROT Homolog: EC 3.2.1.55 Alpha-N-arabinofuranosidase
MAVHHIHIHHHHPHHHHAQEYVIISQHDPGQVLDIQGGSKEAGAQLIIWPRHNGPNQRWRFEADGTIRSVGSGLVLDVKGGAAEGREIIQWGHHGGPNQQWTIHPDGSIRCGHLAIDIKGGSKAHGTHLIAWGHHGGSNQKWRIEPVH

SEQ ID NO: 44554 - DNA, 584 bp, Panicum virgatum
  misc_feature: Ceres CLONE 2021197
  misc_feature: Encodes the peptide sequence at SEQ ID NO. 44555
tgccatggtggccctgctgaaatcattgtggatggggtgtctggtttgcacattgatccttaccacagtgacaaagctgcagatatcttggtcaacttctttgataagtgcaaggaggatccaagctactgggacaaaatttcagcaggaggcctgcagagaatttatgataaatacacctggaagctgtactccgagaggctgatgaccctgactggtgtgtacggattctggaagtacgtgagcaacctggagaggcgtgagactcgtcgctaccttgagatgttctatgctctcaaataccgtagcctggcaagtgctgttccattgtccttcgattagtgcgtgaaagaacatcaagctggagagccatcagctgcattacaatttttaccacaattcgcattgttagtcatgtgtttgagtaatgtgtacttgattccaagcacttggtactttttcgcgaggttttgggcggcgctggctggttcctgctctaggatactagctgcacattttcgcttccaataaacacctgctcatgtcacctgtccttcagaatccaatgcaatgttttgttgccc

SEQ ID NO: 44555 - protein, 113 aa, Panicum virgatum
  misc_feature: Ceres CLONE 2021197
  misc_feature: SWISSPROT Homolog: EC 2.4.1.13 Sucrose synthase
  misc_feature: Functional homolog of the protein sequence given in SEQ ID NO 51467
  misc_feature: Useful for making plants with altered carbohydrate content
  misc_feature: Functional homolog of the protein sequence given in SEQ ID NO 50271
  misc_feature: Useful for making plants with altered cell wall content and/or composition
  misc_feature: The sequence is a functional homolog of SEQ ID NO 2 in US patent 7091398
  misc_feature: The sequence is a functional homolog of SEQ ID NO 12 in US patent 7091398
CHGGPAEIIVDGVSGLHIDPYHSDKAADILVNFFDKCKEDPSYWDKISAGGLQRIYDKYTWKLYSERLMTLTGVYGFWKYVSNLERRETRRYLEMFYALKYRSLASAVPLSFD

SEQ ID NO: 44556 - DNA, 745 bp, Panicum virgatum
  misc_feature: Ceres CLONE 2021202
  misc_feature: Encodes the peptide sequence at SEQ ID NO. 44557
ctctttgttgctgtgcacaatcactacaaggggatatacaagccaattcggagactcgccgctcgacctcgccgctgtcgccgactccgggttcttcgacgggcccgtgcttccaccaggagacgctcaacatgttctcggggatgggccggtcggtgtggaaggaggcatgcgccacgctccagaatattctatcagctgctgagccagtcttgcctgacaacaaggccctcaggaacaagtgtttcgttccaatgagtgatatagagatggtccagccaatcattgttggaggctacacagacttcttttgttccgtgcgtgatggcaggaattgcgggtttatcttctgtcggtttgttcacttctctgaaagatcaagccactgaaaagcagttaattgcactgaaaaatatgaaacagatgggttctcttggagcacttatggaggaagttgtcatgtttactgtgtatactaaacataaaaaaaagatttttcttctgatactataaaataactctgagcgtctggaaatacagtactcaaaacgattacagggtggatgagtgcttcaacatatttcagaggaactactcaattgttggatcattcggacaaccttgtgaaaagaaagacacttgggatgttgtctgaaactgccagaggaaacggtttggttcagaacaagcaaattaaaagcacgaaaactgaagcatagctctgttataagtgtgatcaaatggg

SEQ ID NO: 44557 - protein, 128 aa, Panicum virgatum
  misc_feature: Ceres CLONE 2021202
  misc_feature: SWISSPROT Homolog: EC 3.7.1.2 Fumarylacetoacetase
LCCCAQSLQGDIQANSETRRSTSPLSPTPGSSTGPCFHQETLNMFSGMGRSVWKEACATLQNILSAAEPVLPDNKALRNKCFVPMSDIEMVQPIIVGGYTDFFCSVRDGRNCGFIFCRFVHFSERSSH

SEQ ID NO: 44558 - DNA, 702 bp, Panicum virgatum
  misc_feature: Ceres CLONE 2021224
  misc_feature: Encodes the peptide sequence at SEQ ID NO. 44559
agcgatggacgtcgacgccggcggcggcggggaggcgcgcccgtcggagaaggagctcttcagcgccgcggagtcctgcgacgcctccgcgctcgcctcccttacccccgcctccctctccctccgcaacgaggacggccgctccctcgtccacgtcggcgccgccgccgggcacccccaggtggtgctcgcgctcctggaagcagctggtgccgctgcggcgagcgtcctgaacgccaaggacgaggaggggtgggtgccgatccactccgcggccagcaccggcaacgcccagatcgtcgaaatcctgcttgagcgaggtgctgatgttgacctgactactgatggtggtcgaactgctcttcattatgctgcaagcaaagggaggcttaacatagctgagaaactaatatcacatggtgcaaaagtcaacaagaaagacaagtttggctgcacgcccttgcatagagctgccagcactggaaatgctgaactgtgcgaattcctcattgaggaaggtgccgaggttgatgctgttgacaggataggacaaacgcctctgatgcatgctgttatatgtgagaaccaaggggttgcttttctgctaattagacatggtgctgatgttgatgttgaggataaggaaggctacactgtccttggtcgagcatctaacagcttgagaccctcacttattgatgc

SEQ ID NO: 44559 - protein, 232 aa, Panicum virgatum
  misc_feature: Ceres CLONE 2021224
  misc_feature (115)..(147): Pfam Name: Ank Pfam Description: Ankyrin repeat
  misc_feature (148)..(180): Pfam Name: Ank Pfam Description: Ankyrin repeat
  misc_feature (82)..(114): Pfam Name: Ank Pfam Description: Ankyrin repeat
  misc_feature (181)..(213): Pfam Name: Ank Pfam Description: Ankyrin repeat
  misc_feature: SWISSPROT Homolog: EC 2.4.2.30 NAD(+) ADP-ribosyltransferase
  misc_feature: The sequence is a functional homolog of SEQ ID NO 184 in the 10/225,068 US patent application
  misc_feature: The sequence is a functional homolog of SEQ ID NO 382 in the 10/374,780 US patent application
  misc_feature: The sequence is a functional homolog of SEQ ID NO 972 in the 10/225,066 US patent application
  misc_feature: The sequence is a functional homolog of SEQ ID NO 1841 in the 10/374,780 US patent application
MDVDAGGGGEARPSEKELFSAAESCDASALASLTPASLSLRNEDGRSLVHVGAAAGHPQVVLALLEAAGAAAASVLNAKDEEGWVPIHSAASTGNAQIVEILLERGADVDLTTDGGRTALHYAASKGRLNIAEKLISHGAKVNKKDKFGCTPLHRAASTGNAELCEFLIEEGAEVDAVDRIGQTPLMHAVICENQGVAFLLIRHGADVDVEDKEGYTVLGRASNSLRPSLID

SEQ ID NO: 44560 - DNA, 686 bp, Panicum virgatum
  misc_feature: Ceres CLONE 2021225
  misc_feature: Encodes the peptide sequence at SEQ ID NO. 44561
aagcgtggtgactatgtgcctggattgaaggttgatggaatggatgttcttgctgtgaagcaagcctgcaaattcgcgaaggagcatgctgttgccaatggtccaattgttcttgagatggatacctacaggtaccatggccactctatgtcagatccaggaagcacttaccgcagcagggatgagatttcaggtgtaagacaggagcgtgacccaattgagagggtaagaaagttgatctttgctcacgatctggcaactcctgctgagctcaaggatatggagaaagaaatcaggaaacaagttgatgacgccattgctaaagcaaaggaaagttctatgcccgacgcttctgagctcttcacaaatgtttataagaagggctttggtgtggagtcatttgggccagacaggaaggagatgagagcttcccttccgtaggctggcaacaagatgggggctttagccgtaatatgatatgatagccgcgaaataaatattgacgaagaagacccctcaggcattgctcgaattttttgttgggaaaaggaacctgtatagagatgcgttgtcaggaggatcagcttctttgttttgcttcattttttttcattttctacaattcagtctaactgctgctggctggcttcttattgaagctagaaatttggcccgcaaactggtcc

SEQ ID NO: 44561 - protein, 146 aa, Panicum virgatum
  misc_feature: Ceres CLONE 2021225
  misc_feature (1)..(118): Pfam Name: E1_dh Pfam Description: Dehydrogenase E1 component
  misc_feature: SWISSPROT Homolog: EC 1.2.4.1 Pyruvate dehydrogenase (acetyl-transferring)
KRGDYVPGLKVDGMDVLAVKQACKFAKEHAVANGPIVLEMDTYRYHGHSMSDPGSTYRSRDEISGVRQERDPIERVRKLIFAHDLATPAELKDMEKEIRKQVDDAIAKAKESSMPDASELFTNVYKKGFGVESFGPDRKEMRASLP

SEQ ID NO: 44562 - DNA, 711 bp, Panicum virgatum
  misc_feature: Ceres CLONE 2021237
  misc_feature: Encodes the peptide sequence at SEQ ID NO. 44563
gtggactcccatccccacgccagacctcacctctccccgcgacgaatcggcggcggcggcggcgagcgctagagacccagctagagacccgggatggccggcatgggcgagatgccgatgaggccggcgcggccgggcccgccgatgcagcaccgggggccgccgccgatggcgcgcctccgccccgaaccgatagaccgcgagaagacctgtcctctcttgctcagggtcttcacaagggttgctggccatcaccaaaatgaagagtttgcggtgagagggaaggagccaaaagatgaagttcagatttacacatggaaggatgccacgctccgtgagctcacagaccttgtaaaagaggttgctcttccagcaaggaaaagaaatgctaggctttcttttgcttttgtgtacccagacaagaatggccgttttgttgtcagacaggtgggttcgacctttgcatatggtcatggaagaggggatgatgccaaaactctggcagagctcggcttccagattggtgattacttgagcgttgcaatcatgtagacgatgcccatgctgaactcgatcactgcaccggactggatgtaactgttgtgacgtcaaaagccccacgggggcaagggatgaatctgtgttagcattagggaattggaaccaaaattgtctgtaatactggtacgatcaaagttcactaaacattct

SEQ ID NO: 44563 - protein, 152 aa, Panicum virgatum; identical to SEQ ID NO: 12928
  misc_feature: Ceres CLONE 2021237
  misc_feature (30)..(151): Pfam Name: SAP18 Pfam Description: Sin3 associated polypeptide p18 (SAP18)

SEQ ID NO: 44564 - DNA, 848 bp, Panicum virgatum
  misc_feature: Ceres CLONE 2021247
  misc_feature: Encodes the peptide sequence at SEQ ID NO. 44565
gcggacgacgcactaataagcagcaatggccgccctccgccacctcgccgtcggccccggccccacctaccaccgccaccacggcttcgctgccgctgcagccacatcctccctccagctccgccgcctgccctcccgcccgctccgctcccgcttcagccgggtctatgcgctctccagcaatgacatcagggtcggcaccaacatcgaggtcgacggcgcgccatggaaggttctagagtttctccacgtcaagcctgggaaaggtgccgcttttgtcaggacaaaattgcgcaattatgtcaccggcaacacagttgagaaaacctttcgagctggaagtacgctacaggaaccatccctttcaaaggagaacaagcaatttacatacaaggatggctcccagttcgtgttcatggatctgacgacatttgaagaaagtcggttaaatgaggcagatgttggtgacaagcaaaaatggttgaaagagggaatggactgcaatttgctgtactggaatggaaagatcatcgatttcgagcttccaatcactgtgaggctgactgtaactgatactgaccctggggcaagtgatagtgcacaaggaggaacaaagcccgcaaccctggagaccggagctgtggtcaccgtgccctcttttgtgaatgtaggcgacgatattctagttgattcaagaactggccagtatatgaaccgagcatagaggaccgaagaggatgttagatttgaagagaacactacatttttgttcggacattttagtcccattcacctgtacgaatgctctgcatcttttgacccatgaaactacatatttttgcattcag

SEQ ID NO: 44565 - protein, 232 aa, Panicum virgatum
  misc_feature: Ceres CLONE 2021247
  misc_feature (51)..(108): Pfam Name: EFP_N Pfam Description: Elongation factor P (EF-P) KOW-like domain
  misc_feature (177)..(231): Pfam Name: Elong-fact-P_C Pfam Description: Elongation factor P, C-terminal
  misc_feature (115)..(169): Pfam Name: EFP Pfam Description: Elongation factor P (EF-P) OB domain
MAALRHLAVGPGPTYHRHHGFAAAAATSSLQLRRLPSRPLRSRFSRVYALSSNDIRVGTNIEVDGAPWKVLEFLHVKPGKGAAFVRTKLRNYVTGNTVEKTFRAGSTLQEPSLSKENKQFTYKDGSQFVFMDLTTFEESRLNEADVGDKQKWLKEGMDCNLLYWNGKIIDFELPITVRLTVTDTDPGASDSAQGGTKPATLETGAVVTVPSFVNVGDDILVDSRTGQYMNRA

SEQ ID NO: 44566 - DNA, 685 bp, Panicum virgatum
  misc_feature: Ceres CLONE 2021250
  misc_feature: Encodes the peptide sequence at SEQ ID NO. 44567
attcgtgcagtggagcgacctccggtggtggtgctagcgaccacgctgtagtggctggcgccatccgtctcgtcgcgaggatgttcaagcctcctcccgaccggaacgcggcagcgatggccgaggcgcacggcgagcgccccgtggggatgctgggcgacgtccgggacgcgccggcggggcgcgagaacgacctcgaggccgtcgagctcgcgcgcttcgccgtcgctgagcacaacagcaagaccaacgcgatgctggagttcgagaggctcgtgaaggtgaggcagcaggtggtggccgggaccatgcaccacttcaccggcgaggtcaaggaggccggcggcgccaagaagctgaacaaggccaaggtgtgggagaatgtctgggagaacttcaagcagctccagagcttctagcccgtcggggacgccgcggctgcctgaggcaaacgtaccatctttccagtgtgatgtgttttccccctgaaggctcaagcttgtcgctggaggctggagcagaacaatgaaaggatttagctaccgggcatggatacaccacctcactggaggagtttatatgatgaataaaccagcttcttaccagatgtatcatctcatatgttttttagtcctgtaatggagtgcgctgtgcaacaagcaatatggaaagtcaattgcatttt

SEQ ID NO: 44567 - protein, 138 aa, Panicum virgatum
  misc_feature: Ceres CLONE 2021250
  misc_feature (52)..(138): Pfam Name: Cystatin Pfam Description: Cystatin domain
SCSGATSGGGASDHAVVAGAIRLVARMFKPPPDRNAAAMAEAHGERPVGMLGDVRDAPAGRENDLEAVELARFAVAEHNSKTNAMLEFERLVKVRQQVVAGTMHHFTGEVKEAGGAKKLNKAKVWENVWENFKQLQSF

SEQ ID NO: 44568 - DNA, 598 bp, Panicum virgatum
  misc_feature: Ceres CLONE 2021265
  misc_feature: Encodes the peptide sequence at SEQ ID NO. 44569
ataattttgagactattggatgatctccagacatatgagcgagagaaaatgacgcctcatgttgcttcaaccatcaaaagctacatgaaagagcacagtgtctcaatggaaattgcacgcaagaagatagcggaactgaaagaggatacctggaaagattttaaccgtgagtggttgaaccctgataattcagtgcctaggcagctactggagaacatattcaacttgaccaggacgatggagttcatgtacaacctggatgataatttcaccaactgtcaaaacctcaaggataccatccacttgttgtttgtggagccctttgcaatctccatctagtaaagacaattccaacaaataaacgatgacatccaatgtcaagaaaaggaagcccatatcatatccacctgcatattccgtgtgtacaagtttgtgattttagccattgctcatttggtgtattgtgtactgtatttggaactattgccttggtttcagtcactgtgatgtttttctatttctatatattaaagactcggcaagagtggtaagccaggcagtccaagtcaagcaatattattttttaccacttgatctc

SEQ ID NO: 44569 - protein, 112 aa, Panicum virgatum
  misc_feature: Ceres CLONE 2021265
  misc_feature: SWISSPROT Homolog: EC 4.2.3.24 Amorpha-4,11-diene synthase
IILRLLDDLQTYEREKMTPHVASTIKSYMKEHSVSMEIARKKIAELKEDTWKDFNREWLNPDNSVPRQLLENIFNLTRTMEFMYNLDDNFTNCQNLKDTIHLLFVEPFAISI

SEQ ID NO: 44570 - DNA, 787 bp, Panicum virgatum
  misc_feature: Ceres CLONE 2021273
  misc_feature: Encodes the peptide sequence at SEQ ID NO. 44571
acttccctgaacaactcgccgccgtctaaatctgcgcaaaccagggccaccccctccgccgacgccgcctcggcggttcgtccttctgtggtatccgccgccgaggatacgctcgcggccgccgagtccgtcggggaccacctatcccagctgctcgctgaggcggcgaaggaccccgacgccgtcgccgagctccctcccctgcttcgggcgtgcgccttcctagccgtggcgcaggccgccacctccctattagcggtgcggctaaggtgttcaggaattgaccccgacgagcaccccatcagaaaggagtttgagaggttaagcctgtgtcaagagaagttagatcgatttgaggattgggacaaggcaccacttcgccctactactacactgaatactcaagcagcagcaaggttcattggacactcactttcccacctgacatctgatcagaagagaagcatgcaggcaattagtagaggagaaagaaggggttggtctgggcagaagagaaagcctgagcctttacctgaaaagaagtctgtccgtgctgctgcggaagagttccttgcaaaggctgcgcaggaacttattgggaatagtgatagcagggtgaagggtcctgttatactcatttctgatgaagatgaggactagatcagtatgttagttttgttaagatatcaagaatttattgctgcttctgtagttttgttcttactgtatgagtaatgctacacctacaaaatgttaaaagtaatactcacatgctaatttgtacagc

SEQ ID NO: 44571 - protein, 219 aa, Panicum virgatum
  misc_feature: Ceres CLONE 2021273
  misc_feature (33)..(114): Pfam Name: Sas10_Utp3 Pfam Description: Sas10/Utp3 family
TSLNNSPPSKSAQTRATPSADAASAVRPSVVSAAEDTLAAAESVGDHLSQLLAEAAKDPDAVAELPPLLRACAFLAVAQAATSLLAVRLRCSGIDPDEHPIRKEFERLSLCQEKLDRFEDWDKAPLRPTTTLNTQAAARFIGHSLSHLTSDQKRSMQAISRGERRGWSGQKRKPEPLPEKKSVRAAAEEFLAKAAQELIGNSDSRVKGPVILISDEDED

SEQ ID NO: 44572 - DNA, 523 bp, Panicum virgatum
  misc_feature: Ceres CLONE 2021294
  misc_feature: Encodes the peptide sequence at SEQ ID NO. 44573
acctcaaacctcacaccgaacctgtcacgccgcccctccagcttcccccgctcgccgcgaagcccggggccggccgcggcaactgcggtgaggaccgcagatggccacgcaacagcgcacgattcttgacctgcattgccgtggcgctcctctcgccgccgagtgaggaggcggggcactcgatccggctgcgggcggggcgcggcggcgaggaggcgccgttgatggtgaacgccacgcgggtggagaagatacaccggcagttcgagtagtgggtgcagaacaagggcggcctccggctgaggatgttccagcacgggctcatccacaccttcccgaacaactccctcgtcaacaacaacaactcggaggtcgacgacttcaacaccatccacgacgccaacgactcgctccaggacatcaacctcatccccgtcgacatgaagggcaacacctgcacctacacggagaaggagaacggctccacgatgcgcgagttcatcatcctgaagggcgccagcct

SEQ ID NO: 44573 - protein, 72 aa, Panicum virgatum
  misc_feature: Ceres CLONE 2021294
  misc_feature: Functional homolog of the protein sequence given in SEQ ID NO 51268
  misc_feature: Useful for making plants with altered carbohydrate content
MFQHGLIHTFPNNSLVNNNNSEVDDFNTIHDANDSLQDINLIPVDMKGNTCTYTEKENGSTMREFIILKGAS

SEQ ID NO: 44574 - DNA, 689 bp, Panicum virgatum
  misc_feature: Ceres CLONE 2021305
  misc_feature: Encodes the peptide sequence at SEQ ID NO. 44575
acttgtcacccgcatcgcgccgctccagctcgcgtcatcagctagctagctagccatggcgtcctccgaggccgctgcgccgcccgccggcgatcccgcgccgcacgtggtggacgagtgccggggcgtgctgttcgtgtacagcgacggcaccgtggtgcggcgcgcggcgccggggttcgccacgcccgtgcgcgacgacgggtccgtggagtggaaggacgcgacgttcgacgcggcgcgcgggctggggctccggctctaccggccccgggactgggggcgcaggctgccggtgttcttctactaccacggcggcgggttctgcatcggctcccgcgcctggcccaactgccagaactactgcctccgcctcgccgcggacctcggcgcgctcgtcgtggccccggactaccgcctcgcgccggagcaccgcctccccgcggccatcgacgacggcgcggccgcggtcctgtggctcgccgcgcaggcgcggggcggtggcggggacccgtgggtcgcccagtccgcggacctcgcccgcgtgttcgtctcgggcgactccgccggcggcaacatcgcgcaccacctcgccgtgcggttcggctccccggccgggcgcgaggagctcgcgcccgccgccgtccgcggctacgtccagctcatgcccttcttcagcggcaccgagc

SEQ ID NO: 44575 - protein, 211 aa, Panicum virgatum
  misc_feature: Ceres CLONE 2021305
  misc_feature (82)..(211): Pfam Name: Abhydrolase_3 Pfam Description: alpha/beta hydrolase fold
  misc_feature: SWISSPROT Homolog: EC 3.1.1.3 Triacylglycerol lipase
MASSEAAAPPAGDPAPHVVDECRGVLFVYSDGTVVRRAAPGFATPVRDDGSVEWKDATFDAARGLGLRLYRPRDWGRRLPVFFYYHGGGFCIGSRAWPNCQNYCLRLAADLGALVVAPDYRLAPEHRLPAAIDDGAAAVLWLAAQARGGGGDPWVAQSADLARVFVSGDSAGGNIAHHLAVRFGSPAGREELAPAAVRGYVQLMPFFSGTE

SEQ ID NO: 44576 - DNA, 729 bp, Panicum virgatum
  misc_feature: Ceres CLONE 2021312
  misc_feature: Encodes the peptide sequence at SEQ ID NO. 44577
acagcagctcaaagcagcaaagcactcttcaccttctacgcaggccggctgcaagcgcgaggaagaagcgccagcgcagaagtcgtcgaccgccatggctcagggaaggggcagtgcgacgacacggtgcctcgccgtcggcggcctgctcgccgcgtgcctcctcctcggcgccgccgacgcggccacccacagcgtcgtctggtcgttcaacgcggacacctggccccggggcaagagcttccgcgccggggacgtcctcgagttcaactacgacccctccctgcacaacgtggtggccgtggacgccagcggctacaacagctgcggctcctccggcaggacctacagctccgggagggatcgcatcacgctcggccccgggaccaactacttcatctgcagcctcaacgggcactgcgggatggggatgaagatggccgtcaacgccagctgaaggctgaagcccccacgctgcttgcagagcaccaataagtgatgcgtgtcacagtcacaggcggtccgatcgtgcaagaactcaatcgttttggcagcgcacgcccggccctgtgcgggatacgcgccgatacaggtctcatgtgtcatgtactggcagggtatgtgtggtgtggagtggagtggtagtcgaggcatggtgtgtgtatggtttactggcaggacagtgaagcgttacctatagctttgttgtttgtttggacttcgaagcag

SEQ ID NO: 44577 - protein, 120 aa, Panicum virgatum
  misc_feature: Ceres CLONE 2021312
  misc_feature (37)..(113): Pfam Name: Cu_bind_like Pfam Description: Plastocyanin-like domain
MAQGRGSATTRCLAVGGLLAACLLLGAADAATHSVVWSFNADTWPRGKSFRAGDVLEFNYDPSLHNVVAVDASGYNSCGSSGRTYSSGRDRITLGPGTNYFICSLNGHCGMGMKMAVNAS

SEQ ID NO: 44578 - DNA, 473 bp, Panicum virgatum
  misc_feature: Ceres CLONE 2021328
  misc_feature: Encodes the peptide sequence at SEQ ID NO. 44579
aacaaacgctaaaaaagtaacagtttctgtactttattggttcatcgcaacaatgcgcaaggacgagtgcgagttctccaacttcgccatgtaccccggcacgggcatccgctacgtgccgttcgcgttcctcagcacgaagcccgtgctgccgttcgcgcgcccgaagtgcctgtcgctgtacatgcgcaagaagaacccgcgtacggtcgcgtggacccgcacattccgccgcctgtacaagaaggcggcgtcggagaccgtgacccgccgccgcacgcacaagacgtcgcgcgttgcccgcgccatcgtcggtgccgagctgtcgtacatccaggaggtgcgcgccaagcacgccaagaaggaggaccgcacggcgaagggcaaggccgtccgcgctgagatggctgagcgcaaggccgccaagaagtaaacgtgcgcaacgttgaaccggctgcagatctctctccgtt

SEQ ID NO: 44579 - protein, 126 aa, Panicum virgatum
  misc_feature: Ceres CLONE 2021328
  misc_feature (1)..(75): Pfam Name: Ribosomal_L24e Pfam Description: Ribosomal protein L24e
MRKDECEFSNFAMYPGTGIRYVPFAFLSTKPVLPFARPKCLSLYMRKKNPRTVAWTRTFRRLYKKAASETVTRRRTHKTSRVARAIVGAELSYIQEVRAKHAKKEDRTAKGKAVRAEMAERKAAKK

SEQ ID NO: 44580 - DNA, 705 bp, Panicum virgatum
  misc_feature: Ceres CLONE 2021343
  misc_feature: Encodes the peptide sequence at SEQ ID NO. 44581
aatcttgcaggctccaagggtccaaccttcacctcacggcgatggccgcgcaagagccggcgtcgacggagggcgcgcggccccgcgtcctcctggcggcctccggcagcgtggccgccatcaagttcgaggtcctctgccgcagcgtcgccgagtgggccgacgtccgcgcggtggcgaccgcgtccgccctccacttcatcgacggggcctccttccccatcggcgtcccgctctacaccgacgacgacgagtggtcccgctggaggcgcgtcggcgacgaggtcctgcacatcgagctccgcaggtgggccgacgccctggtcatcgcgccgctctcggccaacaccctcgccaagatcgccggcgggctgtgcgacaacctcctcacgtgcgtggtgcgcgcgtgggattacggcaagcccgtctacgtcgcgccggccatgaacaccttcatgtgggacaaccccttcacggcgcgccacctcggcgtcgtgcgcgagctcggtatctccctcatcccgccggtgaccaagcggctggcctgcggggactacggcaacggcgcaatggcggagccgtcggagatctgcagaaccctgctgctcttcttcggaccacaacatctttagcagcagctggagcctgatagtcaaagctcttcagtagttcagttagatttgctttctgtatgagatgtgtgac

SEQ ID NO: 44581 - protein, 196 aa, Panicum virgatum
  misc_feature: Ceres CLONE 2021343
  misc_feature (14)..(134): Pfam Name: Flavoprotein Pfam Description: Flavoprotein
  misc_feature: SWISSPROT Homolog: EC 4.1.1.36 Phosphopantothenoylcysteine decarboxylase
  misc_feature: Functional homolog of the protein sequence given in SEQ ID NO 51681
  misc_feature: Useful for making plants with modulated flowering time
MAAQEPASTEGARPRVLLAASGSVAAIKFEVLCRSVAEWADVRAVATASALHFIDGASFPIGVPLYTDDDEWSRWRRVGDEVLHIELRRWADALVIAPLSANTLAKIAGGLCDNLLTCVVRAWDYGKPVYVAPAMNTFMWDNPFTARHLGVVRELGISLIPPVTKRLACGDYGNGAMAEPSEICRTLLLFFGPQHL

SEQ ID NO: 44582 - DNA, 666 bp, Panicum virgatum
  misc_feature: Ceres CLONE 2021352
  misc_feature: Encodes the peptide sequence at SEQ ID NO. 44583
atctctctaccttatcctttggagtgcgggacgcacgggccgccgccggtcgccgctgcggggcgctgctgcggcccgccgccgggcgctgctgcggggcgctcgccgggggtccgggtccggccaagcaggcagcatggcggaggaggcgctgatgcacgagctgggcctccgccgtggccacgtcgccctccttctcgcgcccagctcgctccacatccccgtcgtctccctcggcgtgctttccctcggcgccgtactctccaccgccaacccgctcctcacgcccggcgagctcgccgaccaggcccgcgactcggagcctttcctcacgctgacgaccgccgagctcgcccccaagctcggctccctgctgcccgcctcgcgggtcgtcctcgtcgaccagctcctcgccggcctcgacggccacgacacaggacaccgccggcagccgctaccgggcgctcgccgggggtccgggtccggccaagcaggcagcatggcggaggaggcgctgacggaagctcgccacggtcgcgtcctcctcgccaccacgacctggttgcgggagctgggaccccgtcacggacaagctgcgggagcttccccgccctgccacgccctacccacttttcaactagaacgcggccgtgctctgcgccgccc

SEQ ID NO: 44583 - protein, 176 aa, Panicum virgatum
  misc_feature: Ceres CLONE 2021352
  misc_feature: SWISSPROT Homolog: EC 6.2.1.12 4-coumarate--CoA ligase
MAEEALMHELGLRRGHVALLLAPSSLHIPVVSLGVLSLGAVLSTANPLLTPGELADQARDSEPFLTLTTAELAPKLGSLLPASRVVLVDQLLAGLDGHDTGHRRQPLPGARRGSGSGQAGSMAEEALTEARHGRVLLATTTWLRELGPRHGQAAGASPPCHALPTFQLERGRALRR

SEQ ID NO: 44584 - DNA, 673 bp, Panicum virgatum
  misc_feature: Ceres CLONE 2021354
  misc_feature: Encodes the peptide sequence at SEQ ID NO. 44585
atcgagaagagcacacagccagagcaacgcatacaaccttcagcaatccactcgcacccgaccgacgatgtcgctggtgaggcgcagcaacgtgttcgaccccttcgccgacttctgggaccccttcgacgtcttccgctccgtggtgcccgcggcatcgaacgaccgcgacaccgtcgccttcgccggcgcgcgcatcgactggaaggagacccccgaggcgcacgtcttcaaggctgacctccccggcgtcaagaaggaggaggtcaaggtggaggtggaggacggcaacgtcctggtgatcagcggcgagcgcagcagggagaaggaggacaagaacgacaagtggcaccgcgtcgagcgcagcagcggcaagttcctccgccggttccgcctgccggagaacgccaagacggaggaggtgaaggccggcttggagaacggcgtgctcacggtcaccgtgcccaaagcagaggtcaagaagcccgaggtgaaggccatcgagatctctggctgagagttcaatctttacggtcgcgcaagctgctacgtcgtgctgtggtcgaagtatggtcgtcgtgttcctcaatcctgtgtcggtcatgtcgtggtcaatgttgtgcttgccggctggccgcgtcgacccgggagcggtattggtatttgtgtgttt

SEQ ID NO: 44585 - protein, 149 aa, Panicum virgatum
  misc_feature: Ceres CLONE 2021354
  misc_feature (45)..(148): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFADFWDPFDVFRSVVPAASNDRDTVAFAGARIDWKETPEAHVFKADLPGVKKEEVKVEVEDGNVLVISGERSREKEDKNDKWHRVERSSGKFLRRFRLPENAKTEEVKAGLENGVLTVTVPKAEVKKPEVKAIEISG

SEQ ID NO: 44586 - DNA, 683 bp, Panicum virgatum
  misc_feature: Ceres CLONE 2021359
  misc_feature: Encodes the peptide sequence at SEQ ID NO. 44587
tgacacagcaagagcctcgcgcgaccaccaacctatttttacacgccggcggcggcggcggcaggggcgcccggtaccgccgcctcggcacgcccgtgctggtcccggtggacaggggcgacgcctgcgtccccgccgccggcgacgccgacgacgcggcgccttgcgacgcgcccgccgacggcgagaacgtcgtcagcctcaaggtcagcctgctcggcgactgccagatcggcaagacaagcttcatggttaagtatgtgggagatgacggggaggagcagaacggcttgcagatgacgggcctgaatctcatggacaagacgatggccgtccggggagctaggattgcctacagcatctgggatgtagcaggagacatccaagccgtcgaccacatcccaatcgcgtgcaagggcgccgtggcgatcctgtacatgttcgatctcacgagccggtgcacgcttaataatattctagattggtacgagagggcgaggaaatggaataagacggctattccaatcctaatcgggacaaagtttgatgactttgctcagattcctcttgaaatgcaatgggccattgttaaccaggccagggcatacgcaagagcgatgaaggcgaccctcttcttctcgagcgcgacgcacaacatcaacgtgaacaagatcttcaagttc

SEQ ID NO: 44587 - protein, 226 aa, Panicum virgatum
  misc_feature: Ceres CLONE 2021359
  misc_feature (68)..(182): Pfam Name: Miro Pfam Description: Miro-like protein
TQQEPRATTNLFLHAGGGGGRGARYRRLGTPVLVPVDRGDACVPAAGDADDAAPCDAPADGENVVSLKVSLLGDCQIGKTSFMVKYVGDDGEEQNGLQMTGLNLMDKTMAVRGARIAYSIWDVAGDIQAVDHIPIACKGAVAILYMFDLTSRCTLNNILDWYERARKWNKTAIPILIGTKFDDFAQIPLEMQWAIVNQARAYARAMKATLFFSSATHNINVNKIFK

SEQ ID NO: 44588 - DNA, 661 bp, Panicum virgatum
  misc_feature: Ceres CLONE 2021373
  misc_feature: Encodes the peptide sequence at SEQ ID NO. 44589
gaacctcccaattgggtgtatcccaaaatatctgatggtatttaagagcgataaggaagaagattatgaaccaaagacaggttgccttaggtggatgaacaagttctcacggtaccacaaccaacttcttatgaaggagattaagaagcttcgcaagctccatgctggagtaaccatcatctatgctgataactatggagctgctatggagattttcctttcccctgaacaatatgggatcgaagatccactcgtggcttgctgtggtggaggtggacggtacggtgtctccccaactacaagctgtggatccggagaatatacggtgtgcagtaaccctgaaaagtatgcctcatggaatggcttccatccatcagaagctgcgtacagggcaattgcaatgggtcttctacgaggttcatacacacagccgtcaattgcttccatcaccagttcatgtccacagcttgcggagctgggatcttctgttgaatccaagcccctctatgacctgtaatgattgtgtaactacatttatttttactacttgaaaaggtcaaatattattagtttggactaatgattagtcaaattacatatacgttaaatgtaaaaattatgtcaatagttcatgtttcgaaatgttctttatatgtcattg

SEQ ID NO: 44589 - protein, 171 aa, Panicum virgatum
  misc_feature: Ceres CLONE 2021373
  misc_feature: SWISSPROT Homolog: EC 3.2.1.51 Alpha-L-fucosidase
NLPIGCIPKYLMVFKSDKEEDYEPKTGCLRWMNKFSRYHNQLLMKEIKKLRKLHAGVTIIYADNYGAAMEIFLSPEQYGIEDPLVACCGGGGRYGVSPTTSCGSGEYTVCSNPEKYASWNGFHPSEAAYRAIAMGLLRGSYTQPSIASITSSCPQLAELGSSVESKPLYDL

SEQ ID NO: 44590 - DNA, 652 bp, Panicum virgatum
  misc_feature: Ceres CLONE 2021386
  misc_feature: Encodes the peptide sequence at SEQ ID NO. 44591
actgctcgagcgagctccagctctcaagaaaccacgccggatcatggccatggagcctttccttcgcccgctcgtcctcgcgctcctgatcgcgtcctgcgccgcgcagcaggcgccgccggcacagcccccgcagacgccgaacgccccgccgcaggcgcctccggctccccaggcgcctccggcgggcaacccgccgccggctccccagacgcctccggccggcaacccgcctcccgcacccaccactcctcctccggctccgacgaccacgccgcccccggcaccgaccacccctcctccggcccccaccacgccgcctccggccccggtgactcccccgccagcccccaccacgccgccgccgtcgccgccggcctctcccccgcccgctcccaccaccccgccacccgctcccgccaccccgcccccgtccccgcccatggcgccgcctccggccacgcctcctccccccgccaccccgcctccggccgcgcccacgccagccccgagcaccgccccgacgctcccgcccgtggcgacacccgccgcgtccccgaagagccccgaccgattcttgatgtacgatgatgacgatggtgatgcattggtttctatggttccgcgggcggattggtgggggttagtgctc

SEQ ID NO: 44591 - protein, 200 aa, Panicum virgatum
  misc_feature: Ceres CLONE 2021386
  misc_feature: Functional homolog of the protein sequence given in SEQ ID NO 51459
  misc_feature: Useful for making plants with altered cell wall content and/or composition
MEPFLRPLVLALLIASCAAQQAPPAQPPQTPNAPPQAPPAPQAPPAGNPPPAPQTPPAGNPPPAPTTPPPAPTTTPPPAPTTPPPAPTTPPPAPVTPPPAPTTPPPSPPASPPPAPTTPPPAPATPPPSPPMAPPPATPPPPATPPPAAPTPAPSTAPTLPPVATPAASPKSPDRFLMYDDDDGDALVSMVPRADWWGLV

SEQ ID NO: 44592 - DNA, 699 bp, Panicum virgatum
  misc_feature: Ceres CLONE 2021388
  misc_feature: Encodes the peptide sequence at SEQ ID NO. 44593
atccattcacagctctcgcttccgaacacacagcagtgtagtttccagagcccccacctctgcctttcgagatcccacaactagccgagatgcctgccctcgccaagcctgcctcccgtccggccaagaccgccgcggcgcccaagccgaagaccgccgccgccaagcccaaggcggccgccgccggcgcctcccacccgccttacttcgagatgatcaaggaggcgatcacggcgctcaaggagaggaccggctcgagctcgcacgccatcgccaagtacatggaggacaagcacggcgcgtccctgccggccaactacaagaagatgctctccatccagctccgggggttcgccgccaagggcaagctcgtcaaggtcaaggcctcctacaagctctccgacgccgccaagaaggactcccccaaggctaagcccgccgcccccaagaccgccgcgcccaagcctgccaaggccgctgccaagccgaagaagacggccgccgctgccaagcccaagaagacggccgctgccgcagccgggaccaagcgcaaggcgccggagaagaagaagatcgtggcgaagccgaagaagtcccccgcggcgaaggccaaggccaagccgaagaccgtcaagtcccccgtctccaagaaggccaggaaggtcgcggcatgagttggttccataggtcgtagtagct

SEQ ID NO: 44593 - protein, 194 aa, Panicum virgatum
  misc_feature: Ceres CLONE 2021388
  misc_feature (35)..(105): Pfam Name: Linker_histone Pfam Description: linker histone H1 and H5 family
MPALAKPASRPAKTAAAPKPKTAAAKPKAAAAGASHPPYFEMIKEAITALKERTGSSSHAIAKYMEDKHGASLPANYKKMLSIQLRGFAAKGKLVKVKASYKLSDAAKKDSPKAKPAAPKTAAPKPAKAAAKPKKTAAAAKPKKTAAAAAGTKRKAPEKKKIVAKPKKSPAAKAKAKPKTVKSPVSKKARKVAA

SEQ ID NO: 44594 - DNA, 691 bp, Panicum virgatum
  misc_feature: Ceres CLONE 2021395
  misc_feature: Encodes the peptide sequence at SEQ ID NO. 44595
ggcttccgacaggagcaaaacttcgaaaccagagaagccgtccgcagcagcgggtgccagcctccccaatccttttgatttttcttctatgagtggcttgctcaatgatccagcaataagagagatggcagagcaaattgcaagtgaccctgtgttcaaccagatggctgaacagcttcagaaaagtgctcagggtgctggtgaacagggcatccctgcactggatcctcaacagtacatggaaacaatgcaacaagtcatgcaaaatcctcagtttgtgtcaatggcagagcatcttgggaatgctcttatgcaggatcctgctatgtccagtatgcttgagaacttgagtagtccagctcataaggagcagtttgaagagcgaatggctcgtatcaaggaagatccatccttgaagccaatccttgatgagatagagaatggtggtccatctgcaatgatgaagtactggaatgaccctgaggttcttaaaaagattggccaggcaatgggagttaaccttccaggagattctagtgcttccactgaactctctggacctgaagaaactgaggaagaaggtggttatgatgatgagtccattgttcatcacactgccagtgttggtgatgcagagatcttgagtcacctgcttcaaaagtgaaccatcaaacttttcagggatgaaggg

SEQ ID NO: 44595 - protein, 220 aa, Panicum virgatum
  misc_feature: Ceres CLONE 2021395
  misc_feature: The sequence is a functional homolog of SEQ ID NO 1839 in the 10/374,780 US patent application
ASDRSKTSKPEKPSAAAGASLPNPFDFSSMSGLLNDPAIREMAEQIASDPVFNQMAEQLQKSAQGAGEQGIPALDPQQYMETMQQVMQNPQFVSMAEHLGNALMQDPAMSSMLENLSSPAHKEQFEERMARIKEDPSLKPILDEIENGGPSAMMKYWNDPEVLKKIGQAMGVNLPGDSSASTELSGPEETEEEGGYDDESIVHHTASVGDAEILSHLLQK

SEQ ID NO: 44596 - DNA, 733 bp, Panicum virgatum
  misc_feature: Ceres CLONE 2021396
  misc_feature: Encodes the peptide sequence at SEQ ID NO. 44597
ctagctcccgtcgccgccgccgccgccgtcaccgccgccgctgcggtcacacaacaatgggtatcgacctcgtcgccggcggccgcaacaagaagactaagcgcacagcgcctaagtccgacgatgtctacctcaagctcctcgtcaagctctaccgcttcctggttcgaaggacaaagagcaactttaacgccgtgatcctcaagcggctgttcatgagcaagaccaaccaacctccgctctcgatgcgccgcctagtcaagttcatggagggcaagggtgaccagatcgctgtgatcgtgggcaccgtcaccgacgacaagaggatcactgaggtgccggcgatgaaggtgtgcgcgctcaggttcaccgagacggcgagggccaggatcatcaatgcctgtggcgagtgcctcaccttcgaccaacttgcactccgtgcaccgctcggacaaaacacggtcctcctgaggggtcctaagaatgcgagggaagctgttaagcactttggccctgcgcctggagtcccacacagccacaccaagccttatgttcgctcaaagggacggaaatttgagaaggcgagagggaggaggaacagcaggggcttcaaggtctaagtggcggatatcagctaaattcttcatgccatactgctcctatcagctaaatatcactgttttggtgccagagctgtactctactactctactgctttagatgtcagaatcat

SEQ ID NO: 44597 - protein, 187 aa, Panicum virgatum
  misc_feature: Ceres CLONE 2021396
  misc_feature (12)..(185): Pfam Name: Ribosomal_L18e Pfam Description: Eukaryotic ribosomal protein L18
  misc_feature: Functional homolog of the protein sequence given in SEQ ID NO 50173
  misc_feature: Useful for making plants with modulated nitrogen use efficiency
MGIDLVAGGRNKKTKRTAPKSDDVYLKLLVKLYRFLVRRTKSNFNAVILKRLFMSKTNQPPLSMRRLVKFMEGKGDQIAVIVGTVTDDKRITEVPAMKVCALRFTETARARIINACGECLTFDQLALRAPLGQNTVLLRGPKNAREAVKHFGPAPGVPHSHTKPYVRSKGRKFEKARGRRNSRGFKV

SEQ ID NO: 44598 - DNA, 485 bp, Panicum virgatum
  misc_feature: Ceres CLONE 2021410
  misc_feature: Encodes the peptide sequence at SEQ ID NO. 44599
aggtctctccctccccagatccccgccatggcccgctcctcttcgcagtcccagtcctccgtcggcggcgccggcgccggcgccggagcccgcccggccaccgttggcccgcgcggcacggccgcagctgccgccggcatgcgccgccgccgcgccgccgccagcgccgggggagggggcttctccggcggcggagggagcaacatgcttcgattctacaccgacgaggccccgggtctgcgcctctcgccaaccatggtgctcgtcgtgtcgctgtgcttcatcgcattcgtcaccgccctccacgtcttcggcaagctctaccgctcccgcaccgcagcaccctccgcgtgatccatcccatcccatcgcatcgctcctgcgcgagtatcatcatatcacaaggttttcagatatatcatcgtcagcctacttactcatgtcttgcctagctttccttcctgtgctagatctggagggagatg

SEQ ID NO: 44599 - protein, 108 aa, Panicum virgatum
  misc_feature: Ceres CLONE 2021410
  misc_feature (54)..(99): Pfam Name: Sec61_beta Pfam Description: Sec61beta family
MARSSSQSQSSVGGAGAGAGARPATVGPRGTAAAAAGMRRRRAAASAGGGGFSGGGGSNMLRFYTDEAPGLRLSPTMVLVVSLCFIAFVTALHVFGKLYRSRTAAPSA

SEQ ID NO: 44600 - DNA, 454 bp, Panicum virgatum
  misc_feature: Ceres CLONE 2021415
  misc_feature: Encodes the peptide sequence at SEQ ID NO. 44601
ggagacaaccgcaacaacagcttcgattctcacatctggggtccgctcccagtaaggaacatcgtcgggagatctctgctccggtactggccgccgtccaagataaccgacacgatccacgactacgagcccgatgccgcgcaccacgcggtgccatcctgatagtgatacctagtttgctccgtcgacgctggagagccgatgtctacaataacatcacatggaactcgctctgtcgatgagccgagctccagttctttttgtttctctcggaataattgtttccctgagtgttgtctgtaaattccctttggctgaccgattggtttattccccattggcaagtgattgtttagagcacctgtcaaaagtgtaatgccttgcaattcgcaagctagaaatgctaagtacctctatatttgcaagtatatagcttttactgaaaggagcattg

SEQ ID NO: 44601 - protein, 53 aa, Panicum virgatum
  misc_feature: Ceres CLONE 2021415
  misc_feature: SWISSPROT Homolog: EC 3.4.21.89 Signal peptidase I
GDNRNNSFDSHIWGPLPVRNIVGRSLLRYWPPSKITDTIHDYEPDAAHHAVPS

SEQ ID NO: 44602 - DNA, 700 bp, Panicum virgatum
  misc_feature: Ceres CLONE 2021416
  misc_feature: Encodes the peptide sequence at SEQ ID NO. 44603
tctaccgatagcacactacgctactctacgctctcgccagctagtcgatcttacactgcgttccgcttccgcagcagcccagcccagcccagctccttcggcaacaacggcggcggctacacggtgttcgcgcccaccgacaacgccttcaacaacctcaagcccggcacgctcaactccctcacccagcagcagcaggtgtcgctggtgcagggccacatcctgcccagtttctacagcatggactccttccagaccgccagcaaccccgtccgcacccaggcctccggccgggacgggccctacacgctcaacatcacctccgacaccaacaaccaggtcaacgtctcctccggcgtcgtcgaggtccgcatcaacaacgcgctctactccgccaagccgctcgccgtctactccgtcgacaaggtgctcctgcccatggagctcttcggggccaaggcccccgccgccgcgcccactgcgtccgagggcaagcccaagaagggcggctcctccgacgcctcgtcaccggccggctccgaggattccgacacgggcgccgccagcgccagggccgtcggctggagcgtcgctggcctcgccgccgttcttggctacctgttgtgagactgggatgagaatgcaatgtccaccaattccatctttgactgagattgtcagcggtggtgtttccttcctt

SEQ ID NO: 44603 - protein, 208 aa, Panicum virgatum
  misc_feature: Ceres CLONE 2021416
  misc_feature (7)..(146): Pfam Name: Fasciclin Pfam Description: Fasciclin domain
  misc_feature: Functional homolog of the protein sequence given in SEQ ID NO 51072
  misc_feature: Useful for making plants with altered carbohydrate content
  misc_feature: Functional homolog of the protein sequence given in SEQ ID NO 51619
  misc_feature: Useful for making plants with altered cell wall content and/or composition
STDSTLRYSTLSPASRSYTAFRFRSSPAQPSSFGNNGGGYTVFAPTDNAFNNLKPGTLNSLTQQQQVSLVQGHILPSFYSMDSFQTASNPVRTQASGRDGPYTLNITSDTNNQVNVSSGVVEVRINNALYSAKPLAVYSVDKVLLPMELFGAKAPAAAPTASEGKPKKGGSSDASSPAGSEDSDTGAASARAVGWSVAGLAAVLGYLL

SEQ ID NO: 44604 - DNA, 585 bp, Panicum virgatum
  misc_feature: Ceres CLONE 2021417
  misc_feature: Encodes the peptide sequence at SEQ ID NO. 44605
ttccctccctacagccgccgccgccgccgcatctcccagcctccgcgcctccgtcgccgccgccgcgccgccgcttcctcagccatgggtaaggtgcacggatcgctggcccgtgccgggaaggtccggggccagacgcccaaggtggcgaagcaggacaagaagaagaagccccgcggccgcgcgcacaagaggatgcagtacaaccgccgattcgtcaccgccgtcgtcggcttcggcaagaagcgcgggcccaactcatccgagaagtaggcgccgcgccgcgcagccgccggctcgacccgccccggttcctctattccgttctcagtatgcttatgctcttgtcggtagtagtttcgttgtgcaagcaaaggaagaaccttttgtagtttcagtttcgttgttcgtgtgatgagatgggaacttgagatggtatctgtaccccgtttaagattttgagatatgatgatatgatcccataactttatggtgctgcgcggtttggtatgtgccactccgccttgtcatgtttctttgtgaatcatcaatttaattctatatgctgttagttttgtacatgtc

SEQ ID NO: 44605 - protein, 62 aa, Panicum virgatum; identical to SEQ ID NO: 30980
  misc_feature: Ceres CLONE 2021417
  misc_feature (3)..(61): Pfam Name: Ribosomal_S30 Pfam Description: Ribosomal protein S30

SEQ ID NO: 44606 - DNA, 527 bp, Panicum virgatum
  misc_feature: Ceres CLONE 2021438
  misc_feature: Encodes the peptide sequence at SEQ ID NO. 44607
gcttacaaacacctaccaattctacagattccgactagcagcttacttcacgtgcagactgcttgcattgcaatggcaaaccgtggctccgccgctctcacaatcgcgtgcctgcttatcatcgcggtcaccctggcggacgcactcccaccgacatcgccgctgcactgcaagacggtgtacggggtgcagaagcgtgagacgtgcttcgccgtggcgcaggctgcggggctgcccctgaagaagttcctccagttcaaccccaacatcaactgcaataacctcttcatcggacagtgggtttgccttgctctcggtcacgcttgagattgagagtttctaaaaatgtcctactatggtgtagtacaacactctctccctcactatatatatgtcacgaaaaagaatcttcgtgctataaaataaggaggtctctcgtgtgttttatctttacagaccttagctgctagtgctaaggtcggctgtctatgctactttcctgttcctgtaatacatgtgtgttctgg

SEQ ID NO: 44607 - protein, 84 aa, Panicum virgatum
  misc_feature: Ceres CLONE 2021438
  misc_feature (37)..(80): Pfam Name: LysM Pfam Description: LysM domain
MANRGSAALTIACLLIIAVTLADALPPTSPLHCKTVYGVQKRETCFAVAQAAGLPLKKFLQFNPNINCNNLFIGQWVCLALGHA

SEQ ID NO: 44608 - DNA, 579 bp, Panicum virgatum
  misc_feature: Ceres CLONE 2021442
  misc_feature: Encodes the peptide sequence at SEQ ID NO. 44609
gcgtggacgacgacggcacgccctactgggtggtgaagaactcgtggggccccgggtggggcgagggcgggtacatccggatggagcgcggcgccggcgacggcggcctctgcggcatcgccatggaggcctccttccccatcaagacctcccccaacccgtcgcgtaagccccggcgcgcgctcctctccagggacgcctcctcctcccagtgatccatccatggctgcatcaatctgaacgagcatccggaggaacgcaccacgcatcagctggcgctggcgcgtaagcatgggtagccaggactactaccaaattactaccactactgtttgcttgtgttattagctatcaattgggttgtactactgatatgaatgtggtttgattgtgccggtctgggtctcggcctctcgggtgagagacgaagctagaataaagtagcagcgcatgcgcgcaacaagagtaagattaggtgtaagatggtgtgtctaaattgtacctgtaatgtaatacggtgtggcatgtaaggcaccggggtataaaaagtaaaggagctacgcgtaagctggcagttgc

SEQ ID NO: 44609 - protein, 70 aa, Panicum virgatum
  misc_feature: Ceres CLONE 2021442
  misc_feature: SWISSPROT Homolog: EC 3.4.22.33 Fruit bromelain
VDDDGTPYWVVKNSWGPGWGEGGYIRMERGAGDGGLCGIAMEASFPIKTSPNPSRKPRRALLSRDASSSQ

SEQ ID NO: 44610 - DNA, 726 bp, Panicum virgatum
  misc_feature: Ceres CLONE 2021443
  misc_feature: Encodes the peptide sequence at SEQ ID NO. 44611
ggctgggctgcctgctgctgtcgggagctcggatcaggggcgcggtggcgagctagggttccactgttccagagcgtgagctagcgggagcgcgctgccgtcctgcgccggcggcggcgggtggagtcggggagattaggagagatggagtcgttcctgcagaagctcaagcggctggacgcgcttcgccatgaactacgccatcgtcgtcctcgtcgtcgtcttcctctccctgctctggcaccccgtctccctcatcgtcttcctcgtctgcatgctcgcctggctcgtcctctacttcctccgcgacgagccgctcgtcctcttcggacgcgtcgtcgcggacgggtacgtcctcgccgcgctcgccgtcgtcacgctcggcctgctgctgctcaccgacgccaccgccaacatcctctcctcgctgctcatcggcctcgtgctcgtcgtcctgcacgccgcgctgcacaaagcggaggacaacgccgacgacgaggtcggacgctggtacgcgccggtgcctcagcagctgccgcactagctcaggtgtgagatcgcccctgccctctgattcgtcttccttgtccgtcctccataagatgattgtttaatgctggtgtatgatctgttaatgactcggtatgttcttgtcattgtcatgctgttggtagttgccgtctgctgttggacatgaggcacaaatgttcagagaatggttcggac

SEQ ID NO: 44611 - protein, 117 aa, Panicum virgatum
  misc_feature: Ceres CLONE 2021443
  misc_feature (1)..(105): Pfam Name: PRA1 Pfam Description: PRA1 family protein
MNYAIVVLVVVFLSLLWHPVSLIVFLVCMLAWLVLYFLRDEPLVLFGRVVADGYVLAALAVVTLGLLLLTDATANILSSLLIGLVLVVLHAALHKAEDNADDEVGRWYAPVPQQLPH

SEQ ID NO: 44612 - DNA, 478 bp, Panicum virgatum
  misc_feature: Ceres CLONE 2021458
  misc_feature: Encodes the peptide sequence at SEQ ID NO. 44613
gcaaccttctgcatcacgacccggcgaccgattctcccatccaccacatcagtcgatcagtcgcgaaaatggattcctcgaaggctcccgtaaagctcgtcaaggtcacccgagtcctcggcagaaccggttctcgtggtggcgtcactcaggtgcgcgtcgagttcatggacgacactacccgttccatcatcaggaacgtcaagggccctgttcgcgaggacgacatcctggttcttctcgaatccgagcgcgaggcccgccgcctcagataaagtatgggtgttttgggggtcgggtgaagatgggaaagtggccacagctttcagctcccttgtcggcctttttggcccgaccgtcgccataagctgcggcgaaggaaggatgggatgtcaaggacgggcgttcggtagaacggtatcacgattattgctctctacaaattctacacggcgctgacgctgcgccaattcctgcg

SEQ ID NO: 44613 - protein, 68 aa, Panicum virgatum
  misc_feature: Ceres CLONE 2021458
  misc_feature (1)..(68): Pfam Name: Ribosomal_S28e Pfam Description: Ribosomal protein S28e
MDSSKAPVKLVKVTRVLGRTGSRGGVTQVRVEFMDDTTRSIIRNVKGPVREDDILVLLESEREARRLR

SEQ ID NO: 44614 - DNA, 881 bp, Panicum virgatum
  misc_feature: Ceres CLONE 2021461
  misc_feature: Encodes the peptide sequence at SEQ ID NO. 44615
gggcaagacggcaaccaacgcgagcaagagcgtcttgattgacaccgatcgagcaaacacaccactgcttctctgctcaaagccggatcgctcttcggcttcgttccacccaccaagccgactcgagacgatgtatccggccaagcccagcgagccggcggcggcgccggtgaccggggtccccgtgggcgtccccggcggcggccagggccagtggtcgtcgggtctcttggactgcttcgacgactgcgggctgtgctgcctgacgtgctggtgcccgtgcatcacgttcgggcgcgtggcggagatcgtggaccgcggcgcgacgtcgtgcgggacgagcggggcgctgtacgcgctgctggcctacctcaccggctgccactggatctactcctgcacctaccgcgccaagatgcgcgcccagttcggcctcccggagaacccctgctgcgactgctgcgtccacttctgctgcgagccctgcgcgctctgccagcagtacaaggagctcaaggcacgcggcttcgacccggacctcggctgggagctcaatgcccagagggccaacgccgccgccatccccatgtacccgcccgccgcacagggcatgggccgctgaactcattcatcatctcgtctcatctcatccgtgccgatgatgctcatcatcagtcgacgagtttatttgcttctgttcgtgcatggtgaattgtacgtactgctgcactagctatgtgtttatttgtgtgtgtgtttcatctcttgcataagccaaaaggaaatgtgcgtgtaaacatcatcagtacggagtgtacgtttcccttttcttttgttactgtatacatgcatgcatatttcttggttcttccatggtttcg

SEQ ID NO: 44615 - protein, 163 aa, Panicum virgatum
  misc_feature: Ceres CLONE 2021461
  misc_feature (29)..(128): Pfam Name: PLAC8 Pfam Description: PLAC8 family
MYPAKPSEPAAAPVTGVPVGVPGGGQGQWSSGLLDCFDDCGLCCLTCWCPCITFGRVAEIVDRGATSCGTSGALYALLAYLTGCHWIYSCTYRAKMRAQFGLPENPCCDCCVHFCCEPCALCQQYKELKARGFDPDLGWELNAQRANAAAIPMYPPAAQGMGR

SEQ ID NO: 44616 - DNA, 691 bp, Panicum virgatum
  misc_feature: Ceres CLONE 2021462
  misc_feature: Encodes the peptide sequence at SEQ ID NO. 44617
ctcgcgaaaaccctagccgcacggtgcttcccttcgctctccaacccctcgaggtaatccattcgcagtcggccaagtcctcggagcgcgggagatggcggatcaggagacccctgttgcggttgaggcacctacccctgttctcggggagccgatggacttgatgactgccctgcagcttgtcatgaagaagtccagtgctcatgatggtcttgtgaagggccttcgtgaggctgccaaagccattgagaagcatgctgctcagctctgcgtgcttgctgaggactgtgaccagcctgattatgtcaaactggtgaaggcactgtgctctgagcacaatgttcatctggttaccgtgcctagcgccaaaactcttggcgagtgggctgggattgactctgagggcaaggcaaggaaggttgtgggctgctcctgtgtcgttgtcaaggactacggtgaggaatctgagggccttaacatagtgcaggagtacgtcaagtcccactaaacgcgacacactccggcgcctggagctttatgttcgacattctggacctcggtttgaaatttgtgcttggtaacggggcttgctaggatattagagcaattttcaagtgtgagccaaggagagatgtgaacgatttggacatctgaactcttgtttgaagagccgtgtcgtctgcttttatac

SEQ ID NO: 44617 - protein, 137 aa, Panicum virgatum
  misc_feature: Ceres CLONE 2021462
  misc_feature (25)..(117): Pfam Name: Ribosomal_L7Ae Pfam Description: Ribosomal protein L7Ae/L30e/S12e/Gadd45 family
MADQETPVAVEAPTPVLGEPMDLMTALQLVMKKSSAHDGLVKGLREAAKAIEKHAAQLCVLAEDCDQPDYVKLVKALCSEHNVHLVTVPSAKTLGEWAGIDSEGKARKVVGCSCVVVKDYGEESEGLNIVQEYVKSH

SEQ ID NO: 44618 - DNA, 668 bp, Panicum virgatum
  misc_feature: Ceres CLONE 2021490
  misc_feature: Encodes the peptide sequence at SEQ ID NO. 44619
acccccaacccgctccggccgccaccaccgatcgatcgccggaccccgccgcgagtctaacccctgctgcgttcgtagccttcgacgacgatgtcgggagccggagaggaggacaagaagccggcggagggcggcgcccacatcaatctcaaggtcaagggacaggatggcaatgaggtgttcttccgtattaagaggtccacccagctgaagaagctgatgaacgcctattgcgaccgccagtctgtggacatgaatgccattgcattcctttttgatggccgcaggcttcgcggtgagcagaccccagatgagctggagatggaggatggtgatgagattgatgccatgcttcaccagaccggtggctacgtgcctagtgcttagaaagcccttgtcgcagcctcgttttgctgcgctgtgcactctaccttctgtagtaaaccaaagaagtcatggaggaacttgtgaggctctggccctatgtctgccattgctgaaggacatcggtagtcttgtttagatttggtacgtcggcgtgtcatgactcgtttatctatcccctaatatatcctcccctgtgtgtactcccaatgatcgcccatgatttgtttatcctgctcgaagtgcgccttgctttgctgacctaccgttgtgcgtggtgccgg

SEQ ID NO: 44619 - protein, 98 aa, Panicum virgatum; identical to SEQ ID NO: 13933
  misc_feature: Ceres CLONE 2021490
  misc_feature (21)..(91): Pfam Name: ubiquitin Pfam Description: Ubiquitin family

SEQ ID NO: 44620 - DNA, 618 bp, Panicum virgatum
  misc_feature: Ceres CLONE 2021492
  misc_feature: Encodes the peptide sequence at SEQ ID NO. 44621
tcgagaatgcccattttctgcagatatatcgtagtcgtgaagtaggccaatcttatatcacctccatcgcgacgacattgctagccacattgcatgctatgtggctagtaataagaatcagaccacaagtgatattttgcaatggtccagggacatgctttcctctatgtgtctcggctttctttctgaaggtgcttggtatgggatggtcctctattttctacattgaaagtattgcaagagtgaagaagctttcgatgagcggtttactgctgtacaagctacggattgctgaccagtttttcgtgcagtggccccagctgcatcaaaagtaccctcgagcatgctacgctggccgtttgatgtgagattcaaaccatatccgacatttgggtgctgcgttttttcaacttgaaagtctgatgatgctgacttagaaaagaaatgctttacagacattgatacttcatacatggggcatgttactttaagataatgtttgtgggtgaaaagtgaatcaaagtaggttcatagaagttacctcttccatactgtcctcaattgtgcctgccccccgtttgacgattctaatataatatacaacatgaattcagcatt

SEQ ID NO: 44621 - protein, 121 aa, Panicum virgatum
  misc_feature: Ceres CLONE 2021492
  misc_feature (1)..(120): Pfam Name: Alg14 Pfam Description: Oligosaccharide biosynthesis protein Alg14 like
ENAHFLQIYRSREVGQSYITSIATTLLATLHAMWLVIRIRPQVIFCNGPGTCFPLCVSAFFLKVLGMGWSSIFYIESIARVKKLSMSGLLLYKLRIADQFFVQWPQLHQKYPRACYAGRLM

SEQ ID NO: 44622 - DNA, 440 bp, Panicum virgatum
  misc_feature: Ceres CLONE 2021502
  misc_feature: Encodes the peptide sequence at SEQ ID NO. 44623
agcactcactgcctcctgcgtctccccccctccccgtccatcatagtctcaatcgagtacccgggggtcctcccggcaacaacttcccgatgtcgctggctcaaccaccgtcaggcactggaaagcgtgctgatgacgctcgatcctgcaccctgtgtatcatgtcaatgcacagaatcagacggcggcttagcgggctgccttctgcctgtgctggtgacatgagtacggcgactgtgaatatctgcaaccctgacctcagtaagaacgtgatgccctctgtcattgttaggcaccgcaagacttggacccgatacgacggcgtctacatgtactttgcacacgctggtgaagtgattgtgatcctacagagagagatgaaacgttctgccctcactggaccgtgcggaaatgagtgcgctgaccagtggccctgtatt

SEQ ID NO: 44623 - protein, 145 aa, Panicum virgatum
  misc_feature: Ceres CLONE 2021502
  misc_feature: Functional homolog of the protein sequence given in SEQ ID NO 50297
  misc_feature: Useful for making plants with modulated biomass
  misc_feature: Useful for making plants with modulated heat sensitivity
HSLPPASPPLPVHHSLNRVPGGPPGNNFPMSLAQPPSGTGKRADDARSCTLCIMSMHRIRRRLSGLPSACAGDMSTATVNICNPDLSKNVMPSVIVRHRKTWTRYDGVYMYFAHAGEVIVILQREMKRSALTGPCGNECADQWPC

SEQ ID NO: 44624 - DNA, 722 bp, Panicum virgatum
  misc_feature: Ceres CLONE 2021531
  misc_feature: Encodes the peptide sequence at SEQ ID NO. 44625
  misc_feature (611)..(611): n is a, c, t, g, unknown, or other
cttggctgcgctgcgggatgcggcggctatggcgatggtaccagcagtgcctggcctcgcacccggtgcgcacgcaggtcgtcagctccggcatcctctggggcctcggcgacatcggcgcccaggccgtcacccactactccgcccgccgccccgacagcctcgacaacaaagcccccgaggataaagataaagataaagagttcaaagttgattggaagagggcaggcatcacaagttcctttggatttgcttttgttggaccagttgggcattactggtatgaatacctggatcgcttcatccggcggagatttcagcctaatacattcaaatttgttgcctcaaaagttgccgcggatggtttcctattcggaccgttagatcttctcttgttcttctcatacgtgggtctcggccaagggaggagcatagagcaggtgaaggaagacgtgaaaagggatttcattcctgctctggtattgggcggaaccatctggccagccgtgcagatcgcaaacttccgcttcatccctgtgcggtaccagctcctgtatgtgaacctgttctgcctcttggacagctgtttcctgtcatggattgagcagcanggagacgcctcctggaagcagtggttcacgtcgttccataaaatcgaaggccataagagtaacgtttgatttcactagttatgggtcatgtgttcttctggatcaacatct

SEQ ID NO: 44625 - protein, 220 aa, Panicum virgatum
  misc_feature: Ceres CLONE 2021531
  misc_feature (131)..(201): Pfam Name: Mpv17_PMP22 Pfam Description: Mpv17 / PMP22 family
  misc_feature (198)..(198): Xaa is any aa, unknown, or other
MRRLWRWYQQCLASHPVRTQVVSSGILWGLGDIGAQAVTHYSARRPDSLDNKAPEDKDKDKEFKVDWKRAGITSSFGFAFVGPVGHYWYEYLDRFIRRRFQPNTFKFVASKVAADGFLFGPLDLLLFFSYVGLGQGRSIEQVKEDVKRDFIPALVLGGTIWPAVQIANFRFIPVRYQLLYVNLFCLLDSCFLSWIEQXGDASWKQWFTSFHKIEGHKSNV

SEQ ID NO: 44626 - DNA, 482 bp, Panicum virgatum
  misc_feature: Ceres CLONE 2021532
  misc_feature: Encodes the peptide sequence at SEQ ID NO. 44627
ggacagccgtgcccggcagctccgctccgccccgccgccgagaatgtccgacgatgccaggcgcggggccgggggcgtcgcgcaggcggcgctccgggcctcctccgaggaccgcaagccggtgggcgcggggtccccgccgccggccgcggcggcgtacaagatccagctcaagagcgccgacatgaaggaggagatgcggcaggaggccttcgaaatcgcccgcatggcgttcgataggcacaccatggagaaggacatcgcggagtacatcaagaaggagttcgacaagaaccacggcccaacctggcactgcatcgtcggccgtaacttcggttcgtatgtaacgcatgaaacaaactactttgtgtacttcttcattgattctaaagccgtcttgctattcaagtctgggtgattggcacagctattgtgatcaccctcgcatgcctgcgtcctgttactctcctgtattgcccccc

SEQ ID NO: 44627 - protein, 124 aa, Panicum virgatum
  misc_feature: Ceres CLONE 2021532
  misc_feature (36)..(124): Pfam Name: Dynein_light Pfam Description: Dynein light chain type 1
MSDDARRGAGGVAQAALRASSEDRKPVGAGSPPPAAAAYKIQLKSADMKEEMRQEAFEIARMAFDRHTMEKDIAEYIKKEFDKNHGPTWHCIVGRNFGSYVTHETNYFVYFFIDSKAVLLFKSG

SEQ ID NO: 44628 - DNA, 708 bp, Panicum virgatum
  misc_feature: Ceres CLONE 2021538
  misc_feature: Encodes the peptide sequence at SEQ ID NO. 44629
aggaaggaagctgcagagagcaccatgaatgcttacaaagctgcccaggatattgccctcgcagatctggctccaacccaccccatcaggcttggcctggcgctcaacttctcggtgttctactatgagatccttaactcccctgaccgtgcttgcaaccttgccaagcaggcttttgatgaggctatctctgagctagacagcctgggtgaggagtcctacaaggacagcactctgatcatgcagctcctccgtgacaacttgaccctatggacatctgacaccaatgaggatggcggtgatgagatcaaggaagctgctgccccgaaggaatccggggacggtcagtaagatggatccaagctcttgacctgatgcatccgctgatgttcgggagcaacaagagctaaagttcctggatttcgatagctaccttctagtatacctaccaccaccgtcgtcgctctgagatgatgatgcattgctgctgtttaatcaagtaccctagatgtctgttatgacgctttgtttcagttttaagttgataaagtgatggctggatgctggttttcatgctccaatcccggccaccagggaaaaaaaacctgctcccgtgttgcagcgttgttagagtgattgcttatgttacttgacctatggagtatttgacaggcctgccgccagtagtattttgttgagttgactttg

SEQ ID NO: 44629 - protein, 116 aa, Panicum virgatum
  misc_feature: Ceres CLONE 2021538
  misc_feature (1)..(99): Pfam Name: 14-3-3 Pfam Description: 14-3-3 protein
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: The sequence is a functional homolog of SEQ ID NO 801 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 404 in the 10/374,780 US patent application
  misc_feature: The sequence is a functional homolog of SEQ ID NO 68 in the 11/375,241 US patent application
  misc_feature: The sequence is a functional homolog of SEQ ID NO 864 in the 10/225,066 US patent application
RKEAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAPKESGDGQ

SEQ ID NO: 44630 - DNA, 561 bp, Panicum virgatum
  misc_feature: Ceres CLONE 2021546
  misc_feature: Encodes the peptide sequence at SEQ ID NO. 44631
ttttatgccattgaaacatttggatctaccggaaagggatttgtcagggaggacttggaatgtagtcattacatgaagaactttgatgttggacatgtacctttgcggttagcaaaggcgaagcaactactcgggaccatcaacaacaactttggaacgctcgctttctgtcgccggtacttggaccgcctcggtgagacgaagtacctcatggctctgaagaatctctgtgataatggtatcgttcagccgtaccctcccctgtgcgatgtgagagggagctacgtctcgcagtttgagcacaccatcctactccggccgacctgcaaagaggtgatttccagaggcgatgactactgagcctccttttagtggagcacacaccgtttttgcgcaacctgtgtaccatctccttatggaccatagtcacatatcacagccagataaataatttcgcactcctgatcaaatgttttgagcctggaatttgttgggtttttttttgacggactgaaattgctaccctgttgaattaatgttggataaccttttgatacgagc

SEQ ID NO: 44631 - protein, 119 aa, Panicum virgatum
  misc_feature: Ceres CLONE 2021546
  misc_feature: SWISSPROT Homolog: EC 3.4.11.18 Methionyl aminopeptidase
FYAIETFGSTGKGFVREDLECSHYMKNFDVGHVPLRLAKAKQLLGTINNNFGTLAFCRRYLDRLGETKYLMALKNLCDNGIVQPYPPLCDVRGSYVSQFEHTILLRPTCKEVISRGDDY

SEQ ID NO: 44632 - DNA, 679 bp, Panicum virgatum
  misc_feature: Ceres CLONE 2021568
  misc_feature: Encodes the peptide sequence at SEQ ID NO. 44633
aactaacgctaaaaaagtaacagtttctgtactttattgtgaggttccacccccacaacaccacccatcatggctgctcgcaccgcgaagctgttcggcaagtgggacttctcggacgtgaacgtgacggacctgtccctcaaggactacatcgccacggcgcccgtgtacgcgccgcactcggcgggccgcttcacgaagcgccgcttccgcaaggcgaagtgcccgatcgttgagcgcctcgccaacggcctcatgttcaccggccgcggcaacggcaagaagctgctcgcggcgcgcatcgtgaagcacaccttcgagatcatcaacctgatgaccgacctgaaccccatccaggtgctcgtcgacgccgtcgccaagggtggcgcccgcgaggactcgacccgtgtcggctccggtggtgtcgtgcgccgccaggcggtcgacgtgtcgccgatgcgccgtgtggacgaggccatctacctgatgtgcaagggtgcgcgcgcgtccgcgttccgcaacctgaagacgatgcccgagtgcctcgccgacgagctcgtgaacgccgccaagggcagctcgaactcgttcgccatcaagaagaaggatgagaccgagcgcgtcgccaaggccaaccgctaaaccatgggccactggaaccgtcacagccatccgctgg

SEQ ID NO: 44633 - protein, 190 aa, Panicum virgatum
  misc_feature: Ceres CLONE 2021568
  misc_feature (35)..(190): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
MAARTAKLFGKWDFSDVNVTDLSLKDYIATAPVYAPHSAGRFTKRRFRKAKCPIVERLANGLMFTGRGNGKKLLAARIVKHTFEIINLMTDLNPIQVLVDAVAKGGAREDSTRVGSGGVVRRQAVDVSPMRRVDEAIYLMCKGARASAFRNLKTMPECLADELVNAAKGSSNSFAIKKKDETERVAKANR

SEQ ID NO: 44634 - DNA, 702 bp, Panicum virgatum
  misc_feature: Ceres CLONE 2021569
  misc_feature: Encodes the peptide sequence at SEQ ID NO. 44635
gaaagtatgaactcgggcgccagcctgctaacaccaagctgtccagcaacaagacagtgaggagggtccgtgtccgtggaggtaatgtgaagtggagggctctacgcctggatactggtaactactcatggggtagcgaggctgttactcgcaagacccgtatcctggatgttgtctacaacgcgtcaaacaatgagcttgttcggacccagacccttgttaagagcgccattgtgcaagttgatgctgccccattcaagcagtggtaccttactcactatggagtggacattggtaggaagaagaaggccccggctgctaagaaggatgctgctgagggtcaagagggtgaggccacagctgaggaaacaaaaaagagtaaccatgtccagaggaagcttgagaagcgccagcagggacgcacacttgacccgcacattgaggagcaatttggcagcggaaggttgttggcatgcattgcttctcgccctgggcagtgtggccgagctgacggttacatccttgagggtaaagagctcgagttctacatgaagaagctccagaggaagaaaggcaagggtgccgcagcttagaaacattatattgtctggaagcgtggcctatcttatcctttactctgggttttgttagttctcaagtatgttatgtcgtgtttgcaacctgatgaaacacccagtgaat

SEQ ID NO: 44635 - protein, 196 aa, Panicum virgatum
  misc_feature: Ceres CLONE 2021569
  misc_feature (1)..(174): Pfam Name: Ribosomal_S8e Pfam Description: Ribosomal protein S8e
KYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAAEGQEGEATAEETKKSNHVQRKLEKRQQGRTLDPHIEEQFGSGRLLACIASRPGQCGRADGYILEGKELEFYMKKLQRKKGKGAAA

SEQ ID NO: 44636 - DNA, 696 bp, Panicum virgatum
  misc_feature: Ceres CLONE 2021571
  misc_feature: Encodes the peptide sequence at SEQ ID NO. 44637
aacaaacgctaaaaaagtaacagtttctgtactttattggcttccgccatgaccgacgccaccgtgaccaagaaggacgcgaacccgatgcgcgagctgcaggtgcagaagctgtgcatcaacatctgcgtcggcgagtccggcgatcgcctcacccgtgcggcgaaggtgctcgagcagctgtgcggccagacccccgtgctgacccgcgccaagctgaccgtgcgtacgttcggcatccgccgtaacgagaagatcgcgtgctgctgcaccgtccgcggtgagaaggccgccgagctcctcgagaagggcctgaaggtcaaggagttcgagctccgcgcgtacaacttcgcccaggacggctcgttcggcttcggcatcaacgagcacatcgatctcggcatcaagtacgacccgtcgactggtatctacggtatggacttcttcgtcgtgctctcccgccgtggcggtcgcgtcgcgaagcgcaagcacgcgcgcgccaccgttggccgctcgcaccgcgtgacccgcgagcacgcgatcaactggttccagaagacgtacgacggcatcgtcttcccgggcaagaagaagcgcacgagcagcggctggaagggcaagaaggggaagaagtaacagacttccctgacttcgggcgtgattggaagctacatctgcaacactctctcatcattc

SEQ ID NO: 44637 - protein, 195 aa, Panicum virgatum
  misc_feature: Ceres CLONE 2021571
  misc_feature (69)..(168): Pfam Name: Ribosomal_L5_C Pfam Description: ribosomal L5P family C-terminus
  misc_feature (12)..(65): Pfam Name: Ribosomal_L5 Pfam Description: Ribosomal protein L5
MTDATVTKKDANPMRELQVQKLCINICVGESGDRLTRAAKVLEQLCGQTPVLTRAKLTVRTFGIRRNEKIACCCTVRGEKAAELLEKGLKVKEFELRAYNFAQDGSFGFGINEHIDLGIKYDPSTGIYGMDFFVVLSRRGGRVAKRKHARATVGRSHRVTREHAINWFQKTYDGIVFPGKKKRTSSGWKGKKGKK

SEQ ID NO: 44638 - DNA, 725 bp, Panicum virgatum
  misc_feature: Ceres CLONE 2021577
  misc_feature: Encodes the peptide sequence at SEQ ID NO. 44639
gagagagagacagaggtgaggaaaggcgaagctcctcctcctcctcgcccacgacgatggcgatgaccgtcgaagtgctggctggactcgcatttatgttctccacgagcattctgctgcaaatactggcatgtgctttgtacaacaactggtggcctatgttagcagctctcatgtatgtccttataccaatgccatgcctgttttttggtggtggatccacacactttttgacaagcagagaaggtggagggtggattaatgctgcaaaattcctgactggtgcatctgccatgggaagcctcgctatcccagctattctgaggcacgcgggcctaattgagaccggtgccatgtttatcgagttcacatccttcttcatccttgtatgcacggtcctgtgcttccatagggctaccctagatgaagattggtaaatgtgcatgcacggaccccagaagaatagcaattctgtggccgcctctctccatgctaagcagaaaaattccagttggaagttaacaattagcatggatctgtacaaagaagtgtatttgaatcccctcgctgatgttttatataggcactgtttaagatctgtggtgatgtggcaaggcagatgttatttcgatcactttgtcatcgtagtcgcatgtttctgtggcgaaggaacccaatctgtgcaaaacatgtgcaagagcctgtacacgatacaccatagtact

SEQ ID NO: 44639 - protein, 126 aa, Panicum virgatum
  misc_feature: Ceres CLONE 2021577
  misc_feature (8)..(124): Pfam Name: Vps55 Pfam Description: Vacuolar protein sorting 55
MAMTVEVLAGLAFMFSTSILLQILACALYNNWWPMLAALMYVLIPMPCLFFGGGSTHFLTSREGGGWINAAKFLTGASAMGSLAIPAILRHAGLIETGAMFIEFTSFFILVCTVLCFHRATLDEDW

SEQ ID NO: 44640 - DNA, 574 bp, Panicum virgatum
  misc_feature: Ceres CLONE 2021578
  misc_feature: Encodes the peptide sequence at SEQ ID NO. 44641
accaccccacccaggcacccagcgtcatctcatccgccgtttgcccgctgcgagaattcctttcacctcacctcactctgagtctgagcgcgcggccgcactcaagcgagcgagcacgggcgaaatggcgcgccacgccgggaagcccctcctcgcgctcctcgtgctgtccggcctcctcctcctcccgctcgtcgcctccgtccccttgccaagaagcctgcgcctggggaacccgcagcagcgcccgccggctctgaagcttgcttcttctcaggaggcggcgatggcggcgtggaacctcggcagcaggcaggcggcgaggatggccgtggaggtgaacgactaccaaccgtccggccccaacaaccgccatgacccgcccaagggtcccgggagagcgtgaacagtggggggggggggggggggggtgtcgtggtgtggcgtgtggattgaaacaataaaaaatgtgtgaaccggttgatcgtggagtgtgtgtgtgctgtagcttatccgatggatgcatgtcgatcggcctattgtagctgtgctcgaaatggagagaacttaatta

SEQ ID NO: 44641 - protein, 93 aa, Panicum virgatum
  misc_feature: Ceres CLONE 2021578
  misc_feature: Functional homolog of the protein sequence given in SEQ ID NO 50820
  misc_feature: Useful for making plants with modulated flowering time
MARHAGKPLLALLVLSGLLLLPLVASVPLPRSLRLGNPQQRPPALKLASSQEAAMAAWNLGSRQAARMAVEVNDYQPSGPNNRHDPPKGPGRA

SEQ ID NO: 44642 - DNA, 667 bp, Panicum virgatum
  misc_feature: Ceres CLONE 2021604
  misc_feature: Encodes the peptide sequence at SEQ ID NO. 44643
aagccttcttcctccccgctcccacaaccccatcctcaccgtcaccggcggtcccaagcgcgggctcacccccttcttcgcgtttctggctgagttcaggccgcagtacctggagaagcaccctgagctcaagggcgtaaaggaggtttccaaggcggctggggagaagtggcgctctatgtccgatgaggagaaggcgaagtatggcgggggcaagaaacagcaggaagacaaggcaagcaagcccgcaaacaagaaaaaggagagcaatagctccaagaaggccaagactgatggtggggagggagaggaagcggaaggttctgacaagtccaagtctgaggttgaggatgatgatgagcaggatggcaacgaggatgaagatgaggagtaaatattaggatggggaacagcagctatgcaatagggcgtttgcttcttttgtacctagcttcctatgccgctgttccttttgatgttatatgctgtaaggagaatttgtagacggaaggtgccctagggctatgacatgctggagtacccgtttaactattagcagggaaagagctggatactgttgccagcctcatccgcatgtgtaaacagttgttttgcttgttttatcgaccgattgggtgactacctgttggtttgccgttaatgttct

SEQ ID NO: 44643 - protein, 130 aa, Panicum virgatum
  misc_feature: Ceres CLONE 2021604
  misc_feature (18)..(85): Pfam Name: HMG_box Pfam Description: HMG (high mobility group) box
SLLPPRSHNPILTVTGGPKRGLTPFFAFLAEFRPQYLEKHPELKGVKEVSKAAGEKWRSMSDEEKAKYGGGKKQQEDKASKPANKKKESNSSKKAKTDGGEGEEAEGSDKSKSEVEDDDEQDGNEDEDEE

SEQ ID NO: 44644 - DNA, 194 bp, Panicum virgatum
  misc_feature: Ceres CLONE 2021613
  misc_feature: Encodes the peptide sequence at SEQ ID NO. 44645
gtgctctcttcagaggtgggttggcttctcctccccctccggttcggttcggttcgggttcgtgaggttcttggggttccgttcgggggcgagaggaagagatggaggcgtcggatgttgagtaccgctgcttcctcggcggccttgcctgggccaccgacgacaactcgctccacaacgccttcagcacctac

SEQ ID NO: 44645 - protein, 30 aa, Panicum virgatum
  misc_feature: Ceres CLONE 2021613
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MEASDVEYRCFLGGLAWATDDNSLHNAFST

SEQ ID NO: 44646 - DNA, 642 bp, Panicum virgatum
  misc_feature: Ceres CLONE 2021618
  misc_feature: Encodes the peptide sequence at SEQ ID NO. 44647
tagtcgaaggattaaaaaagttgggtgttcatccagtgatgctcacaggggataactggagaaccgcccaagctgttgcaaaagaggttggcatcgaggacgtgcgagcagaggtcatgccagctggaaaagccgacgtcgttcgctccctccaaaaggacgggagcatcgtcgccatggtcggggacggcatcaacgactccccggccctggcggcagccgacgtcgggatggccatcggcgagggcacggacatcgccatcgaggcggcggactacgtgctggtgcggaacaacctggaggacgtgatcaccgcgatcgacctctccaggaagacgttcagccggatccggtggaactacttcttcgcgatggcctacaacgtggtcgccatcccggtcgccgcgggcgcgctgttcccgttcaccgggctccagatgccgccgtggctggccggcgcctgcatggccttctcgtccgtgagcgtggtgtgctcgtcgctgctgctgaggaggtaccgaaaacccaggctgaccaccgtgttgcagataactgtagagtgattgatgtgagttgtgaatactacagtagcttccttaaccgccttacggaaatgaaatggaagttgcggcggaaatggcg

SEQ ID NO: 44647 - protein, 186 aa, Panicum virgatum
  misc_feature: Ceres CLONE 2021618
  misc_feature: SWISSPROT Homolog: EC 3.6.3.4 Copper-exporting ATPase
VEGLKKLGVHPVMLTGDNWRTAQAVAKEVGIEDVRAEVMPAGKADVVRSLQKDGSIVAMVGDGINDSPALAAADVGMAIGEGTDIAIEAADYVLVRNNLEDVITAIDLSRKTFSRIRWNYFFAMAYNVVAIPVAAGALFPFTGLQMPPWLAGACMAFSSVSVVCSSLLLRRYRKPRLTTVLQITVE

SEQ ID NO: 44648 - DNA, 654 bp, Panicum virgatum
  misc_feature: Ceres CLONE 2021630
  misc_feature: Encodes the peptide sequence at SEQ ID NO. 44649
agaaaccctagacaccgctcaaaaaaaaaaaagacaccgctcgagccgttcgccgccgcgccgcgccgctccgctcgtcttctcgggctctctccctcccggatccagcaggatgaagtttgttgctgcctatctgcttgctgtcctcgctggcaaccccagcccctctgctgaggatctatcgtccattctggaatcagttggctgtgaaattgacaatgaaaagatggagctgctgctgtcccaactgagcggcaaagacattaccgagctcattgctgctggcagggagaagtttgcttcagtcccatgcggtggtggtggtgtggctgtggcagcagctgcccctgctgctggtggagctgctcctgcatctgaggccaagaaagaagagaaggtggaggagaaggaagagagtgatgatgatatgggcttcagcctcttcgactaagctgtgcggtcaccagagttgtcttttcggcaggaaaaccagagtcgccatgtttggagtttaaccttgttttatgttgcaaagcacccgaaaagactgctacagtctggatatgtagtgattcagccataggttgctacattggttgttggtgtttactggtgaaccagagtttatgcatcatatattaagaatcagttacc

SEQ ID NO: 44649 - protein, 112 aa, Panicum virgatum
  misc_feature: Ceres CLONE 2021630
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MKFVAAYLLAVLAGNPSPSAEDLSSILESVGCEIDNEKMELLLSQLSGKDITELIAAGREKFASVPCGGGGVAVAAAAPAAGGAAPASEAKKEEKVEEKEESDDDMGFSLFD

SEQ ID NO: 44650 - DNA, 495 bp, Panicum virgatum
  misc_feature: Ceres CLONE 2021633
  misc_feature: Encodes the peptide sequence at SEQ ID NO. 44651
aaaatcgtcttcttgcttgccaatccgacgcaccacctaagcacatcggcggcgaagaagcgatgggcgtcaccaaggaggacgtcgaggcggccatcacctccgctctcagcccttcccatctcgtggtgacggatacatctggagggtgtggcgcgagctatgagatcgaggtggtgtcggagaagttcgaggggaagcggctgctggagcggcaccggttggtgaacacggcgctggcgccgcacatggcggagatccacgccgtctccatcaagaaggcgctcactccggcgcaggcccaaccccagccggagccggccgccgataagccccaggcttaagtgcttaactcgcttcaaacagtttgatcacatatgcaccatgagtcaagcttatctctgttgtagtatgtggtctctgatacattaactactggttgaataatgtagcagacgcaattgcaaaattgcaggatgttatgcttgactgctt

SEQ ID NO: 44651 - protein, 93 aa, Panicum virgatum
  misc_feature: Ceres CLONE 2021633
  misc_feature (3)..(80): Pfam Name: BolA Pfam Description: BolA-like protein
MGVTKEDVEAAITSALSPSHLVVTDTSGGCGASYEIEVVSEKFEGKRLLERHRLVNTALAPHMAEIHAVSIKKALTPAQAQPQPEPAADKPQA

SEQ ID NO: 44652 - DNA, 484 bp, Panicum virgatum
  misc_feature: Ceres CLONE 2021645
  misc_feature: Encodes the peptide sequence at SEQ ID NO. 44653
ctcaccagcgcttgcaacagctcatccatccagcaccgtatcgtgccctcatcacgttcgcgcacaatggatcgtgctcagcaggtcgtggcgatcgccttcgttgccgccgtcgaagctgctcgcccccgcggccacctccgaggccgccgtgacctgcgggcaggtcaactccgccatcggcccctgcctcgcctacgcccgcgggtacggctccgggccctcctcggcctgctgcagcggagtcaggagcctcaactccgccgccaggagcaccgccgacaggcgcgccgcatgccactgcctcaagtccgccgcaggcagggtgagcggcctcaacgccggccacgccgccagcatcccgtccaagtgcggagtcagcttcccctacaccatcaacccatccgtcgactgccgctctgactgtaccatgatcaagtaatgctagctgtatataaacagaaacaaaaaaaactaatctaat

SEQ ID NO: 44653 - protein, 146 aa, Panicum virgatum
  misc_feature: Ceres CLONE 2021645
  misc_feature (53)..(138): Pfam Name: Tryp_alpha_amyl Pfam Description: Protease inhibitor/seed storage/LTP family
SPALATAHPSSTVSCPHHVRAQWIVLSRSWRSPSLPPSKLLAPAATSEAAVTCGQVNSAIGPCLAYARGYGSGPSSACCSGVRSLNSAARSTADRRAACHCLKSAAGRVSGLNAGHAASIPSKCGVSFPYTINPSVDCRSDCTMIK

SEQ ID NO: 44654 - DNA, 523 bp, Panicum virgatum
  misc_feature: Ceres CLONE 2021658
  misc_feature: Encodes the peptide sequence at SEQ ID NO. 44655
aaattaatctaaaaattagttaagcatacacaaatgggtaagcaacctgctgctggtcaaaaatccaaagaagccaagtccaaggctgcctctcaatcctccaaggctaagggatccaaggtcaagaaggttgactccagagttagagaaaaggcaaatctcgctgtcttcctcgacaaggccacctacgaaaaggctaaggctgatgtccccaagatgaagctcatcaccgtctccactgttgttgatagacttaaggtcaacggttccatcgccagaaaggtcatcagacaccttgctgaccaaaagctcatcaagaaggtctcttatcacagcagccaatacatcttcaccaccctcaaggacgttaccgcctaaataaatcttatcgagtgaccttgtgctttgataatggcttggatgtttttatatttttagtaaacgttgctacgcctgcatgaaatcgatattgccttctgtcctacctataaaacttccatagactgaataacgaggcttagtt

SEQ ID NO: 44655 - protein, 114 aa, Panicum virgatum
  misc_feature: Ceres CLONE 2021658
  misc_feature (6)..(110): Pfam Name: Ribosomal_S25 Pfam Description: S25 ribosomal protein
MGKQPAAGQKSKEAKSKAASQSSKAKGSKVKKVDSRVREKANLAVFLDKATYEKAKADVPKMKLITVSTVVDRLKVNGSIARKVIRHLADQKLIKKVSYHSSQYIFTTLKDVTA

SEQ ID NO: 44656 - DNA, 592 bp, Panicum virgatum
  misc_feature: Ceres CLONE 2021671
  misc_feature: Encodes the peptide sequence at SEQ ID NO. 44657
ggctttgacgaatcatacacctatttagaaaacgccatctctgaggttggaaacttccatggaatccttggcttctctcaaggcgccgccatggccgcattgttttgcacgcagcagcacaagacatgtggtgctcccaagttcaggtttgggatgttctgctccgggtatccagcaccggaggacgatttcgatggctaaccaatcaagctcccctcgcttcattgttttggcaactgtgaacgccatgacaggcagatagcgaacacggcaagcgccgaacttgccggtctgtttcatcacgattgctgctctgtggttgagcatgatatgggacacataatccccacccggtcgccctacatccatcaaataaaggatttcctgtccattttcctatgaaatgttttcatgtgattgtattctgttgtaagttgctggtgcacacgagttacgttctgaatggcatccaccgtgttttctattaactactaatgttttcccatctgattgtgggaaacaaattgagtaccatactgagaggattactggtgcttcgacatcacaatgtctagaaatcatacatgttggt

SEQ ID NO: 44657 - protein, 66 aa, Panicum virgatum
  misc_feature: Ceres CLONE 2021671
  misc_feature: SWISSPROT Homolog: EC 1.5.1.3 Dihydrofolate reductase
GFDESYTYLENAISEVGNFHGILGFSQGAAMAALFCTQQHKTCGAPKFRFGMFCSGYPAPEDDFDG

SEQ ID NO: 44658 - DNA, 507 bp, Panicum virgatum
  misc_feature: Ceres CLONE 2021677
  misc_feature: Encodes the peptide sequence at SEQ ID NO. 44659
gaggaagcagaatattactggtgtctaccactactggcagaatctgaacgccaacaggcaattatggaaattagggacacttcctgctggtcttgtcacattctggaaccacacattccccctcgatcgctcatggcatctcttgggtctagggtacaagccgaacgtcaaccaaagggatgtcgagcgcgcagctgttatacactacaacgggaatcgaaaaccttggcttgagattggactgccagtataccgccaattctggtccaagtatgtaaattttgataatgtttatctacgcgaatgcaacataaacccgtgagatattgcttttagcactgtatgatagttctttatttttttatatcgatgtataataagtgatgtagagcgcctttttttgttggtcaaatgtcacggccataaatcatagtacaagccatagcaggctgtagaataagatatctgatagtttccttaaaaaaaaagatatctgatagagttatc

SEQ ID NO: 44659 - protein, 106 aa, Panicum virgatum
  misc_feature: Ceres CLONE 2021677
  misc_feature: Functional homolog of the protein sequence given in SEQ ID NO 51693
  misc_feature: Useful for making plants with altered cell wall content and/or composition
  misc_feature: Functional homolog of the protein sequence given in SEQ ID NO 51694
  misc_feature: Useful for making plants with altered carbohydrate content
RKQNITGVYHYWQNLNANRQLWKLGTLPAGLVTFWNHTFPLDRSWHLLGLGYKPNVNQRDVERAAVIHYNGNRKPWLEIGLPVYRQFWSKYVNFDNVYLRECNINP

SEQ ID NO: 44660 - DNA, 580 bp, Panicum virgatum
  misc_feature: Ceres CLONE 2021680
  misc_feature: Encodes the peptide sequence at SEQ ID NO. 44661
tgaaaaaagtcaaatcaccacgacaaacttctaacagatggccgctgaacttgcacctttcgaaaaagtcggacaagcctttctcggcgcatacttcaagcgaatggttgaggccagatcaacgatcggtagtctttatggacccaactctctcctcacatttgagggaaccaaagtcaagggtgccgagaacatctcaaagaagctgaatagccagcccaagatgcagttcagaagagacaagatcgatatccaaccctcagggcaaggtgtattgattgtcgtcacgggaatggtcaagatcgagggcgaagccaaccctgtcaagttttcgcagacattcattctatctccgatcccgggcaaggcaggcagcttcttttgcagcaacgaaatcttccgcttcaactacggcgcctaactctgtatttgtcttcacttcatcttctctcgcactctgctttgcaggagcaaatccccgaagtgcttggtctgaaccggtttttaaagagtccacaagcctttcccgaggtgccagaaattcctaaacttcgctgaccgttcaaaggtcgcccctacc

SEQ ID NO: 44661 - protein, 127 aa, Panicum virgatum
  misc_feature: Ceres CLONE 2021680
  misc_feature (11)..(123): Pfam Name: NTF2 Pfam Description: Nuclear transport factor 2 (NTF2) domain
MAAELAPFEKVGQAFLGAYFKRMVEARSTIGSLYGPNSLLTFEGTKVKGAENISKKLNSQPKMQFRRDKIDIQPSGQGVLIVVTGMVKIEGEANPVKFSQTFILSPIPGKAGSFFCSNEIFRFNYGA

SEQ ID NO: 44662 - DNA, 532 bp, Panicum virgatum
  misc_feature: Ceres CLONE 2021686
  misc_feature: Encodes the peptide sequence at SEQ ID NO. 44663
ctcctccgccgtcgcctctccactttccccatccttcgccgccgtcgcggtcgcctcgcagtccgaagagccgcccccgactccgatggccagccgctgggtccgacccgaggtgtacccgctgttcgcggcgatgggcgtggccgtcggcatctgcggatttcagctcttccggaacatcaccgggaacccggaagtcagggtaaacaaggcagggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgctattgtcgagtatacccatttaaggcattcaatatgtaatgtcacccataaattggaggacagaggatacctcttattaaaagtaccgtgtgagtgattggtgaatggtgatggcttgctatgtgtatgatggtttatgagcgctgcatc

SEQ ID NO: 44663 - protein, 87 aa, Panicum virgatum; identical to SEQ ID NO: 39802
  misc_feature: Ceres CLONE 2021686
  misc_feature (2)..(87): Pfam Name: B12D Pfam Description: B12D protein

SEQ ID NO: 44664 - DNA, 494 bp, Panicum virgatum
  misc_feature: Ceres CLONE 2021695
  misc_feature: Encodes the peptide sequence at SEQ ID NO. 44665
gaaaccctagcattcctcacgctgcgccgccgacggtaagacccaagagaacccttcgtcgtctccctcctgcgtgattaggagcaggagccagaagagggatctgcgatggccaagtcaaagaaccacacggcgcacaaccagtcgtacaaggcgcacaagaacggcatcaagaagcccaagcgccaccgtcagacctccactaacgggatggacccaaagttcctgaggaacctgaggtactcgaggaagaacaacaataagagtggtgaggctgaggctgaggctgaggagtaaactggtggaatttcagatgatgaattcctgtcttgtatcgctaggatcttgaacttaatgctctgttctgtatgaccaaaggagattcctcagttggtaccattttttttttgtcttgctgtctggctggatttgaattaaaaccgtcatttgcagccttatgagaattgggaacccgagtatgtcgttctagtttc

SEQ ID NO: 44665 - protein, 62 aa, Panicum virgatum
  misc_feature: Ceres CLONE 2021695
  misc_feature (3)..(42): Pfam Name: Ribosomal_L29e Pfam Description: Ribosomal L29e protein family
MAKSKNHTAHNQSYKAHKNGIKKPKRHRQTSTNGMDPKFLRNLRYSRKNNNKSGEAEAEAEE

SEQ ID NO: 44666 - DNA, 741 bp, Panicum virgatum
  misc_feature: Ceres CLONE 2021696
  misc_feature: Encodes the peptide sequence at SEQ ID NO. 44667
atcccaagcagcagctagcatcaatataatggccacctcctcctcctcgttgaccctcctgctgctggtcctgggcgcctccttggcagccagcgccagcgccgcgaccttcaccatcaccaacaactgtgggttcacggtgtggccggcggcgacgcccgtgggcgggggcacgcagctgaaccgaggcgggacgtggaccgtcaacgtgccggcgggcaccagctccggccgcgtgtgggcacgcacgggctgctccttcaacggcaaccgcgggagctgccagacgggcgactgcggcggcgcgctcgcctgcacgctgtccggccagccgccgctgacgctggccgagttcaccatcggcggcagccaggacttctacgacatctcggtcatcgacggcttcaacgtcggcatggccttctcctgcagcaccggcgtcgggctggtgtgcagggactccggatgccctgacgcgtaccacaaccccaacgacgtcaagacccatgcctgtggcggcaacagcaactaccgggtcaccttctgcccgtgatcgatgagatgaggctgccgtaataatgtatcaagtgattatatatatttgcagcaggaagaataatgcggacgcatcgtgcacggtatactgattgtgagagtagctacacacgagtgtagataaaactcgtccatatatatgtagctggatctgtgtacgtatactctgtatacagtataccatat

SEQ ID NO: 44667 - protein, 174 aa, Panicum virgatum
  misc_feature: Ceres CLONE 2021696
  misc_feature (32)..(174): Pfam Name: Thaumatin Pfam Description: Thaumatin family
MATSSSSLTLLLLVLGASLAASASAATFTITNNCGFTVWPAATPVGGGTQLNRGGTWTVNVPAGTSSGRVWARTGCSFNGNRGSCQTGDCGGALACTLSGQPPLTLAEFTIGGSQDFYDISVIDGFNVGMAFSCSTGVGLVCRDSGCPDAYHNPNDVKTHACGGNSNYRVTFCP

SEQ ID NO: 44668 - DNA, 403 bp, Panicum virgatum
  misc_feature: Ceres CLONE 2021703
  misc_feature: Encodes the peptide sequence at SEQ ID NO. 44669
agatgtcaagaataaaaaaggggaggtggagtaccgggtgtcaaaagcgagcctggaagatcgtcggagcaccgatacccttctttccagccgtgccatctgcagagactgcagggttctcacgatccacggcgccaaagacgagatcgtcccggcggaggacgcccggcggttcgcggcgaacgtccccaaccacgagctgcgcatcatcgccgaggccaaccaccggttcgccggccacgagcgggagctgacctcgctcgtgctgggcttcgtcaggccccatctccagagcacgccgcccttgcgtccgaaactgtagaacgctgcgagaccagccgtgaacgaacctgatgaaattccttggttccgatcccaattgagatggcgttatctggactcg

SEQ ID NO: 44669 - protein, 106 aa, Panicum virgatum
  misc_feature: Ceres CLONE 2021703
  misc_feature: SWISSPROT Homolog: EC 3.1.1.2 Arylesterase
DVKNKKGEVEYRVSKASLEDRRSTDTLLSSRAICRDCRVLTIHGAKDEIVPAEDARRFAANVPNHELRIIAEANHRFAGHERELTSLVLGFVRPHLQSTPPLRPKL

SEQ ID NO: 44670 - DNA, 708 bp, Panicum virgatum
  misc_feature: Ceres CLONE 2021715
  misc_feature: Encodes the peptide sequence at SEQ ID NO. 44671
gagcgaacgcggagaatagaaaaggattcctccaattcggaaaccggaaagaccagaagaatccggaggcagctccaggatcgtgggcgatgctgcgcgcgagggcgtaccacgagcgggtggtggaccactacaacaaccctaggaacgtggggtcgttcgacaaggacgaccccaacgtcggcaccgggctggtcggcgcgccggcctgcggcgacgtcatgaagatgcagatccgcgtcgacgaggactccggcaagatcgtcgacgcctgcttcaagaccttcggctgcggctccgccatagcgtcctcatccgtggctactgaatgggtgaagggaaaaccaatggatgaagttttgactatcaagaacactgagattgcaaagcacttgtcgcttccaccagtaaagctccactgcagcatgcttgcagaggatgcgattaaggctgctgtgaaggactacgaagccaagaaggcgaagatggggcaaaagggcgaagacagcccttcggagaaggctgctgaagcatgaacgtgaagtttctgccatgaagacacggcacttgcatattttgattcccgaatccaccatcatgcatctgcaaagataaatgctactggccgtaaggtgggggattatgtgtaatgttcacaaactctggtactgcagcatgtatcataactcgggtacggagagggacaat

SEQ ID NO: 44671 - protein, 177 aa, Panicum virgatum
  misc_feature: Ceres CLONE 2021715
  misc_feature (35)..(162): Pfam Name: NifU_N Pfam Description: NifU-like N terminal domain
ANAENRKGFLQFGNRKDQKNPEAAPGSWAMLRARAYHERVVDHYNNPRNVGSFDKDDPNVGTGLVGAPACGDVMKMQIRVDEDSGKIVDACFKTFGCGSAIASSSVATEWVKGKPMDEVLTIKNTEIAKHLSLPPVKLHCSMLAEDAIKAAVKDYEAKKAKMGQKGEDSPSEKAAEA

SEQ ID NO: 44672 - DNA, 707 bp, Panicum virgatum
  misc_feature: Ceres CLONE 2021728
  misc_feature: Encodes the peptide sequence at SEQ ID NO. 44673
agcacacacacaatcacccaacaaagactctcatcagtgaccagtaagtcttcagttcttcaaccgacttgtagccaccatggttgtcggcaaagtcacactggagtactcggtggccgtgtcggtcgagctgctgtggaaggtggtcttctccggcgacgtgtccatcctcaccaaggcctgcgtcggaatgatcgacgcagtagaggtcgaaggcgacggcgggcctgggagcgtcaccaccatgaagctcaaccctgccgtgggcgacgcaaaggtgttcaagaccaaactcctgtcccgcgatgcggcggcgcgcgtggtgaagtcggagatggtggtggagggcagcgagctggccgtgaagtataagtcgcaggtatccgaggtgaaggtggtgccggccggcgagggcgctagcgtggtgcacatgacggtggagtatgagctggtggacagcacgctgctgccgccggaggaggaggccaggattgggcagggctacctcggcctcatcaagaaggtggaggagtacctcgtcgcacaccccagcgagttcgcctaaagctaccataagcatcatcgtggcgatggggctagagaaatccgtgttaaataatgatggtgatcatgccatgggtatgttcttgatttgaaaatcggaaatacgagaggaaatgatcctctgcctggtcggtcgattgtgc

SEQ ID NO: 44673 - protein, 161 aa, Panicum virgatum
  misc_feature: Ceres CLONE 2021728
  misc_feature (1)..(156): Pfam Name: Bet_v_I Pfam Description: Pathogenesis-related protein Bet v I family
MVVGKVTLEYSVAVSVELLWKVVFSGDVSILTKACVGMIDAVEVEGDGGPGSVTTMKLNPAVGDAKVFKTKLLSRDAAARVVKSEMVVEGSELAVKYKSQVSEVKVVPAGEGASVVHMTVEYELVDSTLLPPEEEARIGQGYLGLIKKVEEYLVAHPSEFA

SEQ ID NO: 44674 - DNA, 639 bp, Panicum virgatum
  misc_feature: Ceres CLONE 2021744
  misc_feature: Encodes the peptide sequence at SEQ ID NO. 44675
atatcttgatgaagttgtgtgcacacggcacccccctcccattagatctagcttcgccccctgccctccctccctcccggatccaggatgaagtttgttgctgcctaccttcttgctgtccttgctggcaaccccagcccctctgcagaggacttgtcgtctattctggaatcagttggctgtgaaattgataatgaaaagatggagctcctgctgtcccagctgagtggcaaggacattacggagctcattgctgcgggtagggagaagtttgcttccgtcccatgcggcggcggcggtgtggctgttgcggcagctgccccagctgctggtggtgctgctcctgcagctgaggcgaagaaggaagagaaggtggaggagaaggaagaaagtgatgatgacatgggcttcagcctcttcgattaggcttttgcagtcatcagagctgtcatttttggttaggaaaacccagagtcgtgctgtttggatttgaaccttgctttattttgcaaatcactggagaggctgctgctgtcttgcaatatatgaagtaattcagctgtaggttgctatgctggttggggtttactggtgaaccagagttttccctatcgcatgtatctgatgaattggttgccc

SEQ ID NO: 44675 - protein, 112 aa, Panicum virgatum; identical to SEQ ID NO: 27985
  misc_feature: Ceres CLONE 2021744
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 44676 - DNA, 479 bp, Panicum virgatum
  misc_feature: Ceres CLONE 2021745
  misc_feature: Encodes the peptide sequence at SEQ ID NO. 44677
aaaaaagcttttaaaaaattattcattaggttttaaccatgagccacatcagactcgacagagaaggtacctacaacgataagggagaactcattgatctctatatccccagaaagtgtgctgccaccaacaagatcatccatgctaaggataaatcctctgttcaattgaacatcgctgaagttgatgaggccactggtaaagccactggcaagaagattatatacggcctttccggcttcgtcagaagcatcggcagagctaacgctgaagtcgaaaacttgttggccagagacggtcttatgccattcaaggagtaaatacccatttacctgtctctttgtacgttcttaatatcattcgcatcatggagatagacgaagcttgaggacttgcatgatggttcgtcttttgaattgtatgaccctgcattgataaacccgaacatagaattaaatagatctagactgctataattc

SEQ ID NO: 44677 - protein, 93 aa, Panicum virgatum
  misc_feature: Ceres CLONE 2021745
  misc_feature (13)..(92): Pfam Name: Ribosomal_S21e Pfam Description: Ribosomal protein S21e
MSHIRLDREGTYNDKGELIDLYIPRKCAATNKIIHAKDKSSVQLNIAEVDEATGKATGKKIIYGLSGFVRSIGRANAEVENLLARDGLMPFKE

SEQ ID NO: 44678 - DNA, 618 bp, Panicum virgatum
  misc_feature: Ceres CLONE 2021750
  misc_feature: Encodes the peptide sequence at SEQ ID NO. 44679
gggtgagactattttccccgatgcaaatgtgaacagcagttcattaccatggtataatgagctttcagaatgtgctagaagaggtctctctgtcaaaccaaagatgggagatgctcttcttttctatagcatgaaaccagatgccactttggacccattgagtttacatggaggttgtcctgtgattaaaggaaataaatggtcgtcaaccaagtggatgcatatccatgagtacaaagcttgagccttctaaagtcaacttaccaaagatggatctctatgtccttgtggcttggggttcttttcaggatggccggccactcatgtacgctttactggagttgtattctttactcctggatggaggagatgatggggccaataagcaggggcttgagttgcccttgcagtatttttgggagtgatcctagctgacttggctttcctttccttttcttcccttgcagtaccccaactatagagcaatgatgttagtgtttgggggtatagaatttggaatttcgtttttgtgctttaccggtgggtgatattagtaccagaatgctgtattgttatgggtataagctgtgttactaatgaataaagaggcgtagagct

SEQ ID NO: 44679 - protein, 80 aa, Panicum virgatum
  misc_feature: Ceres CLONE 2021750
  misc_feature: SWISSPROT Homolog: EC 1.14.11.2 Procollagen-proline dioxygenase
GETIFPDANVNSSSLPWYNELSECARRGLSVKPKMGDALLFYSMKPDATLDPLSLHGGCPVIKGNKWSSTKWMHIHEYKA

SEQ ID NO: 44680 - DNA, 526 bp, Panicum virgatum
  misc_feature: Ceres CLONE 2021754
  misc_feature: Encodes the peptide sequence at SEQ ID NO. 44681
ccttttttcctcatcatggctgacgagcaaactactcctagaaagagaactttccgtaagtttacctaccgtggtatcgaccttgaacaactcttggacttgtcttctgaacagttcatggagctcgttcactgccgtgctcgcagaagattccaacgtggtcttaagcgtaagcctatgggtctcatcaagaagctccgtgctgccaagaagaacgctgcccctggtgagaagcctgaggtcgtcaagacccacctccgtaacatgatcatcgttcctgagatgatcggttccgtcattggtatctacaacggtaaggtcttcaaccaagttgaaatcaagcctgagatgactggtcactacctcgctgagttctccatctcttacaagcctgtcaagcacggacgacccggaattggtgctactcactcttccaagtttgttcccctcaagtaaattcgacaaacagagaaagaaaaacgaatcgatcaaaaagagagcaagttgcatttttgctctttctttt

SEQ ID NO: 44681 - protein, 146 aa, Panicum virgatum
  misc_feature: Ceres CLONE 2021754
  misc_feature (48)..(129): Pfam Name: Ribosomal_S19 Pfam Description: Ribosomal protein S19
MADEQTTPRKRTFRKFTYRGIDLEQLLDLSSEQFMELVHCRARRRFQRGLKRKPMGLIKKLRAAKKNAAPGEKPEVVKTHLRNMIIVPEMIGSVIGIYNGKVFNQVEIKPEMTGHYLAEFSISYKPVKHGRPGIGATHSSKFVPLK

SEQ ID NO: 44682 - DNA, 580 bp, Panicum virgatum
  misc_feature: Ceres CLONE 2021761
  misc_feature: Encodes the peptide sequence at SEQ ID NO. 44683
agctccacgccacgcctctcggctcgccatggccacggcatctacgcgggcgcacggtggcggccaccaacaccagcagctgccgccgccgcaatcccacgggctgcgatacgagccgctgcgccgcatgcggggcctggaactgaaggccgcgctccgtgccaggagcccgcgcgcgtccacagtggccacgggcgcgctcctcgtcccgctcggcgccgcactgctgggagcctcggggttagcactggctgcaaccctggcggggctcgcgctggccgcgccgctcctcgtgctcttcagcccggagatcgtgcccaccgagcaggacgaggatcacgacgtgtcgggcttcctggcgtcgggcgggctcggagtcgcgggcgtctcggtgctcgcgtgggcctccggatacgtatggcggggcggcggaggcaccggtgggggcctcacggggatggtggtgcagccgctggaccacggggaaaaacggcgcggcgcataaagccccgcggcattcttcggccaccggccccgggacatcgacatcgacaaggcgcgcggagtgtcctcagtgctg

SEQ ID NO: 44683 - protein, 158 aa, Panicum virgatum
  misc_feature: Ceres CLONE 2021761
  misc_feature (49)..(155): Pfam Name: Oleosin Pfam Description: Oleosin
MATASTRAHGGGHQHQQLPPPQSHGLRYEPLRRMRGLELKAALRARSPRASTVATGALLVPLGAALLGASGLALAATLAGLALAAPLLVLFSPEIVPTEQDEDHDVSGFLASGGLGVAGVSVLAWASGYVWRGGGGTGGGLTGMVVQPLDHGEKRRGA

SEQ ID NO: 44684 - DNA, 538 bp, Panicum virgatum
  misc_feature: Ceres CLONE 2021762
  misc_feature: Encodes the peptide sequence at SEQ ID NO. 44685
agccgcaagcgcccggctcgtcgccgtccgctacgcctgctcgtcttcatcccgcacggccgccaggcgtccgcgacttcgacggcaaccacacaccagcagggcaagaggctagcgataggttcaacataaattctcagcttgagcatcttcaagccaaatatgttggcacaggacacgcggacttgaccagatttgaatgggctgtaaacatccagagggacagctatgcctcttatattgggcactatccaatgctggcatattttgctattgctgaaaatgaatcaattggaagagagcgttacaattttatgcagaaaatgctgcttccatgtggcctccctcctgagagagatgaagactgaggagcctctgcatgatcctgatgcatcacaagagtaacttgtcttgaactcaggtttgctaccgaagtaaaagggggcgaggctagtagcatctgtgtctctgttggaaaattttgaattccctgatcgtgtattggacgcttctagcttatcctacatggatatttatc

SEQ ID NO: 44685 - protein, 121 aa, Panicum virgatum
  misc_feature: Ceres CLONE 2021762
  misc_feature (39)..(121): Pfam Name: SF3b10 Pfam Description: Splicing factor 3B subunit 10 (SF3b10)
PQAPGSSPSATPARLHPARPPGVRDFDGNHTPAGQEASDRFNINSQLEHLQAKYVGTGHADLTRFEWAVNIQRDSYASYIGHYPMLAYFAIAENESIGRERYNFMQKMLLPCGLPPERDED

SEQ ID NO: 44686 - DNA, 513 bp, Panicum virgatum
  misc_feature: Ceres CLONE 2021770
  misc_feature: Encodes the peptide sequence at SEQ ID NO. 44687
ttttttcaactccatccatctcgactctcttcatcctccccctctctctttctcttccaacatgtcgggtcgtggtaagggtggtaaggggttaggaaagggaggtgctaagcgtcatcgtaaggtgttgagggacaacatccagggcatcactaagcccgccatccgtcgtctcgctcgtcgtggtggtgtcaagcgcatctcggggttgatctacgaggagacgcgtggtgtgctcaaggtgttcctcgagcacgtcatccgtgacgccgtcacctacaccgaacacgcacgaaggaagacggtgacggccatggacgtcgtctacgcgctcaagagacaggggaagacgctgtacgggttcggtgggtaaggaggagtggtgagagggaacaaggcgtagggtagtggtgcagctcacatgcgtatcattgatccattacttcctcgatggcattcacctgcatccctgttgttgatacattgtcaatatattcttcctctttactttcg

SEQ ID NO: 44687 - protein, 103 aa, Panicum virgatum
  misc_feature: Ceres CLONE 2021770
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKVFLEHVIRDAVTYTEHARRKTVTAMDVVYALKRQGKTLYGFGG

SEQ ID NO: 44688 - DNA, 467 bp, Panicum virgatum
  misc_feature: Ceres CLONE 2021800
  misc_feature: Encodes the peptide sequence at SEQ ID NO. 44689
acaccctcgcagctgatccaccgctgaagttatttgcagatcgagagagaagcgaaaccatggcgtccaaggcgctcctagtgctcgcgctcctgctcgctgctgctttccttgtcgcctcagctaacaacgagcacacccaggcgaaagaggaggagagcaagcaggccggcgtgcaagaataccaccgcggcggcggctaccccggcggcgggtggcgcggaagaagcggctaccccggcggcgggcggggcgggggcggtggctaccctgggcacgggcgcggcggctggtactgccggtgggggttctgccaccgcgggtcctacgggggctgccgcttctgctcgcgccccgaggagatccccgaagccatggaccgcccggaggtcctccaggtccacgactgaatgaagcagctagctggcccttccggctcgttggcatggacttctaccatctaagac

SEQ ID NO: 44689 - protein, 116 aa, Panicum virgatum
  misc_feature: Ceres CLONE 2021800
  misc_feature (1)..(93): Pfam Name: GRP Pfam Description: Glycine rich protein family
MASKALLVLALLLAAAFLVASANNEHTQAKEEESKQAGVQEYHRGGGYPGGGWRGRSGYPGGGRGGGGGYPGHGRGGWYCRWGFCHRGSYGGCRFCSRPEEIPEAMDRPEVLQVHD

SEQ ID NO: 44690 - DNA, 495 bp, Panicum virgatum
  misc_feature: Ceres CLONE 2021808
  misc_feature: Encodes the peptide sequence at SEQ ID NO. 44691
agctaccataccaagcaccagccaccagcagctagcaccggctagacctcgggcaggaagcaagcagccggcggcgacaccagagaggaagagaggcatggcggccggcggcgacaccattgcccgggtccacgccggcatcgacagcagcaacaagacgctgctcaagagcgaggccctctacaagtacgtgctggacacgtcggtgctgccgcacgagccggagtgcatgcgcgagctgcggctggtgacggacaagcacgagtgggggctgatgcagtcgtctgagttgatgatctgttgctgctccccctcgctctcgccgctgctgctgccgtcccggtgctttcaataagattcttttccccctttctattcctttctctttttgcaagttgatgcgtcgtcacatcgtgtgctatactgtacctactactactactgtactgtacttgtgttatcgaactggagcaaatacagcgcattattttcgcc

SEQ ID NO: 44691 - protein, 85 aa, Panicum virgatum
  misc_feature: Ceres CLONE 2021808
  misc_feature: SWISSPROT Homolog: EC 2.1.1.104 Caffeoyl-CoA O-methyltransferase
  misc_feature: Functional homolog of the protein sequence given in SEQ ID NO 51474
  misc_feature: Useful for making plants with altered carbohydrate content
  misc_feature: Functional homolog of the protein sequence given in SEQ ID NO 51309
  misc_feature: Useful for making plants with altered cell wall content and/or composition
  misc_feature: Useful for making plants with altered lignin content
MAAGGDTIARVHAGIDSSNKTLLKSEALYKYVLDTSVLPHEPECMRELRLVTDKHEWGLMQSSELMICCCSPSLSPLLLPSRCFQ

SEQ ID NO: 44692 - DNA, 750 bp, Panicum virgatum
  misc_feature: Ceres CLONE 2021817
  misc_feature: Encodes the peptide sequence at SEQ ID NO. 44693
aacgaacgctaaaaaagtaacagtttctgtactttattgcacccaccacaatgggacgccgccccgcgacgtgctaccgcttctgcaagaacaagccgtacccgaagagccgcttctgccgcggtgtgccggacccgaagatccgcacgtacgacctcggcgcgcgtaaggcggacgtggcggagttcccgtacacgatccacctggtgtcccgcgagctcgagcagatctcgtccgaggcgctggaggccgcccgtatccaggcgaacgagtacatggcgaacaagaccaacaagctgggcttccacctgcgcatccgcgtgcacccgttccacgtgctccgcatcaacaagatgttgtcctgcgccggtgccgatcgtctgcagaccggcatgcgtcagtcgtacggcaagccgtacggcaccgcggcgcgcgtgcgcatcggccagatcctgatgtcgatccgctgcaaggagaaccactccgagcacgcgaacgaggcgctccgccgcgccaagttcaagttcccgggccgccaggtgcttgtgcactccaagttctggggcttcacgaagatcctccgcagcgagtacgagtccctgctggcggccggcaaggtcgacctgcgcggcacgcacgcgaagctgatcgccgcgaagggccgcatcacggcgaagaacgtgaacgcgtaatcgttcatcaagagtggcatggtggtgtgcgaagaaagtcttcttcctctcgttattc

SEQ ID NO: 44693 - protein, 213 aa, Panicum virgatum
  misc_feature: Ceres CLONE 2021817
  misc_feature (5)..(167): Pfam Name: Ribosomal_L16 Pfam Description: Ribosomal protein L16
MGRRPATCYRFCKNKPYPKSRFCRGVPDPKIRTYDLGARKADVAEFPYTIHLVSRELEQISSEALEAARIQANEYMANKTNKLGFHLRIRVHPFHVLRINKMLSCAGADRLQTGMRQSYGKPYGTAARVRIGQILMSIRCKENHSEHANEALRRAKFKFPGRQVLVHSKFWGFTKILRSEYESLLAAGKVDLRGTHAKLIAAKGRITAKNVNA

SEQ ID NO: 44694 - DNA, 636 bp, Panicum virgatum
  misc_feature: Ceres CLONE 2021818
  misc_feature: Encodes the peptide sequence at SEQ ID NO. 44695
caatcgggtcattaagtcccagcttaatcactctgcttcgagcttgtggtcaagcaactgttgctgcacatcacagcaatggcacgcaaggcctcggtcgcgctgttcctggccatcaacctggtcgtgttcgccgtggccagtgccacaagcgccaactgccccccgccgccatcgacgccgaccccgacgccagcctcgaaaggcaagtgcccccgcgacgcgctgaagctgggcgtgtgcgccaacgtgctgggcctcatcaaggctaaggtcggcgtgccgccggcggagccctgctgcccgctgttggaggggctcgtcgacctcgaagccgccgtgtgcctctgcaccgccatcaagggcaacatccttggcatcaacctaaacctgcccatcgatctcagcctcatcctcaactactgcggcaagaccgtgcccaccggcttcaagtgcctctaagttaactgatcgatgcatgagccgaccatgcatgccagcattcttttgcttaattatctgatcgttcttatcggttgctatgtacgcatgtaaacggtttggctagctttcgcttttcgatgattcctgtgcaagtccttgcatggactagtccctaaactactttgattactc

SEQ ID NO: 44695 - protein, 127 aa, Panicum virgatum
  misc_feature: Ceres CLONE 2021818
  misc_feature (45)..(126): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MARKASVALFLAINLVVFAVASATSANCPPPPSTPTPTPASKGKCPRDALKLGVCANVLGLIKAKVGVPPAEPCCPLLEGLVDLEAAVCLCTAIKGNILGINLNLPIDLSLILNYCGKTVPTGFKCL

SEQ ID NO: 44696 - DNA, 714 bp, Panicum virgatum
  misc_feature: Ceres CLONE 2021825
  misc_feature: Encodes the peptide sequence at SEQ ID NO. 44697
acaataatatcatcgctattggaatggaggactctaccattcaaatctacaatgtccgcattgatgatgtcaaaagtaagctcaagggtcatcagaaaaagattactggattggccttttctcaatctatgaatgtgctagtatcgtcaggcgctgatgctcagttatgtgtatggagcattgatggttgggagaaaaagaaatcaagatatatccaacccccagcgaaccggtctggcactttggttggcgatacaagggtgcagttccacaatgaccagacacatcttttggtagttcatgagagtcaattggcgatctatgatggaaatcttgaatgtttgcgctcgtggtccccgagagatgcactcccagctccaatctcgagtgcaatatactcttgtgatggtctcttagtctacgctgcattctgcgatggtgctattggagtctttgaagcagaatctcttcgattgcgttgcagaattgcaccttctgcatacattccaccttcaatactacctggtcctggacgcgtttaccccttggtggttgctgctcatcctgtggagcctaaccagattgcacttggtatgagcgatggtaaagtccatgtggtcgagccattggacgcggacccaaagtgggggacagcaccgcctcaggacaacggagcacacccagcgatatcagccgcaccgtcagctgctagca

SEQ ID NO: 44697 - protein, 237 aa, Panicum virgatum
  misc_feature: Ceres CLONE 2021825
  misc_feature (21)..(59): Pfam Name: WD40 Pfam Description: WD domain, G-beta repeat
NNIIAIGMEDSTIQIYNVRIDDVKSKLKGHQKKITGLAFSQSMNVLVSSGADAQLCVWSIDGWEKKKSRYIQPPANRSGTLVGDTRVQFHNDQTHLLVVHESQLAIYDGNLECLRSWSPRDALPAPISSAIYSCDGLLVYAAFCDGAIGVFEAESLRLRCRIAPSAYIPPSILPGPGRVYPLVVAAHPVEPNQIALGMSDGKVHVVEPLDADPKWGTAPPQDNGAHPAISAAPSAAS

SEQ ID NO: 44698 - DNA, 699 bp, Panicum virgatum
  misc_feature: Ceres CLONE 2021827
  misc_feature: Encodes the peptide sequence at SEQ ID NO. 44699
aaccctcggcgcagtcccccccccccccctcgcgtccccatggagcctccgcaggaatccgccgccggtgaccgcaagcggcgccggcgaggtggcggccggaaccgccggaagccctcgtcgtcctcgcaacaagcgcctccgcccgcggcggcacccccgccgctgccctcccctccggcaaagcggcggcgcaaggacgggaccggccaggccgcggccacacccaagcgaggcaacacctcgagcctactcgacaagatgcgtgcaagattatctggtggccatttcagaatgctaaacgaaaagctctacacttgcagtgggcaggatgcgtttgactacttcaaaaatgaccctaatcttttcgatgtgtatcatacaggatatcgagaacagatgtcacattggccagagcagccagtaaatgtgataatcaattggttgaagagacataatgcatcatggactgttgctgattttggctgtggcaacgcagcagttgcaaaaaatgtggagaacaaggttttctccattgatcttgtttcagatgatccttcagtgattgcttgtgatatggctcatactccattggatccgtcctctgtagatgttgcaatattttgcctttcgttgatgggaaccaactatccaagttacttggaggaagcaaatagggttctcaagccgagtggctgg

SEQ ID NO: 44699 - protein, 219 aa, Panicum virgatum
  misc_feature: Ceres CLONE 2021827
  misc_feature (70)..(219): Pfam Name: Methyltransf_8 Pfam Description: Hypothetical methyltransferase
MEPPQESAAGDRKRRRRGGGRNRRKPSSSSQQAPPPAAAPPPLPSPPAKRRRKDGTGQAAATPKRGNTSSLLDKMRARLSGGHFRMLNEKLYTCSGQDAFDYFKNDPNLFDVYHTGYREQMSHWPEQPVNVIINWLKRHNASWTVADFGCGNAAVAKNVENKVFSIDLVSDDPSVIACDMAHTPLDPSSVDVAIFCLSLMGTNYPSYLEEANRVLKPSG

SEQ ID NO: 44700 - DNA, 679 bp, Panicum virgatum
  misc_feature: Ceres CLONE 2021830
  misc_feature: Encodes the peptide sequence at SEQ ID NO. 44701
gatccagttctcttttgacatgtccaccaaagccaagacctccaaaaagaaggcaccagaggcccgaggaaaagaagctaaaatcgcaaaggctgctaaagacccacaagcaccaaaagcaaagaaagccccagctaaagtcgtcgagaagaaaccagtcgttgaaaaaccaaaattaaccaaagaacaaaaggttgctgctgcagctgctaaaaaagcaactctcgcaaaggctcttaaagccaaacaagccactaaagcaggaggagtcgtcaaaaagagacgtgctatccgaaccagtgttcgcttcaacagaccaaaaacaaagactcttgcaagaagcccaaaatacccaagaaagtctgtcccaaacaagaaccctttgaatcaattctcgatccttaaatacccattgggaactgaaagcgccatgcaaaacattgaaaataattcaacccttgtctttattgttgatatccgtgccaacaagagacaaatcaaggattgtgttaagagaatgtacgacattaaagctcaatcagtcaacactctcatcagacctgatggtaaaaagaaggcatacgttaggcttacaaaggatgtagacgctttggatgttgctaacaagattggaatttatctaaacgtctggtgttactacaaataaaagagaacttat

SEQ ID NO: 44701 - protein, 215 aa, Panicum virgatum
  misc_feature: Ceres CLONE 2021830
  misc_feature (125)..(204): Pfam Name: Ribosomal_L23 Pfam Description: Ribosomal protein L23
  misc_feature (66)..(119): Pfam Name: Ribosomal_L23eN Pfam Description: Ribosomal protein L23, N-terminal domain
MSTKAKTSKKKAPEARGKEAKIAKAAKDPQAPKAKKAPAKVVEKKPVVEKPKLTKEQKVAAAAAKKATLAKALKAKQATKAGGVVKKRRAIRTSVRFNRPKTKTLARSPKYPRKSVPNKNPLNQFSILKYPLGTESAMQNIENNSTLVFIVDIRANKRQIKDCVKRMYDIKAQSVNTLIRPDGKKKAYVRLTKDVDALDVANKIGIYLNVWCYYK

SEQ ID NO: 44702 - DNA, 655 bp, Panicum virgatum
  misc_feature: Ceres CLONE 2021832
  misc_feature: Encodes the peptide sequence at SEQ ID NO. 44703
actcggcccagcccccctcgcttcctttcccctcctcgtcgctcggctcgctcgctcgtctgcacagcggaatcccccctccgccgccgccgccgccgccgctccttccggcttcggaactcgcccgagatggcaaacgcaagatcaggagtcgcggtgaatgatgactgcatgctgaagttcggcgagctgcagtcgaagaggctgcaccgtttcattgtttacaagatggatgacaagttcaaggagattattgtggataaggttggggatcgcgagaccagctatgaggatttcaccaacagcctacctgaaaatgactgccgatatgctatctatgattttgactttgttactgcagaagacgtccaaaagagcaggatcttctatatcctatggtccccgtccactgccaaggtgaagagcaagatgctttacgctagctcaaaccaaaaattcaagagtgggctcaatggcatccaggtggaactgcaggctactgatgctagtgaaatcagccttgatgagatcaaggatcgggcgcgctaggctccatcgtgcagctcatgaccatgcatcgtggacttgcctactgctgtggatttgtatgccattatagacttggtgctatgaaagaccgcttggtgatttatgg

SEQ ID NO: 44703 - protein, 139 aa, Panicum virgatum; identical to SEQ ID NO: 12693
  misc_feature: Ceres CLONE 2021832
  misc_feature (12)..(139): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence

SEQ ID NO: 44704 - DNA, 627 bp, Panicum virgatum
  misc_feature: Ceres CLONE 2021833
  misc_feature: Encodes the peptide sequence at SEQ ID NO. 44705
gtatgcaattacgcaataagttgggaccaaactagaaaaagagcccctctgctatttgcttcggcattaatccgaaaggaacactatgacaaaagcagaaagcgggggagacgaggagccaacacggcacgccaaaccaaaaccacacaggacgccaggagctccgcgtcccaaatttcttctgcaagagcaaggccgacaagagtttgttcccggaatctctcgctcgcgtgcgcgtgatttgatccccaaccacccgagcccctctccctctcgctccggcggtcggttccttcgatcccaaaccgtgatccgctcgatggcggccaccgccggcggcaacaagatccgcaacgccaagctggttcttctcggggatgtgggcgccggcaagtccagcctggttctccggtttgtgaaaggccagttcgtcgaattccaggaatcgaccatcggggcggctttcttctcgcagaccttggcagtgaacgatgagacagtcaagtttgagatatgggacacggcagggcaggagaggtatcacagcttggctcccatgtattaccggggcgctgctgctgcgatagttgtctacgacatcacaaatgcggcctctttcacacgtgc

SEQ ID NO: 44705 - protein, 102 aa, Panicum virgatum
  misc_feature: Ceres CLONE 2021833
  misc_feature (14)..(102): Pfam Name: Ras Pfam Description: Ras family
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
MAATAGGNKIRNAKLVLLGDVGAGKSSLVLRFVKGQFVEFQESTIGAAFFSQTLAVNDETVKFEIWDTAGQERYHSLAPMYYRGAAAAIVVYDITNAASFTR

SEQ ID NO: 44706 - DNA, 645 bp, Panicum virgatum
  misc_feature: Ceres CLONE 2021840
  misc_feature: Encodes the peptide sequence at SEQ ID NO. 44707
agaaacaggagcagagaagagagacaccaaagagcagagcccagcaatggcgggggagaagcaggagaagggtcgtctgcagcttctggacttctgggtgagcccgttcgcgcagcgctgccgcatcgcgctggcggagaagggcctgccgtacgagtccctggagcaggacctctccaacaagggcgagctcctcctccgcgccaaccccgtgtacggcaaggtccccgtgctcctccacggcggccgccccgtctgcgagtccatcgtcatcctccactacctcgacgaggcgttcccggacgaggcgccggcgctgctccccgccgacccgcgcgcccgcgcgcacgccaggttctgggcggacttcgccgacaggacggtgtttgcctgcgggatccggctgtggaagctgcgcgacggggaggcgcgggcgcgggcgcgggcggagatggtggaggccctgcgggcgctggacgccgagctcggggacaagccctacctcgccggcgaggcgttcgggttcgccgacctcaccgtcgtgccgttcgcggcgtggctccccggctacgcgcgcctcggggagttccgcctcgacgaggtgtgcccgaggctgccggcgtgggcggagcggtgcggcgagag

SEQ ID NO: 44707 - protein, 199 aa, Panicum virgatum
  misc_feature: Ceres CLONE 2021840
  misc_feature (9)..(82): Pfam Name: GST_N Pfam Description: Glutathione S-transferase, N-terminal domain
  misc_feature (104)..(197): Pfam Name: GST_C Pfam Description: Glutathione S-transferase, C-terminal domain
  misc_feature: SWISSPROT Homolog: EC 4.4.1.5 Lactoylglutathione lyase
MAGEKQEKGRLQLLDFWVSPFAQRCRIALAEKGLPYESLEQDLSNKGELLLRANPVYGKVPVLLHGGRPVCESIVILHYLDEAFPDEAPALLPADPRARAHARFWADFADRTVFACGIRLWKLRDGEARARARAEMVEALRALDAELGDKPYLAGEAFGFADLTVVPFAAWLPGYARLGEFRLDEVCPRLPAWAERCGE

SEQ ID NO: 44708 - DNA, 726 bp, Panicum virgatum
  misc_feature: Ceres CLONE 2021844
  misc_feature: Encodes the peptide sequence at SEQ ID NO. 44709
gaatcgaagcagcccctctcgaaatccagcatcgccttctccgccgccgccgctcgatctaccccagaggttctcccccgaaacccgttcggcgatggcgacgatccagtccgtgaaggcgcgccagatcttcgacagccgtggcaaccccaccgttgaggttgatgtgtgctgctcggacggaaccttcgcgcgtgctgctgttcccagtggtgcatcaactggtgtttatgaagctctggagttgcgggatggtggatctgactacctgggcaagggagtttccaaggctgttaacaatgtgaactctatcattggacctgctcttgttggcaaggaccctacgacacagactgagattgacaactttatggttcagcagcttgatggcactaagaatgagtggggatggtgcaagcaaaagcttggtgctaatgccatcttggctgtgtcactagctgtttgcaaagctggagctagcatcaagaaaattcctctttaccagcacattgccaatcttgctggcaacaagcaattagttttgcctgttcctgcatttaatgtcatcaatggtggttcccatgctggaaacaagcttgctatgcaggagttcatgatcttgcctactggagctgcctcattcaaggaggctatgaagatgggtgttgaagtttaccacaacctgaagtctgttatcaagaagaggtatgggcaggatgcccccca

SEQ ID NO: 44709 - protein, 210 aa, Panicum virgatum
  misc_feature: Ceres CLONE 2021844
  misc_feature (3)..(139): Pfam Name: Enolase_N Pfam Description: Enolase, N-terminal domain
  misc_feature: SWISSPROT Homolog: EC 4.2.1.11 Phosphopyruvate hydratase
MATIQSVKARQIFDSRGNPTVEVDVCCSDGTFARAAVPSGASTGVYEALELRDGGSDYLGKGVSKAVNNVNSIIGPALVGKDPTTQTEIDNFMVQQLDGTKNEWGWCKQKLGANAILAVSLAVCKAGASIKKIPLYQHIANLAGNKQLVLPVPAFNVINGGSHAGNKLAMQEFMILPTGAASFKEAMKMGVEVYHNLKSVIKKRYGQDAP

SEQ ID NO: 44710 - DNA, 912 bp, Panicum virgatum
  misc_feature: Ceres CLONE 2021849
  misc_feature: Encodes the peptide sequence at SEQ ID NO. 44711
accgagaaagatatccttagaaatagatcggccggcctcgctcgccgagtccgcggtctgctccctcgacctccgcatcggcggcagcggcgacgggggcgaggacgtccgcctcctctgcgaaaggctcggtctctccggacccgacgacttcaccatctcgattgccgagtgggaggcgcacaaggccctgcgcttctgcacctctgctagctccccttcctcggcgcaccccagctccaaaccccctgcgcgggactcctcgctctttcacgagggcgccgaggagcatgattgccctgagggcaccgtacctgagctactggtggcacgcggcggccgaattgaagctccagagcggctggcatggctggatccgccggagctcacccggccaaatgtgaagagggcagctgaggacggaggaatcaagggcatgcgcccgcagccggtgctcaagccgccgccctcgatggcgccgccggttgtctgctgggcggggtcctcgtgggatatcctgcggtcttttgcgccggatgaggataaacacgccccggtgagcagatctggccgtggtttgggataccaggatgcgagcatgaccaccggatccaggatcttcatccccccgaacgggaggattaagatccggtcatggaaccgagggatgctcctgggtagtggctcgtttgggaatgtctacgagggcatcagcgatgagggtgtcttctttgctgtcaaggaagtaagcttatctgatcaagggatcaacgcaaagcagtgtatctttcagcttgagcaggtttatttctttatatttttgtcttgataatatgatagctataatctattattggcagttacctattgtattgtgaattgcaagtcaactgcatgtagctcaatttgtat

SEQ ID NO: 44711 - protein, 275 aa, Panicum virgatum
  misc_feature: Ceres CLONE 2021849
  misc_feature: SWISSPROT Homolog: EC 2.7.11.25 Mitogen-activated protein kinase kinase kinase
PRKISLEIDRPASLAESAVCSLDLRIGGSGDGGEDVRLLCERLGLSGPDDFTISIAEWEAHKALRFCTSASSPSSAHPSSKPPARDSSLFHEGAEEHDCPEGTVPELLVARGGRIEAPERLAWLDPPELTRPNVKRAAEDGGIKGMRPQPVLKPPPSMAPPVVCWAGSSWDILRSFAPDEDKHAPVSRSGRGLGYQDASMTTGSRIFIPPNGRIKIRSWNRGMLLGSGSFGNVYEGISDEGVFFAVKEVSLSDQGINAKQCIFQLEQVYFFIFLS

SEQ ID NO: 44712 - DNA, 697 bp, Panicum virgatum
  misc_feature: Ceres CLONE 2021863
  misc_feature: Encodes the peptide sequence at SEQ ID NO. 44713
gtttctgtttcattccaaagatgatgcgtaaggccacttcatcgctcgcagtgcgcggtgccgcccgatccacggggcagcagcgactcttttcgaccactgtgctgggtcgcgctcgtccggcggtggcagtagtaacctcccgcgcggtcctcggcttgccgcttcgcactgcccacgccgtgcccctcgtcgctcgccctcagcagcagcggtggtatgccacgggtgaggagaaggagaccgacggtgaggtctctgcggaggactctgtgcaggaggccatcaagaaggtggtcgctgagtacccgtgcgtcgtcttcatgaaggggacccccgacgcgccgcagtgcggcttctccaacgccaccatcaaggctctcaacactgtgggcgctaagtacgaggcgttcgacgtcctccagagcgccgagctcagggacggcatcaagaagttcaccgactggccgaccatcccgcaggtcttcattggcggcgagtttgtcggcgggtgcgacatcaccctccagcacctccgttcgggcgagctcaccaccctgctcgagaaggccaaggcgctcaagacctcagagtagagtctctactctgaaagaaaagaaaagaggagaaccatctgccccttccctcgatctctctctgtgtgtttcgtcctcttttgaagaagacttggcgagtc

SEQ ID NO: 44713 - protein, 191 aa, Panicum virgatum
  misc_feature: Ceres CLONE 2021863
  misc_feature (98)..(162): Pfam Name: Glutaredoxin Pfam Description: Glutaredoxin
MMRKATSSLAVRGAARSTGQQRLFSTTVLGRARPAVAVVTSRAVLGLPLRTAHAVPLVARPQQQRWYATGEEKETDGEVSAEDSVQEAIKKVVAEYPCVVFMKGTPDAPQCGFSNATIKALNTVGAKYEAFDVLQSAELRDGIKKFTDWPTIPQVFIGGEFVGGCDITLQHLRSGELTTLLEKAKALKTSE

SEQ ID NO: 44714 - DNA, 1030 bp, Panicum virgatum
  misc_feature: Ceres CLONE 2021873
  misc_feature: Encodes the peptide sequence at SEQ ID NO. 44715
accgaggcaaggaaccgaacacgccgccgctgccgcgccgcgtcaccgggtcggaagcggggcgtcggcgagcacgtgcctaggaggtgacggcggcggagagtcggagagacagctcccggcagcctcaattgaatactcgacaggagcacctggagtagtcatgacaggaaaatctgagcagaagtctcggaaacagaggaggaaagaggcgagatcagagaagcagaagctgcggtttctctcttgggttcagcaccagggtggcaaaaagaagaaactggcaatgccagcagtagagcctaatccagaagaggggaagaaaataactccacatccatccatcaaccacatcgcggtcattccatttccaatacaacaatttcatcaacccactccgataactttatcatcaatcacaatggcccgcactaagcagaccgcccgcaagtccactggtggcaaggcccctcgcaagcagcttgcttctaaggctgcccgcaagtcggccccgtcgaccggcggtgtcaagaagcctcaccgttacaagcccggtaccgtcgctcttcgtgagattcgccgctaccagaagtcgactgagctgctcatccgcaagctccccttccagcgtctggttcgcgaaatcgctcaggacttcaagtccgacctccgcttccagagctccgccattggcgccctccaggagtccgtcgagtcctacctcgtctctctcttcgaggacaccaacttgtgcgccatccacgccaagcgcgtcaccatccagtcgaaggacatccaactcgctcgtcgcctccgtggtgagcgcaactaagcatagttgctcgactatttgctagtttggggggttcgcaggttatgactttctcatttgggacgcgctctggatgaaggggctcattcacgggacaagggacggcgtttaattgcgatgggtttttgctctatggggttgtacattacatggtggcaaacggactgctgcgaatatccacgttgacttcatgatcac

SEQ ID NO: 44715 - protein, 136 aa, Panicum virgatum; identical to SEQ ID NO: 35280
  misc_feature: Ceres CLONE 2021873
  misc_feature (58)..(132): Pfam Name: Histone Pfam Description: Core histone H2A/H2B/H3/H4

SEQ ID NO: 44716 - DNA, 586 bp, Panicum virgatum
  misc_feature: Ceres CLONE 2021905
  misc_feature: Encodes the peptide sequence at SEQ ID NO. 44717
ggccaaccgaaccattcgcccccgcccccgatcgatctcttccccccccccccaaacgcccccgtcgggattccctcgtagcatcccctcacgcgcgcgtcgaccatgttggtctactgggggaagtacaaagacgagctcatcaagaatgctgcctacattggaacccctggcaagggtatccttgctgctgaggagtctggtggtatcattggcaagggggtttgaagggtcaatgttgagaacattgaggagaacgggcgtgccgttcgtgagctcctattgtgaacccctggtgccctccagtacctcaggggtgtgatactatttgaggagacactatgacgaagaagaggggacggtaagcccttcgttgatgttcttaaggagggaggtgtcctcgctggcgtggaggtcgacgagggtagcatctggatcgctggcaacaacgaggagaacaacaaccacggccgtgatgaccttgagaagtgctgcgctaagtactacgaggctggtgcccgttttggcgagtggcgtggtgactgcaatattggccccaagcagacatcatagattgggattgaca

SEQ ID NO: 44717 - protein, 40 aa, Panicum virgatum
  misc_feature: Ceres CLONE 2021905
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
  misc_feature: Functional homolog of the protein sequence given in SEQ ID NO 50217
  misc_feature: Useful for making plants with modulated biomass
MLVYWGKYKDELIKNAAYIGTPGKGILAAEESGGIIGKGV

SEQ ID NO: 44718 - DNA, 670 bp, Panicum virgatum
  misc_feature: Ceres CLONE 2021934
  misc_feature: Encodes the peptide sequence at SEQ ID NO. 44719
agataaaccctagccgccgcgccgccccccagcgctccacctcctcctcctcgcgcggcccccctcctccacgtacctccagctccgtctccggcggcggcccccgcggcgaggatgaacatgaagggcggcggccggatcccggcgcccccgccgggggccagcgcgctggtcaaggtcgccgtgctcggcggcgccgccgtgtacgccgccgtgaacagcctctacaacgtcgatggcgggcaccgcgccatcgtcttcaaccgcatccaggggatcaaggacaaggtataccctgaagggactcactttatgattccatggtttgaacgaccaatcatttatgatgtacgcgctcgcccgaatcttgttgagagtacttctggaagcagggatcttcagatggtgaaaattggtcttcgtgtcctcacaaggccaatgccagagaggctaccccatatctacaggactctgggggagaacttcaacgagcgagttctgccttctatcatacatgaaacactgaaagctgttgttgcccaatacaatgctagccaactgatcacacagagagagactgtcagtagggagattaggaagatactgactgagagggccagaaacttcaacattgctcttgatgatgtctcgattacaagccttagctttg

SEQ ID NO: 44719 - protein, 185 aa, Panicum virgatum
  misc_feature: Ceres CLONE 2021934
  misc_feature (38)..(183): Pfam Name: Band_7 Pfam Description: SPFH domain / Band 7 family
  misc_feature: Functional homolog of the protein sequence given in SEQ ID NO 51073
  misc_feature: Useful for making plants with modulated biomass
MNMKGGGRIPAPPPGASALVKVAVLGGAAVYAAVNSLYNVDGGHRAIVFNRIQGIKDKVYPEGTHFMIPWFERPIIYDVRARPNLVESTSGSRDLQMVKIGLRVLTRPMPERLPHIYRTLGENFNERVLPSIIHETLKAVVAQYNASQLITQRETVSREIRKILTERARNFNIALDDVSITSLSF

SEQ ID NO: 44720 - DNA, 657 bp, Panicum virgatum
  misc_feature: Ceres CLONE 2021935
  misc_feature: Encodes the peptide sequence at SEQ ID NO. 44721
attttgttcccagtgcattggcttttctaatgaacaatgagactgatatagtgaagaatttcctcctgaaaactcttcaccttcagagctcaaaaaaaatggtagaccggttcaagcttggagcaggagcgatgcctgcaagtttcaaggtggaccggaataaaaacagaaacactgaaaccttagttgctgattttggtgagagtgcaatcggcagggtggcaccagttgactcaggattttggtggattattctcctccgggcatatacaaagtacactggggatgttagtttggcagaatcacctgactgccagaagtgcatgaggttgatattgaatctctgcttatccgaaggatttgatacattcccaactctgctttgcacggatggctgctcaatgattgatcgtcgaatgggtatatatggttacccaattgagatccaagctctattttatatggcattaagatgtgctctccaaatgctcaagccagagggtgaagggaaggaattcatagagaagataggacaacggctacatgcactgacctaccacatgaggaattatttctggctagattttcaccagctgaataacatatacagatacaaaacagaagagtattcccacactgctgtgaacaagttcaatg

SEQ ID NO: 44721 - protein, 218 aa, Panicum virgatum
  misc_feature: Ceres CLONE 2021935
  misc_feature (1)..(218): Pfam Name: Invertase_neut Pfam Description: Plant neutral invertase
  misc_feature: Functional homolog of the protein sequence given in SEQ ID NO 51255
  misc_feature: Useful for making plants with modulated oxidative stress sensitivity
  misc_feature: Functional homolog of the protein sequence given in SEQ ID NO 50740
  misc_feature: Useful for making plants with altered carbohydrate content
FVPSALAFLMNNETDIVKNFLLKTLHLQSSKKMVDRFKLGAGAMPASFKVDRNKNRNTETLVADFGESAIGRVAPVDSGFWWIILLRAYTKYTGDVSLAESPDCQKCMRLILNLCLSEGFDTFPTLLCTDGCSMIDRRMGIYGYPIEIQALFYMALRCALQMLKPEGEGKEFIEKIGQRLHALTYHMRNYFWLDFHQLNNIYRYKTEEYSHTAVNKFN

SEQ ID NO: 44722 - DNA, 690 bp, Panicum virgatum
  misc_feature: Ceres CLONE 2021940
  misc_feature: Encodes the peptide sequence at SEQ ID NO. 44723
ctagggtttatcgccgtcgcattccctccgcagcgagctcgccgccgccgtcgccgtcttcgcccgctccagtgcgggcgaaccctaggcgcctagcaagatggcgaggggtttgaagaaacatctgaagaggctcaatgctccgaagcattggatgcttgacaagcttggtggagcatttgcacccaagccttcatctggtccccacaaagcaatggagtgcttgcctttgatccttatcctcaggaacaggttgaagtatgctctgaactaccgtgaagttatttcaatcttgatgcagcgtcaagttatggttgatggcaaggtcaggactgacaagacatatccatctggattcatggatgttgtgtcgattccaaagactggagagaatttccgccttctctatgacaccaagggacgcttccgtctccacagtatcagggatgatgaggctaagttcaagctttgcaaggtgcggtctgtgcagtttgggcagaagggcatccctttccttaacacctatgatgggcgcacaatccgctatccagaccctctcatcaaggccaatgacaccatcaagattgacctggataccaacaagattgtagacttcatcaagtttgatgttggtaatgttgtgatggtgactggtggaaggaacactgggcgtgttggggtgatcaagag

SEQ ID NO: 44723 - protein, 196 aa, Panicum virgatum
  misc_feature: Ceres CLONE 2021940
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
MARGLKKHLKRLNAPKHWMLDKLGGAFAPKPSSGPHKAMECLPLILILRNRLKYALNYREVISILMQRQVMVDGKVRTDKTYPSGFMDVVSIPKTGENFRLLYDTKGRFRLHSIRDDEAKFKLCKVRSVQFGQKGIPFLNTYDGRTIRYPDPLIKANDTIKIDLDTNKIVDFIKFDVGNVVMVTGGRNTGRVGVIK

SEQ ID NO: 44724 - DNA, 726 bp, Panicum virgatum
  misc_feature: Ceres CLONE 2021942
  misc_feature: Encodes the peptide sequence at SEQ ID NO. 44725
aacacatggggcgcactcgcactcgcactccatcgcagcgcattcacacagcgcctaatataaattagcaagtgatcgaagcaagcaaagcaggccgggcggcatggcggagcagctcatctccacggccgtgcacgagcagctgccggagaactacgtccggccggagacgcagcgcccgcgcctccacgaggtcgtctccgacgcgcagatccccgtggtcgacctcgccgaccccgaccgcgccgccgtcgtcgccaggatcggcgaggcctgcaccacccacggcttctttcaggtgatcaaccatggggtgcccgtggagctgatggacgcgatgctggcggtggcgtacgacttcttccggctcccgccggaggagaaggccaagctctactccgacgacccggccaagaagatgcggctgtccaccagcttcaacgtgcgcaaggagacggtgcacaactggcgcgactacctccgcctccattgccacccgctcgagcagtacgtccccggctggccggcaaatccgccagccttcagggagatggtgagcgcctactgcagagaggtccgggcgctggggttccggctgtacgcggccatctccgcgagcctgggcctggaggaggagtacgtgaaggcggcgctgggcgagcaggagcagcacatggcggtcaacttctaccccaagtgcccggcgccggacctcaccttcgggct

SEQ ID NO: 44725 - protein, 207 aa, Panicum virgatum
  misc_feature: Ceres CLONE 2021942
  misc_feature: SWISSPROT Homolog: EC 1.14.11.9 Flavanone 3-dioxygenase
MAEQLISTAVHEQLPENYVRPETQRPRLHEVVSDAQIPVVDLADPDRAAVVARIGEACTTHGFFQVINHGVPVELMDAMLAVAYDFFRLPPEEKAKLYSDDPAKKMRLSTSFNVRKETVHNWRDYLRLHCHPLEQYVPGWPANPPAFREMVSAYCREVRALGFRLYAAISASLGLEEEYVKAALGEQEQHMAVNFYPKCPAPDLTFG

SEQ ID NO: 44726 - DNA, 705 bp, Panicum virgatum
  misc_feature: Ceres CLONE 2021947
  misc_feature: Encodes the peptide sequence at SEQ ID NO. 44727
gtggttctaaacaacacgaacaacccaagaaaagcactttacggaacggtgaacaatgtgcgggggcgccatcctcgcggagctgatcccgtcgccgcgccgggcggcgtcgaagccggtgaccgcgggccaccttaggccggcgggctccgactccaagaaagccggcagcgggaggagcaagaggcaccagctcgccgacgtcgacgactttgaggccgccttcgaggacttcgccgacgattttgacgaggacgaccaccacttcgtgttctcgtccaaatccgcattctccccagcccacggcgggcgcgcggcgccggcgacccagaagaagcgcggccgccgccacttccgcggcatccggcagcgcccctggggcaagtgggcggcggagatccgcgacccgcacaagggcacccgcgtctggctcggcaccttcaacaccgccgaggacgccgcccgggcctacgacgtcgaggcacgccgcctccgcggcagcaaggccaaggtcaacttccccgcggccggcgcgcgcccacgccgcggcaacgcgccgagaccgcagcgccaccatgatgcagcgcagcccgcgttgctcgcaggagagaagcagagggaggaggaggtcgtggtgaagcctgaaattggggcgtcgttcgacgtgggcagcttcttcgacatgaccttctcccgcttccccgc

SEQ ID NO: 44727 - protein, 216 aa, Panicum virgatum
  misc_feature: Ceres CLONE 2021947
  misc_feature (98)..(149): Pfam Name: AP2 Pfam Description: AP2 domain
  misc_feature: Functional homolog of the protein sequence given in SEQ ID NO 50249
  misc_feature: Useful for making plants with altered lignin content
MCGGAILAELIPSPRRAASKPVTAGHLRPAGSDSKKAGSGRSKRHQLADVDDFEAAFEDFADDFDEDDHHFVFSSKSAFSPAHGGRAAPATQKKRGRRHFRGIRQRPWGKWAAEIRDPHKGTRVWLGTFNTAEDAARAYDVEARRLRGSKAKVNFPAAGARPRRGNAPRPQRHHDAAQPALLAGEKQREEEVVVKPEIGASFDVGSFFDMTFSRFP

SEQ ID NO: 44728 - DNA, 1371 bp, Panicum virgatum
  misc_feature: Ceres CLONE 2021948
  misc_feature: Encodes the peptide sequence at SEQ ID NO. 44729
aacaactagcgtgcgatttctttagttctttatgccagcccagtcccaacaactccgccacgggaacgtgggcccacagccaccgccgccgccgacgcccggcgcttgctcctcccgatccagacggccggcggcacgtcagcgtcagtcaacccaaggccctccacggggccacccggcggtgcgcctgggctgcgccagcgccgcaggacagcgggggctcgcaaccgccgctggtcatccagcatcctcgccgcctcgcctccgctagcccctgctaaaggtgcaaaatggcgcaaccttctgtcattcttgcaactgcaagctatgatcacacaatcaggttttgggaagccaagagcggccgctgttatcgcacgattcagtacccagactctcaagttaatcgccttgagataaccccagacaagcgtttcttagctgctgctggcaaccctcatatccgtctttttgacgttaactcaaatagccctcaaccggtaattagctatgattcacatactagtaatgttatggctgtggggttccattgtgatggtaactggatgtactcaggttcagaggatggtactgtgcgaatctgggatttacggaccgcgacttgtcagcgagaatatgaaagtcgagcagctgtcaacacagtagtcctacacccaaatcagaaagaactaatatctggtgatcaaaatggaaacatacgtgtgtgggatttggctgctaactcatgcagctgtgagttggtaccagaggtggatactgctgtaagatctctgacagtcatgtgggatgggagtatggtggttgctgcaaataaccgcgggacatgttatgtttggcgcctacttaagggtacacagacaattacctgctttgaaccccttcacaaattgcaagctcatgatggctacattctaaagtgccttctttcgccagaattctgcgatcctaacaggtatcttgcgacagcatcatctgacaacactgtaaaaatttggaatgttgatggcttcaagttagaaagaactttagtaggtcatcaacgctgggtttgggattgcgtgttctcagttgatggtgcttatttgattaccgcttcatctgatacaactgcgagattgtggacgatgtcaaccggagaggccatcagggtgtaccagggacaccataaggcaaccgtctgttgtgctctacatgacggggctgaatcagctccctcttaaagtcataagcaccgtataaccttggattctgtacataactctgactgcctagtttccagcattgctgtaacttgagaacatgcggctaccgtagtgaaactgtgcacagccatatttggggtttcgtgtg

SEQ ID NO: 44729 - protein, 316 aa, Panicum virgatum
  misc_feature: Ceres CLONE 2021948
  misc_feature (68)..(106): Pfam Name: WD40 Pfam Description: WD domain, G-beta repeat
  misc_feature (247)..(285): Pfam Name: WD40 Pfam Description: WD domain, G-beta repeat
  misc_feature (201)..(243): Pfam Name: WD40 Pfam Description: WD domain, G-beta repeat
  misc_feature (110)..(147): Pfam Name: WD40 Pfam Description: WD domain, G-beta repeat
  misc_feature: SWISSPROT Homolog: EC 2.7.11.7 [Myosin heavy-chain] kinase
MAQPSVILATASYDHTIRFWEAKSGRCYRTIQYPDSQVNRLEITPDKRFLAAAGNPHIRLFDVNSNSPQPVISYDSHTSNVMAVGFHCDGNWMYSGSEDGTVRIWDLRTATCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDNTVKIWNVDGFKLERTLVGHQRWVWDCVFSVDGAYLITASSDTTARLWTMSTGEAIRVYQGHHKATVCCALHDGAESAPS

SEQ ID NO: 44730 - DNA, 744 bp, Panicum virgatum
  misc_feature: Ceres CLONE 2021952
  misc_feature: Encodes the peptide sequence at SEQ ID NO. 44731
agagacccctcgatcgagccaaacaaaagccaagaagaatccagccggccgtgtcgcgccgagccaacaagcacacgcgcctcgccctccccagcgcacaccaaccacagcctcctcctcgccgccatgcagcagcagccgcgccgccgcgcctccccggccgcgtcgctctgacgtgcggcgccgtcgtccgtcctctcgaccgtgctgccatctgtccgatcgatcgatccatgggggttcacctgcagctgctgaagaagcagccctcgtcggcgtcgctggagggctcgaggagcggggggtcgtcgccgccgatgccgcccaaggggtgcatggcggtgcgcgtggtggggcctggcggcggggaggaggaagaggaggagcggttcgtggtgccggtggggtacctgaagcacccgctgttcgtggcgctgctcaaggcggcggaggacgagtacggcttcgagcagaagggcgccatcaccaccccctgcggcgtcgaccacttccgccacgtccagggcatcatccaacaccagaagcaccaccaccacatctcatccggcttcgtctcctgcgacggcggccaccatggccaccacaacaaccaccaccacttccacatcgcggggtgcttccgcgcctgatgcgatgcggggatgcggggttcgagatctccagcggatgcatggatccaaaaacaataatacatagtacctattttatttaggtttttttgtc

SEQ ID NO: 44731 - protein, 138 aa, Panicum virgatum
  misc_feature: Ceres CLONE 2021952
  misc_feature (4)..(101): Pfam Name: Auxin_inducible Pfam Description: Auxin responsive protein
MGVHLQLLKKQPSSASLEGSRSGGSSPPMPPKGCMAVRVVGPGGGEEEEEERFVVPVGYLKHPLFVALLKAAEDEYGFEQKGAITTPCGVDHFRHVQGIIQHQKHHHHISSGFVSCDGGHHGHHNNHHHFHIAGCFRA

SEQ ID NO: 44732 - DNA, 1092 bp, Panicum virgatum
  misc_feature: Ceres CLONE 2021957
  misc_feature: Encodes the peptide sequence at SEQ ID NO. 44733
gccgccgtagacgaagtagaagaagaagaagaaggatttccctttcattcacccctctcccccccacaacaagatgtcgtacgctcccgctgcctccaagcccgccgtccccgtcctcgtcgtccccgtcggcgtcgtgaggcccgccgccccgctctactcgaacctcggcaagggcgccaaggatctgctcagcaagggcttcccctccacccacaaggtcgaggtgaccaccagcgctgagaacggcttccagttcgtctcctctgccgagaagaagcaggccaacaaggccgacgtcgtcgtgggcaccttccagcccaagtacaagatctcctcgcgcggaattgagatcattggtaccttcgacaccaacaaccagatcaaggccgagctcgccatcgagaacctcctcgtgcccggcgtgaagggtaccttcaaggcccagactggcctcagccacgatctcgaggctggtttcgagtacaagcacgaggccggcaccttcacctcgaccttcgtccacaaccccgttctctcgggcaccgtcatctcggccaccgccaccgtttcgcgccaggcgatcaccgctggtgtggagagcaagtacacgctcgcccccaccgcgcccggcacccttgccaccgtcactggtgccctcaactacaaggccgccacccacgaccttacggccttcgttaagagcgacgctgccagcgtgaccgatggcggcgctgcccccaggctctactcgctcggtgctcacctgcactacaccccctcgaaggagagcagcttcgcctcctcgctcgactacgacctccagaagagcaccatcaaggtgaccattggtggctcgcagaagctcgatgcccgcactgagaccaaggccaagttctcctccgatggtcgtctcggcctcggtgtggcccagcagctcacccccgccgtcaaggccacgctcggcactgagctcaacaccttcgatcttgccggcaccacccccaagttcggcgtccacttcaaggtcagggcttaaatccttccccctcttgtctacatctgtgcgtcatccacgcattcaaagccccg

SEQ ID NO: 44733 - protein, 321 aa, Panicum virgatum
  misc_feature: Ceres CLONE 2021957
  misc_feature (25)..(314): Pfam Name: Porin_3 Pfam Description: Eukaryotic porin
MSYAPAASKPAVPVLVVPVGVVRPAAPLYSNLGKGAKDLLSKGFPSTHKVEVTTSAENGFQFVSSAEKKQANKADVVVGTFQPKYKISSRGIEIIGTFDTNNQIKAELAIENLLVPGVKGTFKAQTGLSHDLEAGFEYKHEAGTFTSTFVHNPVLSGTVISATATVSRQAITAGVESKYTLAPTAPGTLATVTGALNYKAATHDLTAFVKSDAASVTDGGAAPRLYSLGAHLHYTPSKESSFASSLDYDLQKSTIKVTIGGSQKLDARTETKAKFSSDGRLGLGVAQQLTPAVKATLGTELNTFDLAGTTPKFGVHFKVRA

SEQ ID NO: 44734 - DNA, 1136 bp, Panicum virgatum
  misc_feature: Ceres CLONE 2021959
  misc_feature: Encodes the peptide sequence at SEQ ID NO. 44735
gaacgcctccatctccatcccacccccagcaccagccggtcggcctcggctggatctcgccggccgcctccaattggcttccgcgctcgggccggcggggtctttctctaggcctgcagatccgcgcctgcgcctgcgcctcgtggaaacctccgcctcctcgcgttggatcgagccggttcccctccgtcccgcacgagtccttccaagcgatcggaatttccggccgggccggcacggggattcgggcctttatcaagccaggagctcctccgggtggtgagattccgtaggagggcggtgctctgaggtgatcagggcaggatgagggggccggcgtggcgggcgctgctgctggtgctcgcgctggccttggcggacgcggcggcggggaggttcgtggtggagaagaacagcatccaggtgacgtcccccgacgagctcaagggcaagtacgagtgcgccatcgggaacttcggggtgccgcagtacgggggcacgctgcacggctgggtcaagtaccccagcaccaaccagcaggggtgccagagcttcgacgacatctcctttaagcccaagaaagccgggggacgccccaacttcgtcctcctcgaccgcggagaatgctttttcgccgtcaaggcatggaacgcccaaaatgctggagctgccgcagttattgttgtggatgacaaatcagaacctttaatcacaatggacaacccagatgaaggcaaaaaacacctagaaaacatcactattccctctgtgcttataacaaagaaattgggggatcaacttaagaaatctgcagaagcaggtgagatgcttagcattcttctggactggagagaatctcttcctcaccccgatgagcgtgtagagtatgaattctggacaaacagcaacgatgaatgtggtcctaaatgtgatatgcaaatggacttcgtgaagagcttcagaggaactgcacaagttcttgagaaaaagggttacacccagtttactccacattatattacatggtattgtccagaagcttttgtcacgagcaaacaatgcaaatcacagtgcatcaatcacgggagatattgtgcaccagacccagagcaagattttagccaaggatatgatgg

SEQ ID NO: 44735 - protein, 270 aa, Panicum virgatum
  misc_feature: Ceres CLONE 2021959
  misc_feature (55)..(163): Pfam Name: PA Pfam Description: PA domain
MRGPAWRALLLVLALALADAAAGRFVVEKNSIQVTSPDELKGKYECAIGNFGVPQYGGTLHGWVKYPSTNQQGCQSFDDISFKPKKAGGRPNFVLLDRGECFFAVKAWNAQNAGAAAVIVVDDKSEPLITMDNPDEGKKHLENITIPSVLITKKLGDQLKKSAEAGEMLSILLDWRESLPHPDERVEYEFWTNSNDECGPKCDMQMDFVKSFRGTAQVLEKKGYTQFTPHYITWYCPEAFVTSKQCKSQCINHGRYCAPDPEQDFSQGYD

SEQ ID NO: 44736 - DNA, 711 bp, Panicum virgatum
  misc_feature: Ceres CLONE 2021961
  misc_feature: Encodes the peptide sequence at SEQ ID NO. 44737
ggtctgtggacaccagcgacactactagcctcgaccgtcgacaacccccagcaatcgatcctgctcccgcagccatggcggcctccacggcgctctccaccgccgccaaccccacccagctctgccgtccccgcgcttcttcgctgggcaagccggtgaagggcctcggcctcggtatgggccgggagcgcgcccagcgaagcatcacctgccaggcggccagcagcatctccgccgaccgcgtccccgacatggagaagcggaagctgatgaacctcctcctcctcggcgccatctccctccccaccgtcggcatggtcgtcccctacggcgccttcttcgtccccgccgggtccggcggcgccggcggcgggacctacgccaaggacaagctgggcaacgacatcaaggtggacgagtggctcaagacgcacggccccaacgaccgcacgctggcgcaggggctcaggggcgacccgacgtacctggtggtggagcaggacaagacgctggccacctacggcatcaacgccgtgtgcacccacctcggatgcgtcgtgccgtggaacagcgccgagaacaagttcatctgcccatgccatggatcccagtacaacaaccagggcagggtggtccgtggcccggcgcctctgtcgctggccttggtccacgccgacgtcgacgacgggcaaggtctcttcgtcccggggg

SEQ ID NO: 44737 - protein, 212 aa, Panicum virgatum
  misc_feature: Ceres CLONE 2021961
  misc_feature (55)..(93): Pfam Name: CytB6-F_Fe-S Pfam Description: Cytochrome B6-F complex Fe-S subunit
  misc_feature (111)..(203): Pfam Name: Rieske Pfam Description: Rieske [2Fe-2S] domain
  misc_feature: SWISSPROT Homolog: EC 1.10.99.1 Plastoquinol--plastocyanin reductase
MAASTALSTAANPTQLCRPRASSLGKPVKGLGLGMGRERAQRSITCQAASSISADRVPDMEKRKLMNLLLLGAISLPTVGMVVPYGAFFVPAGSGGAGGGTYAKDKLGNDIKVDEWLKTHGPNDRTLAQGLRGDPTYLVVEQDKTLATYGINAVCTHLGCVVPWNSAENKFICPCHGSQYNNQGRVVRGPAPLSLALVHADVDDGQGLFVPG

SEQ ID NO: 44738 - DNA, 745 bp, Panicum virgatum
  misc_feature: Ceres CLONE 2021967
  misc_feature: Encodes the peptide sequence at SEQ ID NO. 44739
cttctcccattccgcttcgccgaatccacgcgaccgcgagagcgcagagagcaccgccactgccgagaggattggcccagccgagcaaaccctccaaatctcggcggcaatggcgctctccgaccgctcccgggagtcgctcctcccgagcttcctctacgccccggcggcggcgaggtccttcgccggcgcctcccgcttccccgccccgggaactggtgcagcgccgtcgttcccgatccaggcgcccaaggagaagatcgagatgtattcgccggcgttctacgcagcctgcactgccggaggcatcgccagctgcgggctcacccacatggctgtcacgccgctcgacctcgtcaagtgtaacatgcagattgacccagcaaaatacaagagcatctcatccgggtttggaattctggccaaggagcaaggagtgaggggcttcttcaggggatgggtgcccaccctgcttggttacagtgctcagggagcttgcaagtttggtttctatgagttcttcaagaagtactactcagatattgcagggcctgagtatgctcagaaatacaagacattgatataccttgccggatcggcttctgctgaggtgattgctgatgtggctctctgcccctttgaagctgtgaaggtccgtgtgcagacacagcctggttttgctcgtgggctcagtgatggtctccctaagttcattagatctgagggtgccctgggggctttacag

SEQ ID NO: 44739 - protein, 211 aa, Panicum virgatum
  misc_feature: Ceres CLONE 2021967
  misc_feature (58)..(146): Pfam Name: Mito_carr Pfam Description: Mitochondrial carrier protein
MALSDRSRESLLPSFLYAPAAARSFAGASRFPAPGTGAAPSFPIQAPKEKIEMYSPAFYAACTAGGIASCGLTHMAVTPLDLVKCNMQIDPAKYKSISSGFGILAKEQGVRGFFRGWVPTLLGYSAQGACKFGFYEFFKKYYSDIAGPEYAQKYKTLIYLAGSASAEVIADVALCPFEAVKVRVQTQPGFARGLSDGLPKFIRSEGALGAL

SEQ ID NO: 44740 - DNA, 699 bp, Panicum virgatum
  misc_feature: Ceres CLONE 2021969
  misc_feature: Encodes the peptide sequence at SEQ ID NO. 44741
  misc_feature (615)..(615): n is a, c, t, g, unknown, or other
gcctttcctttccttgctagcgctagcggcgacgaccgggcgagtgccgccgtccgccacttcttcgtcggccgaccaccatctgaaaggggactgggtggacagttgcctcagccctcggggaaggaagcatttgtccgcatgattttactcactcgatgatttgcggttgcgcgtctcctctcgagagacatcggggtccgaccctccacctcatccactgttttgctcccccacccccaccccacacacacacaagaagaagatccctctgcgttacggatgagtgaagaggacaagactgctgctgctgctgagcagccgaagcgagcccctaagctcaacgaaaggatcctctcttctttgtccaggagatctgtagctgctcatccatggcatgatgttgagatcggtcctggggctcccgctgtcttcaatgttgtcgttgagatcacaaagggaagcaaagttaaatatgagcttgacaagaaaactggactgattaaggttgatcgagtcctgtactcatcagttgtataccctcacaattatggtttcattccgaggactctttgtgaggacaatgacccaatggatgttttggtcctgatgcangagcctgttattccgggttcattcctccgggcaagagcaattggccttatgcctatgattgaccagggtgaaaaggatgacaag

SEQ ID NO: 44741 - protein, 138 aa, Panicum virgatum
  misc_feature: Ceres CLONE 2021969
  misc_feature (52)..(138): Pfam Name: Pyrophosphatase Pfam Description: Inorganic pyrophosphatase
  misc_feature: SWISSPROT Homolog: EC 3.6.1.1 Inorganic diphosphatase
  misc_feature: Functional homolog of the protein sequence given in SEQ ID NO 50116
  misc_feature: Useful for making plants with modulated nitrogen use efficiency
  misc_feature (111)..(111): Xaa is any aa, unknown, or other
MSEEDKTAAAAEQPKRAPKLNERILSSLSRRSVAAHPWHDVEIGPGAPAVFNVVVEITKGSKVKYELDKKTGLIKVDRVLYSSVVYPHNYGFIPRTLCEDNDPMDVLVLMXEPVIPGSFLRARAIGLMPMIDQGEKDD

SEQ ID NO: 44742 - DNA, 706 bp, Panicum virgatum
  misc_feature: Ceres CLONE 2021979
  misc_feature: Encodes the peptide sequence at SEQ ID NO. 44743
tgctagtatagtggcagtagcgctctcgggcagtgcgtttgcgcggtagctatcttttgctctgcttgcttgccatggccgatcagcaccggggagggatgggaggcggcggcggcgagacgcagcagaggcagggcgccatgatgacggccctgaaggcggcgacggccgcgaccgccggcgggtcgatgctggtgctgtccgggctgatcctggccggcaccgtgatcgcgctcacggtggcgacccccgtgctggtgatcttcagcccggtgcttgtgccggcggccatcgcgctggcgctcatggccgccgggttcgtcacctccggcggcctcggcgtggccgcgctgtccgtgttctcgtggatgtacaagtacctgacgggcaagcacccgccgggcgccgaccagctggaccacgccaaggcgcggctggcgtccaaggcccgcgacatcaaggatgcggcgcagcaccgcatcgaccaggcccagggatcttaagggtataagatacaaagcggatcgcgcatgccctgcgtgtccagtgcggggcggcgcacgaccaccgccggtgcggcatggcctacggcagccgccgcagcgccgcgctagctagctgatcgttatgatatgttgtgctttgtatgtgcatgtgtccgtgggttgctgtgcgtttttcttggtcgtagtggcgggtcggatgt

SEQ ID NO: 44743 - protein, 142 aa, Panicum virgatum
  misc_feature: Ceres CLONE 2021979
  misc_feature (22)..(132): Pfam Name: Oleosin Pfam Description: Oleosin
MADQHRGGMGGGGGETQQRQGAMMTALKAATAATAGGSMLVLSGLILAGTVIALTVATPVLVIFSPVLVPAAIALALMAAGFVTSGGLGVAALSVFSWMYKYLTGKHPPGADQLDHAKARLASKARDIKDAAQHRIDQAQGS

SEQ ID NO: 44744 - DNA, 573 bp, Panicum virgatum
  misc_feature: Ceres CLONE 2021982
  misc_feature: Encodes the peptide sequence at SEQ ID NO. 44745
gtttttcatcgttgtcagcaactataagacaactactctcccttaaggctgctggaaatgaattatttcaagctaggagatattcagatgctgtggaacaatattcagcggctttggcatgcaatagtgaatcacgcccgttttcagctgtctgtttttgcaatcgtgcagctgcatatcaagcacttggacaggttactgatgcaatagcagattgctcacttgccatggttcttgatgcaaattatctaaaggcaatttcaaggcgagccaccttatacgagatgataagagattatgggcaagctgccaatgatgtaaggaagctaatcttgcttcttgaaaagaaagtcaatgtgtctggattatcaccaaaagtttttaacaagcacagtgatctcaagcaagcacgcgcgcggctctcatccatagaggatgaagcaaaaaaggatgctccgctgaatttgtatttaatcttgggagtggagccatcctgctctgcagcagatatcaagaaggcatataggaaagctgcattgaaacatcacccagacaaagctgctcaattactag

SEQ ID NO: 44745 - protein, 190 aa, Panicum virgatum
  misc_feature: Ceres CLONE 2021982
  misc_feature (49)..(82): Pfam Name: TPR_1 Pfam Description: Tetratricopeptide repeat
  misc_feature (154)..(190): Pfam Name: DnaJ Pfam Description: DnaJ domain
  misc_feature: SWISSPROT Homolog: EC 3.1.3.16 Phosphoprotein phosphatase
FSSLSATIRQLLSLKAAGNELFQARRYSDAVEQYSAALACNSESRPFSAVCFCNRAAAYQALGQVTDAIADCSLAMVLDANYLKAISRRATLYEMIRDYGQAANDVRKLILLLEKKVNVSGLSPKVFNKHSDLKQARARLSSIEDEAKKDAPLNLYLILGVEPSCSAADIKKAYRKAALKHHPDKAAQLL

SEQ ID NO: 44746 - DNA, 1347 bp, Panicum virgatum
  misc_feature: Ceres CLONE 2021987
  misc_feature: Encodes the peptide sequence at SEQ ID NO. 44747
aactaacgctaaaaaagtaacagtttctgtactttattgcggagattgccattagctccggccgattcacgtcaccccaaccacttcaccgctacaccacatgttccgcctgtccaacctccaccgcctcgccacgaaggccgctgtctgcctcccgaaggagctgcaccagcgcggcgcgacccggctccgaatttctaatcctctttcctctattcctctccgcccccaccaccgccgcccaccacctccgccgccgtctccgcggcctcttcggccggaaccctagcctcgcctcggccgcctccgccgctcctgtcgggcggtcgtggtgcggccggacggccgcgatggacgaatccggctcggcccccatcttcccgaacgtgcgcacccccgaggacgtgttcagggacttccgcggccgccgcgccggcatcatcaaggccctcaccaccgatgtggagaagttctacaagatgtgcgacccagagaaggagaacttgtgcctctatggactatctaatgaaacctgggaagtgacccttccagctgaggaagttcctcctgaacttccagagccagcactgggaataaactttgctcgtgatggaatggctgagaaagattggctcacgctggttgctgtacacagtgatgcttggttaattgctgtggcattttactttggagctcgctttggatttgataaagatgccaggagacggctctttatgatgatcagtaatcttcccactgtatatgaagttgtgacaggaagtgggaagaagcaatcaaaaccccccaacagcaatggcaaaagcaagtcgggttctaaaccatccaagaaacccaattcgaatagcaagccagcaaagcagcccctgccaaagcaggaggaacagatggtcaaagaagagggaggtgacaaggatcaagcttacctgtgcggaacctgtggtaggagctattctaataatggtgaattctggataggctgtgacatttgtgagaactggtaccatggcgaatgtgtccgcatcactcccgccaaggcagagcacatcaagcagtacaagtgcccggcttgcagcaccaagaggagcagagactgagcgtgggatgctcctggctgatgtagtttgggttggtagggcttgagccggggcattcttgtttcctgctgtttcagcagcgccagttgccccggcagttgtattagtgtcatcaaaacattgggcgtagttgttagtactgtagagaccgctgctgctctcctagtgccctagaagtgttatgttaatggattgtcaaaactctccatgagtaacgaagtggtttcttagc

SEQ ID NO: 44747 - protein, 254 aa, Panicum virgatum
  misc_feature: Ceres CLONE 2021987
  misc_feature (199)..(250): Pfam Name: PHD Pfam Description: PHD-finger
  misc_feature: SWISSPROT Homolog: EC 2.1.1.43 Histone-lysine N-methyltransferase
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50175
  misc_feature: Useful for making plants with altered lignin content
  misc_feature: Useful for making plants with modulated flowering time
MDESGSAPIFPNVRTPEDVFRDFRGRRAGIIKALTTDVEKFYKMCDPEKENLCLYGLSNETWEVTLPAEEVPPELPEPALGINFARDGMAEKDWLTLVAVHSDAWLIAVAFYFGARFGFDKDARRRLFMMISNLPTVYEVVTGSGKKQSKPPNSNGKSKSGSKPSKKPNSNSKPAKQPLPKQEEQMVKEEGGDKDQAYLCGTCGRSYSNNGEFWIGCDICENWYHGECVRITPAKAEHIKQYKCPACSTKRSRD

SEQ ID NO: 44748 - DNA, 659 bp, Panicum virgatum
  misc_feature: Ceres CLONE 2021997
  misc_feature: Encodes the peptide sequence at SEQ ID NO. 44749
atccctgagctctagaggtcgtcttcttccttggccttgtgtggttaagagtgagagcgagctagagcgccgcgaaaatgccgatcaacaggatcgccgtcgggagccaccaggaggtgtaccacccaggtgccctcaaggcggcgttcgctgagttcatctccaccctcatcttcgtcttcgccggccagggctccggcatggccttcagcaagctcagcagcggcggcgcgacgaccccggccgggctgatctccgcggcgatagctcacgccttcgccctgttcgtggcggtctccgtgggcgccaacatctccggcggtcacgtgaacccggccgtgaccttcggcgccttcgtgggcggcaacatcaccctgttccgcggcctcctctactggatcgcccagctgctgggctccaccgtggcgtgcttcctcctccgcttctccacgggcgggctcgccacgggcaccttcggcgtcaccggcgtctccgtgtgggaggcgctcgtgctcgagatcgtcatgaccttcggcctcgtctacaccgtgtacgccacggccgtggaccccaagaagggcagcttgggcaccattgctcccatcgccatcggcttcattgttagcgccaacatcctggttggtgggcccttctccggg

SEQ ID NO: 44749 - protein, 193 aa, Panicum virgatum
  misc_feature: Ceres CLONE 2021997
  misc_feature (13)..(193): Pfam Name: MIP Pfam Description: Major intrinsic protein
MPINRIAVGSHQEVYHPGALKAAFAEFISTLIFVFAGQGSGMAFSKLSSGGATTPAGLISAAIAHAFALFVAVSVGANISGGHVNPAVTFGAFVGGNITLFRGLLYWIAQLLGSTVACFLLRFSTGGLATGTFGVTGVSVWEALVLEIVMTFGLVYTVYATAVDPKKGSLGTIAPIAIGFIVSANILVGGPFS

SEQ ID NO: 44750 - DNA, 738 bp, Panicum virgatum
  misc_feature: Ceres CLONE 2022012
  misc_feature: Encodes the peptide sequence at SEQ ID NO. 44751
accagcatcatcacccgcttcatgtacgacaaattcgacaacacctaccaggctacaattggtattgatttcctgtccaagacaatgtatcttgaagatagaaccgtgagactccaactctgggatactgctggacaggaaagattcaggagtttaattccaagctatatcagagactcttcagttgctgtcattgtattcgatgttgcaagcaggcagtctttcttaaatacatcaaaatggatagaggaagttcgcactgagaggggcagtgatgttatcattgttcttgttggcaacaaaactgaccttgttgacaagaggcaagtctcaatagaggaaggggaaggcaaggcaaaagaccttggtgtcatgtttatcgaaaccagtgctaaagctggctttaacattaaggctttgttccgtaagattgcggctgcgcttcctgggatggagaccctctcatcagcgaagcaggaagacatggttgatgtgaacttgaggtccggcaatgcaaactcatcccagtctcaggctcaggctgggggatgcagttgttagttgcagtccctgacacttgctgcttatgatctcgagaccctgagtgttggaacgcgttatctctgctgtttctctaaggaaggagagttgattgtctctcatcactcatcagtgaatctcaccatagtctttacccggtgaatggaccatttgtgttggaatgataccttttatgag

SEQ ID NO: 44751 - protein, 186 aa, Panicum virgatum
  misc_feature: Ceres CLONE 2022012
  misc_feature (1)..(150): Pfam Name: Ras Pfam Description: Ras family
  misc_feature: SWISSPROT Homolog: EC 2.7.11.1 Non-specific serine/threonine protein kinase
TSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLRSGNANSSQSQAQAGGCSC

SEQ ID NO: 44752 - DNA, 662 bp, Panicum virgatum
  misc_feature: Ceres CLONE 2022019
  misc_feature: Encodes the peptide sequence at SEQ ID NO. 44753
aaaaagaaaatagagtcccctgagagcggcgcaggcggctgtagtcggccgccggccacgcgcccggccgtgaaccctagatgacgccggcgaacggtgcatcagcgccagaagcggtggtggaggcagcgctgccccccgaggtggagtccgaggccgacgcgttccagcgccaggtcgacgacctcgtctccaagaccgacgtgctggagaggcaggtgaacgaggtggtggacttctacgatggaaagaagcacggcagcggcggtcgtaagggcggcaggtatggggcatacgggagggggatgcccgaccttatgcgccagttcggcgtgattttacgagagatcaccgatgataaggattcatggccatttcgggagccagtggatgttgtaggactgcaacttcatgactattacaagattattaccaaacctatggacttctctactattcaaaataaaatggaagggaaggatgttaccacttacaaaaatgttcgagaaatatgtgcggatgttagattaatttttgccaatgcaatgaagtacaatgatgacgagaatattgtccacttgcttgctaaatcattacttgagaaatttgaagagaagtggcagcaatttctttctaaagttgagagtgaggaaaaaagacaa

SEQ ID NO: 44753 - protein, 193 aa, Panicum virgatum
  misc_feature: Ceres CLONE 2022019
  misc_feature (79)..(171): Pfam Name: Bromodomain Pfam Description: Bromodomain
  misc_feature: SWISSPROT Homolog: EC 2.3.1.48 Histone acetyltransferase
MTPANGASAPEAVVEAALPPEVESEADAFQRQVDDLVSKTDVLERQVNEVVDFYDGKKHGSGGRKGGRYGAYGRGMPDLMRQFGVILREITDDKDSWPFREPVDVVGLQLHDYYKIITKPMDFSTIQNKMEGKDVTTYKNVREICADVRLIFANAMKYNDDENIVHLLAKSLLEKFEEKWQQFLSKVESEEKR

SEQ ID NO: 44754 - DNA, 931 bp, Panicum virgatum
  misc_feature: Ceres CLONE 2022022
  misc_feature: Encodes the peptide sequence at SEQ ID NO. 44755
ataaatcagtctttaaaaaacacaaaaaattaccattcccatacatatctttccaatttcccatgaccggcatattcactttcaagccaattgaagctaaactcatcgacgaaagagacgttctccgtcaaaccgacccttattgcgccttcatgttcactcgcaaaaaagtcatcagccaagtttgcacctctggtggcaaacaccctacttggaacgacactatcgttgttcccctcgatgtcgaccaaccagcttgtgtggttgagcttctcgataaagaaaagaccttaccagatgacagtattggaacttttgtgattgatctttacgaaatcagaagaagaggccacattgacaagtggtaccaagtttattataaggaccagccagctggatggatccatatcgagtcaaaattccaacattttcaggactctgatgatgagaaagaaactggcacctcctcaatgaaggccaaagatatcataaaaacgccccttgtgttggaagaagaatttaacaagtcttctgctggctgcggcgctgtaaaagaacctatccgtaattgaaatggaagaaaaaggttcgccttataattaatacaatgaggagatgagatcttctcataaccagtctactacctcttgatatatttatccacctttttcatactgccttaatatctcataaaatgagtaaaatatttgaatatacatattcaatccagctactttatgaatcatacccggctatatttttgtaaataatcggtaaatctttttaaatatatatacagtatgatttcttgatggtttgaatgctcactcaagcaaaataaacctctctcttttccgagagaaaaagagacgtaaagtttgattgtttaatgagcttgcaccaggccttgagaaattccatctattaatcg

SEQ ID NO: 44755 - protein, 169 aa, Panicum virgatum
  misc_feature: Ceres CLONE 2022022
  misc_feature (5)..(86): Pfam Name: C2 Pfam Description: C2 domain
MTGIFTFKPIEAKLIDERDVLRQTDPYCAFMFTRKKVISQVCTSGGKHPTWNDTIVVPLDVDQPACVVELLDKEKTLPDDSIGTFVIDLYEIRRRGHIDKWYQVYYKDQPAGWIHIESKFQHFQDSDDEKETGTSSMKAKDIIKTPLVLEEEFNKSSAGCGAVKEPIRN

SEQ ID NO: 44756 - DNA, 674 bp, Panicum virgatum
  misc_feature: Ceres CLONE 2022024
  misc_feature: Encodes the peptide sequence at SEQ ID NO. 44757
gactcgacttcctccgcgaaccgccaccgccacctcacccaccacctcgccggagatcacgagaggagcctcgccgctgccccccccgcccgccatgggggatgccgcttccggccgcggccacgttgtctaccctccccgctccgccgaggacatcttcaaggactaccgcgcccgccgctccgccatcctccgggccctcacccatgagaaggagaacctctgcctgtacgggtacgcgaacgaggcctgggaggtggcgctgccggcggaggaggtgccaacggagctgccggagcccgcgctggggatcaacttcgcgcgcgacggcatgaatcgccgcgactggctcgcgctcgtcgccgtccactccgactcatggctcctctccgtcgctttctactacgctgctcggctcaatcggaatgaccggaaacgtttatttggtatgattaacgaattgcaaactgtttttgaagttgtctccggtgcgagacaacaacaatctaaggagaggtccagtatggacaatggtgggagggccaaaccctcagtaaagatagaaaataacggaaaagcatcagaagatgcatacggagaagatgacagtgatcacggtgaaactctatgtggtacctgtggtggtatatacagcgcagatgagttctgggatt

SEQ ID NO: 44757 - protein, 193 aa, Panicum virgatum
  misc_feature: Ceres CLONE 2022024
  misc_feature: Functional homolog of the protein sequence given in SEQ ID NO 50175
  misc_feature: Useful for making plants with altered lignin content
  misc_feature: Useful for making plants with modulated flowering time
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1981 in the 11/479,226 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
MGDAASGRGHVVYPPRSAEDIFKDYRARRSAILRALTHEKENLCLYGYANEAWEVALPAEEVPTELPEPALGINFARDGMNRRDWLALVAVHSDSWLLSVAFYYAARLNRNDRKRLFGMINELQTVFEVVSGARQQQSKERSSMDNGGRAKPSVKIENNGKASEDAYGEDDSDHGETLCGTCGGIYSADEFWD

SEQ ID NO: 44758 - DNA, 722 bp, Panicum virgatum
  misc_feature: Ceres CLONE 2022026
  misc_feature: Encodes the peptide sequence at SEQ ID NO. 44759
atccgcacattcattctattctagattgcatcacaaaagaacattcttgtaatagtcacgcaattgcagcttctgggcctgcagttgtttaacactaccgatccatcatcagcatgacaatcaagtcttgtctggtactgctgctccctttggcactgctgcttctcgccagcagctcgccggcagcggcccagctggaggtcggctactacagcaagacgtgcccgaacgtcgaggccatcgtccgagaggagatggagaaaataatctccgccgcgcccagcctcgccggcccgctcctcaggctccatttccacgactgcttcgtcaggggttgtgatgcctccgtcctgctcaactccagcgagggcaacctggccgagcgggacgccaagccgaacaagagcctgcggggcttcggttctgtgaacagggtgaaggccaagctcgaggccgcctgccccaacaccgtctcctgcgccgacgtcctcaccctcatggcgcgcgacgccgtcgtgcttggcaagggccccttctggcccgtcgcgctggggaggagagacggcagcgtgtccagcgccacggaggcggccgaccagctgccgcccgccaacggtgacgtcccgctgctcgccaagatcttcgcctccgaggggctcgaccctcaagacctcgtcgtcctctccggtgcgcacaccctcggcacggcacactggccgtcg

SEQ ID NO: 44759 - protein, 202 aa, Panicum virgatum
  misc_feature: Ceres CLONE 2022026
  misc_feature (44)..(201): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51272
  misc_feature: Useful for making plants with altered carbohydrate content
  misc_feature: Functional homolog of the protein sequence given in SEQ ID NO 51443
  misc_feature: Useful for making plants with altered cell wall content and/or composition
MTIKSCLVLLLPLALLLLASSSPAAAQLEVGYYSKTCPNVEAIVREEMEKIISAAPSLAGPLLRLHFHDCFVRGCDASVLLNSSEGNLAERDAKPNKSLRGFGSVNRVKAKLEAACPNTVSCADVLTLMARDAVVLGKGPFWPVALGRRDGSVSSATEAADQLPPANGDVPLLAKIFASEGLDPQDLVVLSGAHTLGTAHWP

SEQ ID NO: 44760 - DNA, 611 bp, Panicum virgatum
  misc_feature: Ceres CLONE 2022032
  misc_feature: Encodes the peptide sequence at SEQ ID NO. 44761
atatttcttttcttgtatcatcgcttcagagttcggacagccgcaggcaagaagaaatggagtctgcaaggacttgctcccagcccgagccggagccggcggcgccgccgtccgctgccggcggcgccgccgcccgctgccggcggccgggactggtcggagctgccgctggacgcgctggtgcaggtcttcgccaggctcggccccgtcgagatcctcatgggctcggggctcgcgtgccgctcgtggctgcgggcggccagggagcccgagctgtggcggttcgtggacatggcgagccacagattggtggaggagatggacggagacgtcctccgcgccatagcggaggtggccgtcgaccgcgccggagggaagatggaggcgttctccgggaagtacttcgtcactgacgaccttctcaagtacataggggacaggtcagcatctctgaaaaccctcggcctcatatcatgccacgaggtctccaacaagggattcaccgaacttgtcaagaagtcacccctgctggaggacctctccctcgagctctgcccgaaaatcggcggtcgcagcgtgtacgagtccccgggcaaagcgtgcccccggct

SEQ ID NO: 44761 - protein, 203 aa, Panicum virgatum
  misc_feature: Ceres CLONE 2022032
  misc_feature (50)..(98): Pfam Name: F-box Pfam Description: F-box domain
IFLFLYHRFRVRTAAGKKKWSLQGLAPSPSRSRRRRRPLPAAPPPAAGGRDWSELPLDALVQVFARLGPVEILMGSGLACRSWLRAAREPELWRFVDMASHRLVEEMDGDVLRAIAEVAVDRAGGKMEAFSGKYFVTDDLLKYIGDRSASLKTLGLISCHEVSNKGFTELVKKSPLLEDLSLELCPKIGGRSVYESPGKACPR

SEQ ID NO: 44762 - DNA, 700 bp, Panicum virgatum
  misc_feature: Ceres CLONE 2022038
  misc_feature: Encodes the peptide sequence at SEQ ID NO. 44763
gccgcggccggcgctagccaaagctcttttctttcttccgtgtctgctgcttcctccccccaccccgtccgtctccgattgcgagagcgagttgttgcggcgcactgaacccctgcagcctgcagcaggaggaggaggagctccttcgccgccccgctgggcttccctgtcccgaggatagatgggttccgaggggccttctcccgtcaccgttcatgtgaccggattcaagaggttccatggagttgcagaaaacccgaccgagaaaatcgtgcgcaatctccggtcctttgtggagaagagggggctgcccaagggacttgtgcttggaagctgcactgtccttgaggcggccgggcagggcgcactaggtccactgtatgaattgttggagtcaactgtacaggaccgggaatatggaacactgaatcaagagcaagtaattctgctccattttggagccaacagtggttcacttaggtttgctcttgagaatcaagctgttaatgaagctactttccgttgccctgatgagctaggatggaaaccacagagggttcctatcatgtcatctgatggaagcatcttgcatgcaagacagactacactgccagtgaaggaaataagcaaatatctccaacaaatgggatacgatgtgacaccttcagatgacgctggtcgatttgtgtgcaactatgtc

SEQ ID NO: 44763 - protein, 172 aa, Panicum virgatum
  misc_feature: Ceres CLONE 2022038
  misc_feature: SWISSPROT Homolog: EC 3.4.19.3 Pyroglutamyl-peptidase I
MGSEGPSPVTVHVTGFKRFHGVAENPTEKIVRNLRSFVEKRGLPKGLVLGSCTVLEAAGQGALGPLYELLESTVQDREYGTLNQEQVILLHFGANSGSLRFALENQAVNEATFRCPDELGWKPQRVPIMSSDGSILHARQTTLPVKEISKYLQQMGYDVTPSDDAGRFVCNY

SEQ ID NO: 44764 - DNA, 707 bp, Panicum virgatum
  misc_feature: Ceres CLONE 2022041
  misc_feature: Encodes the peptide sequence at SEQ ID NO. 44765
agataagatcgagctcggggaggttggggccgaaaagaaaaagaaaaatcatctccaatctccaatcaagttaaccctagcagccgccggcggttagggtttcgagcgagatggcggcggcggcgtggcagcgcggcaccgtgaagtggttcaatgacaccaagggcttcggcttcatctcccccgaggacggcagcgaggacctcttcgtccaccagtcgtccatcaagtcggagggcttccgctccctcgccgagggcgaggaggtcgagttctccgtctcggagggcgacgacggccgcaccaaggccgtcgacgtcaccggccccgacggatcctacgtcaagggcggctccggcggcggcggcgggggcggcggcttcggatcccgcggcggggccggatctggcggcggtggccgcagctacggcggcagctggggcggcgggaggagatccggtggcgggggcggcgccggcgcctgctacaagtgcggggagcccggccacatggccagggactgccccagcgctgatggcggcggcggatacggcgggggcggctacggcggcggcggtggatacggcgggggcggctacggcggcggcggtggcggtggatgctttaagtgcggggagcctggccacatggccagggactgctccagcggcggttacggcggcggcggctacggaggcggaggcgga

SEQ ID NO: 44765 - protein, 198 aa, Panicum virgatum
  misc_feature: Ceres CLONE 2022041
  misc_feature (6)..(73): Pfam Name: CSD Pfam Description: 'Cold-shock' DNA-binding domain
  misc_feature (123)..(140): Pfam Name: zf-CCHC Pfam Description: Zinc knuckle
  misc_feature (169)..(186): Pfam Name: zf-CCHC Pfam Description: Zinc knuckle
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 468 in the 11/479,226 US patent application
MAAAAWQRGTVKWFNDTKGFGFISPEDGSEDLFVHQSSIKSEGFRSLAEGEEVEFSVSEGDDGRTKAVDVTGPDGSYVKGGSGGGGGGGGFGSRGGAGSGGGGRSYGGSWGGGRRSGGGGGAGACYKCGEPGHMARDCPSADGGGGYGGGGYGGGGGYGGGGYGGGGGGGCFKCGEPGHMARDCSSGGYGGGGYGGGG

SEQ ID NO: 44766 - DNA, 693 bp, Panicum virgatum
  misc_feature: Ceres CLONE 2022043
  misc_feature: Encodes the peptide sequence at SEQ ID NO. 44767
agtctccacctgcaccttactgcaaggcaaagccaagaaaccaagaacacgccatggcaccagcgacggccaagcttctctccctcgccttcctcctcctcgcggcggcctcgtcgacaccggcggtggccaccacgctgacgctccacaacctctgcccgtacccattgtggccgctggtaaccccgaacaccggcttcccttccatctccgacaacacgggccgcctggacggcggcgggcgcggcctcgtctccttccacttcccgccaagcttctgggcgggccgcgtggtggcgcgcacgggctgcggcggcagcgcgtgcgagactggcgcctcgccgccggcgacggtggtgcagctggcggtgcacgcggagggccaggacctggcggcgtacagcgtaagcctggtggacgggttcaacgtcgccgccgtggtgagcccgcaggcggtgggcagcgggcagtgccccgccctcgggtgcgcggcggacctgaacgccgggtgcccccgcgcgcagcgcgtggtcggggcccgcggcgaggtggtggcgtgccggggccccgcggggtacttcaaggagcggtgcccgctgacgcgcaccacgcccgccgacgtggagcccgtgccgcagcggtgcttcggccccggcgagctcaaggtcgtcttctgccagcccgccatggtga

SEQ ID NO: 44767 - protein, 213 aa, Panicum virgatum
  misc_feature: Ceres CLONE 2022043
  misc_feature (33)..(210): Pfam Name: Thaumatin Pfam Description: Thaumatin family
MAPATAKLLSLAFLLLAAASSTPAVATTLTLHNLCPYPLWPLVTPNTGFPSISDNTGRLDGGGRGLVSFHFPPSFWAGRVVARTGCGGSACETGASPPATVVQLAVHAEGQDLAAYSVSLVDGFNVAAVVSPQAVGSGQCPALGCAADLNAGCPRAQRVVGARGEVVACRGPAGYFKERCPLTRTTPADVEPVPQRCFGPGELKVVFCQPAMV

SEQ ID NO: 44768 - DNA, 722 bp, Panicum virgatum
  misc_feature: Ceres CLONE 2022045
  misc_feature: Encodes the peptide sequence at SEQ ID NO. 44769
gcagccggccggacttgttcttcttcttcttcctgttcgttccttcacaaggcggagagctccttcctttgatcgatcccccgctgcaatccgaatcccatcgcagagcaggagcgacaggaggtccgtcgacccgtggtgttcggttggagatttgactgtcgctgctgcaatggccgccgccgctccatgtctggcgccggtgccgtccccgtcccagtcccctgccacgtcgccgacgaccgcgtcgcccaaggccggcgacaggaaggtggtgccgctgacggcggccgacgaggtggagctggaggagaagcacgtgctggcggtcgacgacagctccgtcgaccgggccgtcatcgccaagatactacgcagctccaagtacagagtgaccacggtcgattcggcgacgagggcgctggagctgcttacactgggcctgctgccggacgtgaacatgatcatcacggactactggatgcccggcatgaccgggtacgagctcctcaagcacgtcaaggagtcgtccaagctcaaggagatcccggtggtgatcatgtcgtcggagaacgtgcccaaccggatcagccggtgcctggaggagggcgccgaggacttcctcctcaagcccgtccgcccctccgacgtctcccggctctgcagccggatccgatgatcggccccccggcggagtccgctaggactgataatttacgctt

SEQ ID NO: 44769 - protein, 168 aa, Panicum virgatum
  misc_feature: Ceres CLONE 2022045
  misc_feature (48)..(168): Pfam Name: Response_reg Pfam Description: Response regulator receiver domain
  misc_feature: SWISSPROT Homolog: EC 2.7.13.3 Histidine kinase
  misc_feature: The sequence is a functional homolog of SEQ ID NO 932 in the 10/666,642 US patent application
  misc_feature: Functional homolog of the protein sequence given in SEQ ID NO 51179
  misc_feature: Useful for making plants with modulated low light sensitivity
  misc_feature: Useful for making plants with modulated nitrogen use efficiency
MAAAAPCLAPVPSPSQSPATSPTTASPKAGDRKVVPLTAADEVELEEKHVLAVDDSSVDRAVIAKILRSSKYRVTTVDSATRALELLTLGLLPDVNMIITDYWMPGMTGYELLKHVKESSKLKEIPVVIMSSENVPNRISRCLEEGAEDFLLKPVRPSDVSRLCSRIR

SEQ ID NO: 44770 - DNA, 750 bp, Panicum virgatum
  misc_feature: Ceres CLONE 2022050
  misc_feature: Encodes the peptide sequence at SEQ ID NO. 44771
atgctagaaaaaggttacacgagaaaaatcaaatcaggagacggagattcgagagagctccgcccggtagggaagggaagaggaggcgaaggggaggagcgaggaggtgccgaggcgggatgggggcggtcgagtccgtgccggagacctccatacacgaattcaccatcaaggattgcaacggcaaggaagtgagcctggagacctacaaggggaaggtcctcctcgttgtcaacgtcgcctccaaatgtgggttcacggagaccaattacacgcagctgacggagctttatcagaagtacagggacaaagtttcagggaccatttggatagtgatactaacttacagacacctgacgaaggcgaacaaaaaaagttctgaaagaaggcaatgggaactctgttttccaatgaagatatttgcttccatgaggattatttcaccaaatttgttgaacaactccataaattgaaagaaagcatcacacttagttaccagccaccaagcatcaaattatgggcagcgttcagtggaattaaatcaaaactgcaaggagttcaaatgatacctaaaagtcaacgatatttatatgttgttacttatgcatcaaatactgtatcctgttacgcatttgcatcgaaataactttattgcgggtggctatcaaaccaattatcttatgcaaccttacatcaaaattaatttgtgggtgatattccattgaactgttctgtctttattctctggat

SEQ ID NO: 44771 - protein, 117 aa, Panicum virgatum
  misc_feature: Ceres CLONE 2022050
  misc_feature (12)..(105): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50170
  misc_feature: Useful for making plants with modulated flowering time
MGAVESVPETSIHEFTIKDCNGKEVSLETYKGKVLLVVNVASKCGFTETNYTQLTELYQKYRDKVSGTIWIVILTYRHLTKANKKSSERRQWELCFPMKIFASMRIISPNLLNNSIN

SEQ ID NO: 44772 - DNA, 882 bp, Panicum virgatum
  misc_feature: Ceres CLONE 2022062
  misc_feature: Encodes the peptide sequence at SEQ ID NO. 44773
aaacaaacgctaaaaaagtaacagtttctgtactttattgtccgatgcccggcaaggagaagaagatcgcgccgaaggcggcgaagaaggcggcggagccggtgaagaaggcgcccgtggagccgtccaagttcgcgtcccgcccgaagaacttcggcgtcggccgcgacacgccgtacagccgtgacatctcccgcttcatgcgctggccgcgtttcgtgaccatgcagcgcaagaagcgtgtgctgcagcgccgcctgaagacgccgccggcgctggcccagttcgccaagaccctggaccgctcgacccgcactgaggtgttcaagctgctgaagaagtacgcgccggagtcccgcaaggagcgcgcgacgcgcctgaaggccgctgccgccacgaagacgacggactcgaagaagaccgtgtcgacgaaggcgccgctcgccgtggtcacgggcatccaggaggtgacccgcgccatcgagaagaagcaggcgaagctcgtggtcatcgcgtgcaacgtggacccgatcgagctcgtgctctggatgccggccctgtgccgcgcccagaagatcgcgtactgcatcgtcaaggacatggcgcgcctcggtgacgtgatcggccagaagaccgccacgtgcgtcgcgatcaaggccgtgaagagcgaggacgaggccacgctcaaggccgtgacgaagtcggtcaacgctcgcttcctgtctcgcacgaaggagctcacgcgccagtggggcggcctcaagctgtcgctgcgctcgcgcgcggcgcagcgcaagtaccacgcggctcgcgctggtgccaaggtcgagtccaagtaaacgcatcctgccatcggactttctagcacacctctcatgtttg

SEQ ID NO: 44773 - protein, 264 aa, Panicum virgatum
  misc_feature: Ceres CLONE 2022062
  misc_feature (121)..(216): Pfam Name: Ribosomal_L7Ae Pfam Description: Ribosomal protein L7Ae/L30e/S12e/Gadd45 family
MPGKEKKIAPKAAKKAAEPVKKAPVEPSKFASRPKNFGVGRDTPYSRDISRFMRWPRFVTMQRKKRVLQRRLKTPPALAQFAKTLDRSTRTEVFKLLKKYAPESRKERATRLKAAAATKTTDSKKTVSTKAPLAVVTGIQEVTRAIEKKQAKLVVIACNVDPIELVLWMPALCRAQKIAYCIVKDMARLGDVIGQKTATCVAIKAVKSEDEATLKAVTKSVNARFLSRTKELTRQWGGLKLSLRSRAAQRKYHAARAGAKVESK

SEQ ID NO: 44774 - DNA, 1296 bp, Panicum virgatum
  misc_feature: Ceres CLONE 2022068
  misc_feature: Encodes the peptide sequence at SEQ ID NO. 44775
acgacacaaatcgaagagtggagaagagagagagagcagccacctctacctcggagcgcagcccccatcgctcctcacctggtgcgctgggctctacgcctctactggtgctcgctcgctggccggcgtcggagccagttcagctccagtcgattcggccgtgggagctgttgttgctgccgcagggcctccgctggggcgcggtgctgcgtgccggtactcccggcgctccggcaagggcctcatcctctgatctggcctgggcgtggtcgccaccaggagaggccgcgcactgggaagcgaagcacgcagccgccttgagttcgccggaggaatcggcgtgctaacggttttgcgggaggaatcggcgtgcgacgggataaggtaagcatggaggcggcggggaagacggtgtgcgtgaccggagcgggcggcttcgtggcgtcgtggcttgtgaagctcctcctgtcccggggccagtacatggtccgcggcactgtgcgcgaccctggtgctagcaagaatgctcatctcaaggcattggatgatgctggggaaaggttgcagcttctcaaagctgatttgctggactacaacaacgttgcatcagcggtttctggctgtgagggtgtcttccatgtagctagccctgttccctctggtcgatcctccaaccctgaggtggaggtcataggtcctgctgtcacaggtactgccaatgtgttaaaggcttgctatgaggcaaaagttggtcgagttgtggtggtgtcttctattgcagctgtgtccaataatcctaactggcccaagggcaaggcttttgatgaagatagctggtcagatgaggagtactgcaggaagaatgaggattggtacaacctttctaaaactctggcagaacgtgaggcctttgcttatgcagaaaaaacggggctggatgttgtagctatttgcccgtcattggtacttggacccttgatgcaatctacaataaatgcaagcagcaaaatcctccttaattatttcaaaggggatcgtgacaccgttgaaaataggctcagaaatattgtggatgttcgcgacgttactgatgctcttcttctggcatatgaaaaaccagaggcatctggacgatacatctgcagttcacatccaataaaagtttctgacatgataaacatattgaagaacttatatccaacttactcttatcccaagaacttttgtggaagtggaagaaaattttgtatacaattctgagaaacttcagaagctaggatggacttttaggcctat

SEQ ID NO: 44775 - protein, 289 aa, Panicum virgatum
  misc_feature: Ceres CLONE 2022068
  misc_feature (8)..(252): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Functional homolog of the protein sequence given in SEQ ID NO 50651
  misc_feature: Useful for making plants with altered carbohydrate content
  misc_feature: Functional homolog of the protein sequence given in SEQ ID NO 50652
  misc_feature: Useful for making plants with altered cell wall content and/or composition
  misc_feature: Functional homolog of the protein sequence given in SEQ ID NO 50653
  misc_feature: Useful for making plants with altered lignin content
MEAAGKTVCVTGAGGFVASWLVKLLLSRGQYMVRGTVRDPGASKNAHLKALDDAGERLQLLKADLLDYNNVASAVSGCEGVFHVASPVPSGRSSNPEVEVIGPAVTGTANVLKACYEAKVGRVVVVSSIAAVSNNPNWPKGKAFDEDSWSDEEYCRKNEDWYNLSKTLAEREAFAYAEKTGLDVVAICPSLVLGPLMQSTINASSKILLNYFKGDRDTVENRLRNIVDVRDVTDALLLAYEKPEASGRYICSSHPIKVSDMINILKNLYPTYSYPKNFCGSGRKFCIQF

SEQ ID NO: 44776 - DNA, 657 bp, Panicum virgatum
  misc_feature: Ceres CLONE 2022091
  misc_feature: Encodes the peptide sequence at SEQ ID NO. 44777
agattgtcattctgtaaattcaactacccccaaatgcaaaactattcctggtgacatcaactcaaagcttctaagaacccctccatgtgcattgcctggtattggcttgcatttgaatgcccttgctgcaataccaaaagaaaaaatagtctgtcgagacatccaatctagtataaaaaatgaatccagtaattttccttgtcctgctggatcttctccaccgccttctgaacaaaacattataaatgatgagtttgctcaaagaaccgatgttgcaagcgctgaaccttctagtcagggtaatcccaagaagaaaaggcacaagtttgatgatggtacttcatgcaagcgttgtagctgtaagaagtcaaaatgcttgaaactttactgtgagtgttttgcggctggagtgtattgttctgaaccttgtacatgccaaggctgtctaaataacgagagtcttatggaaacagttctatctactcgacagcagattgaatctcgcaatccattagcatttgctcctaaagtaattcacacatctgagcctggcctggaactaggggacttcaacaacaaaactcctgcttcagctcgtcataaaagagggtgcaattgcaagaagtcatcgtgtctaaaaaaatactgtgaatgttt

SEQ ID NO: 44777 - protein, 218 aa, Panicum virgatum
  misc_feature: Ceres CLONE 2022091
  misc_feature (113)..(154): Pfam Name: CXC Pfam Description: Tesmin/TSO1-like CXC domain
DCHSVNSTTPKCKTIPGDINSKLLRTPPCALPGIGLHLNALAAIPKEKIVCRDIQSSIKNESSNFPCPAGSSPPPSEQNIINDEFAQRTDVASAEPSSQGNPKKKRHKFDDGTSCKRCSCKKSKCLKLYCECFAAGVYCSEPCTCQGCLNNESLMETVLSTRQQIESRNPLAFAPKVIHTSEPGLELGDFNNKTPASARHKRGCNCKKSSCLKKYCEC

SEQ ID NO: 44778 - DNA, 707 bp, Panicum virgatum
  misc_feature: Ceres CLONE 2022100
  misc_feature: Encodes the peptide sequence at SEQ ID NO. 44779
agcgggagagtcccttagcaacacacaagagaaaagagagggcgagcaagcaaaggcccaagcctaggacgatgggcgtgctcctgcttcttcacgtcctcctcgtcgcggtggcagcgagggctcctgccgctcaggcatggggcaaggagggccactacatggtgtgcaagatcgccgagagctttatgacggaacaggccaagacggcggtgaatggcctgctgccggggtgggccggcggcgacctcgccgagacgtgctcgtgggcggacaggcagcgtttccggtaccggtggtccagccccctccacttcgccgacaatccgggtgactgcaagttcgactacgccagggactgccacaacacgaaaggagagaaggacatgtgcgtggttggagcaatcaacaactacaccgctgcgctgaaggactcatcaagtccatatgatcggaccgagagcttgatgttccttgcacacttcgtcggcgacgtccaccagccgctccactgcggccgcgccgacgatctcggcggcaacaccatcatcgttcactggtacagaaggaagagcaaccttcaccatgtgtgggatgtgaacgtgattcagacagccatgaaggatttctacggcaacgatctaagcaccatgatacaggccatccagcggaacatctctggagagtgggctaacgaagagaaacgg

SEQ ID NO: 44779 - protein, 211 aa, Panicum virgatum
  misc_feature: Ceres CLONE 2022100
  misc_feature (24)..(211): Pfam Name: S1-P1_nuclease Pfam Description: S1/P1 Nuclease
  misc_feature: SWISSPROT Homolog: EC 3.1.30.1 Aspergillus nuclease S(1)
MGVLLLLHVLLVAVAARAPAAQAWGKEGHYMVCKIAESFMTEQAKTAVNGLLPGWAGGDLAETCSWADRQRFRYRWSSPLHFADNPGDCKFDYARDCHNTKGEKDMCVVGAINNYTAALKDSSSPYDRTESLMFLAHFVGDVHQPLHCGRADDLGGNTIIVHWYRRKSNLHHVWDVNVIQTAMKDFYGNDLSTMIQAIQRNISGEWANEEK

SEQ ID NO: 44780 - DNA, 738 bp, Panicum virgatum
  misc_feature: Ceres CLONE 2022104
  misc_feature: Encodes the peptide sequence at SEQ ID NO. 44781
catagggatgtgaaacctcagaatcttttggttgatcctttgactcaccaagtgaagatatgtgattttgggagtgccaaaatgttggtcaaaggtgaagcgaacatatcatatatatgctcacgttattaccgtgctccagagctcatatttggggcgactgagtacacaacatcaattgatatctggtcagctggatgtgttcttgctgagctgcttcttggccaacctctcgtccctggtgaaagtgctgtggatcagcttgttgagataataaaggttcttggtactccaacacgcgaggaaatccgatgtatgaacccgaactacactgaatttagattccctcagatcaaagctcatccatggcacaagattttccacaagcggatgcctccagaagctatagatctcgcttcacgtctgctccagtattcacctaatctacgatgcactgctcttgaagcatgcgcacatccattcttcgatgagttgcgagaaccacatgcaaggttgccaaatggtcggccattccctccactctttaactttaaacaggaactagcaaatgcttctcctgagcttatcaacaggttgatcccagaccatgctaggcggcatcttgggctcacttaaatccctgcaactggaccatagggaagctgtatggtgttttaccttgcgcttccgatgcttctttgtgccgaagggcaacctgcatgtcctcacatttaagat

SEQ ID NO: 44781 - protein, 211 aa, Panicum virgatum
  misc_feature: Ceres CLONE 2022104
  misc_feature (1)..(162): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
HRDVKPQNLLVDPLTHQVKICDFGSAKMLVKGEANISYICSRYYRAPELIFGATEYTTSIDIWSAGCVLAELLLGQPLVPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLT

SEQ ID NO: 44782 - DNA, 651 bp, Panicum virgatum
  misc_feature: Ceres CLONE 2022105
  misc_feature: Encodes the peptide sequence at SEQ ID NO. 44783
gtgctcataacctacatccaacaagcgttgcacatcttcagcctcactacccaccaccacacttttcttcaaccccccaaaccatcatcatgactggacgcggaaagggcggcaagggcctcggcaagggcggtgccaagcgtcatcgcaagattcttcgtgacaacatccagggtatcaccaagcccgctatccgccgtctggcgcgtcgtggcggtgtcaagcgtatctcagccatgatctatgaggagacccgcggtgtcctcaagtccttcctcgagggtgtcatccgtgacgccgtcacctacaccgagcacgccaagcgcaagacggtcacgtcgctcgacgtcgtctacgccctcaagcggcaaggccgcactctctacggcttcggcggctaaacgggccggcgccgtggcgacgactcttgatgacatttcagcgcgtttttcacacgtttttactctccatcggttatggttgggctgcgatgagttttatgggggcaactgggtttttattttcactttcggtctgtctgggttatgtgtaccatacgggggcggtcaacaatgggtgttttacacgggtggacataccaaaggcataatcgatgcgatctcctgcttgctgcggggcgcattcttgatc

SEQ ID NO: 44783 - protein, 103 aa, Panicum virgatum
  misc_feature: Ceres CLONE 2022105
  misc_feature (25)..(94): Pfam Name: Histone Pfam Description: Core histone H2A/H2B/H3/H4
MTGRGKGGKGLGKGGAKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 44784 - DNA, 676 bp, Panicum virgatum
  misc_feature: Ceres CLONE 2022108
  misc_feature: Encodes the peptide sequence at SEQ ID NO. 44785
attcgatcgagctgctagcagcagctgctacacatacagaggcgagctgcagatcatcggagatggcgaggctcaacgctgccgtgctacctctgtgcgtggcactgctcgccttctccctggccgggcagtcggccgccggcaggtactactcggaccaagtccaggacaaggtgaggaaggaagtggagaaggccatggcgtacaaccccagcatcggccccgccctcgtccgcttggtgttccatgactgctgggtaaatggttgtgatggatctgtgctcctggacaagacgcccaccgacggcaccaacaccgagaagaaggccgtcaacaacatcggcctcgccggcttcgaggtcatcgacaccatcaagcagaaggtcggcgccgccgcctcctgcgccgacatcctcgccttcgcggggcgcgacgcggccgacatcctcagccgcggcaacatcttctactccataccgggcggccgcaaggacggcgtcgtctcctccgccgcggccgcggacgccaacctccccgagtccaccttcgacttcggccagctgcagaccaacttcgccgcgcccggccgcaacttcaccgtcgaggagctcgtcgtcctctccggcgcgcactccatcggcgtcgcgcacctctcgtcctacaaggaccgcctcgg

SEQ ID NO: 44785 - protein, 204 aa, Panicum virgatum
  misc_feature: Ceres CLONE 2022108
  misc_feature (38)..(204): Pfam Name: peroxidase Pfam Description: Peroxidase
  misc_feature: SWISSPROT Homolog: EC 1.11.1.7 Peroxidase
MARLNAAVLPLCVALLAFSLAGQSAAGRYYSDQVQDKVRKEVEKAMAYNPSIGPALVRLVFHDCWVNGCDGSVLLDKTPTDGTNTEKKAVNNIGLAGFEVIDTIKQKVGAAASCADILAFAGRDAADILSRGNIFYSIPGGRKDGVVSSAAAADANLPESTFDFGQLQTNFAAPGRNFTVEELVVLSGAHSIGVAHLSSYKDRL

SEQ ID NO: 44786 - DNA, 530 bp, Panicum virgatum
  misc_feature: Ceres CLONE 2022113
  misc_feature: Encodes the peptide sequence at SEQ ID NO. 44787
taaattgaattaaacaattatcttaaaaaaaagagagagacatgtctgacaagaagctcagagttttcaagcttagaaacgcctctgatgaggacttgctcaagggtttggacgaatacaagaaggagctcaactcactcagaacccttaagatcaccggtggtacctctgccaagctcggcaaaatcagagttgtcagaaaggctattgctagatacttgactgttatcaaccaaagaaatcgccaaaaggtcagagaatccctctatggcaagaaatatttgcccactgacttgagatacaagaagaccagagctctcagactcgccctcactaagcacgagagaaaacaaagaacccaaagatccctcaccaaggctgctaacttccccctcagaaagttcgctcttagagcttaagttcttcggctttttcgttaatggtgcaattatgtaaggttgtaaaacaaatgcatagaagtctctatatcaaattcattcctcatgctctagttaaccctgaaacgaacg

SEQ ID NO: 44787 - protein, 125 aa, Panicum virgatum
  misc_feature: Ceres CLONE 2022113
  misc_feature (8)..(66): Pfam Name: Ribosomal_L29 Pfam Description: Ribosomal L29 protein
MSDKKLRVFKLRNASDEDLLKGLDEYKKELNSLRTLKITGGTSAKLGKIRVVRKAIARYLTVINQRNRQKVRESLYGKKYLPTDLRYKKTRALRLALTKHERKQRTQRSLTKAANFPLRKFALRA

SEQ ID NO: 44788 - DNA, 1429 bp, Panicum virgatum
  misc_feature: Ceres CLONE 2022116
  misc_feature: Encodes the peptide sequence at SEQ ID NO. 44789
acgaggcaccgaagagtggcagaccgaacaccgaagaggagaaccaaaaaacgaagaatttctgggaaaaaataaaataaacgcgaagacctccaccgtttcatgatcctcttcctcctccgaatcccccaatccgcgatcgccccaccacctgccggcggcgactacctgagcccctcctccggcggccaatcgcgacgagccccgggctcccccccccgttccaaaccctacccgtcgaaccgcgcgcctcgatccgttcccgccacgccgatcccgcgcctgccgccccaatccggtcgggattctccgccgccgggcgttgatcggtattctccgcctcgatcccttccccgcccgccgataattggctcgcggaggaggcgggcgtcaccatgttgcagtgcctggatggggtgaagcacctctgcggcctgctcctcaagtgctgcgacatcgacctcaagcagccaaagggcctcgaggatccggaggtcctcgccagggagaccgtctttagcgtgagcgagatcgaggcgctgtatgagctgttcaagaagatcagcagtgccgtgattgatgatggactgatcaataaggaggagtttcagttggcgttgttcaagactagtaagaaggagagcttatttgctgatcgtgtatttgatttatttgacacaaaacacaacggaattctaggatttgaggaatttgcccgtgcgctctcagtattccatcccaatgctcctcttgatgagaagattgacttttctttccagctatatgacctcaagcaacaaggcttcattgaaagacaagaggttaagcaaatggttgttgctacacttgctgagtcaggaatgaatctttcagatgaagttatagagagcatcattgacaagactttcgaggaggcagacacaaaacatgatgggaaaatcgataaagaagaatggcgcaatctagtactgaggcatccctcgttattaaagaacatgacacttcagtacctcaaggacatcaccactacatttccaagctttgtcttccattctcaggttgatgatacatgaagctatgagatcctatttttgcccccaatgaaacatcagaaggtagtcccagtgctttgttaagcaagctttccaatgttagcttgaaggttcagcatatgccatagcattcagaagttgcatgatcattttgagaagtcaagcctttgttgttaataacgcttagtttcttgttttattcaaaattctggctgaaatccccctccccgtcctcttcttcttcttcttcttcttcttcttcttcttcttcttcttcttttgaatttggttgttgactcaacgtttcttggtgtacaaagctgcagctgaacttcccctttagtgaattgtattttactcgtgaaagtattatattg

SEQ ID NO: 44789 - protein, 225 aa, Panicum virgatum; identical to SEQ ID NO: 37137
  misc_feature: Ceres CLONE 2022116
  misc_feature (166)..(194): Pfam Name: efhand Pfam Description: EF hand
  misc_feature (85)..(113): Pfam Name: efhand Pfam Description: EF hand
  misc_feature: SWISSPROT Homolog: EC 2.7.11.17 Calcium/calmodulin-dependent protein kinase
  misc_feature: Functional homolog of the protein sequence given in SEQ ID NO 51003
  misc_feature: Useful for making plants with modulated drought sensitivity
  misc_feature: Functional homolog of the protein sequence given in SEQ ID NO 51004
  misc_feature: Useful for making plants with modulated water use efficiency
  misc_feature: The sequence is a functional homolog of SEQ ID NO 2 in US patent 7250555
  misc_feature: Functional homolog of the protein sequence given in SEQ ID NO 50528
  misc_feature: Useful for making plants with modulated salt sensitivity

SEQ ID NO: 44790 - DNA, 590 bp, Panicum virgatum
  misc_feature: Ceres CLONE 2022123
  misc_feature: Encodes the peptide sequence at SEQ ID NO. 44791
agggtgctcaggtgcctcgaagcagccatctccagacgagtgtccgagggcttcacgctggagctgtgcggcagggacagggtgggcctgctgtcggacgtgacgagggtgctgcgggagcacgggctgacggtgacccgcgccgacgtgacgacggtgggcgggcaggccaccaacgtcttctacgtccgaaacccctcggggcagccggtggacatggagaccatcgaggggctccgggggcgggtcggccagaccgtcatgctcagcgtcaagagcgtccctgccgccgtcgccaaggtgccagagccgggatccggcggcgtcgccaggaccagcttcttctccttcggcagcctcttcgccaagctccgggcctgatcaaagtgattccgacaccggctccagtttgtgtgattggtgtagagatgaactgagaactagagtagtggtggagggggagacagagcaactgtatgtggcatgtggcagctgtggttgtatagttcataaggagcctctaccagactggtggttctgtgcaatgcaggctgcagactgctttgttgagggcgtcagcgcattgggct

SEQ ID NO: 44791 - protein, 126 aa, Panicum virgatum
  misc_feature: Ceres CLONE 2022123
  misc_feature (18)..(81): Pfam Name: ACT Pfam Description: ACT domain
  misc_feature: SWISSPROT Homolog: EC 2.7.7.59 [Protein-PII] uridylyltransferase
RVLRCLEAAISRRVSEGFTLELCGRDRVGLLSDVTRVLREHGLTVTRADVTTVGGQATNVFYVRNPSGQPVDMETIEGLRGRVGQTVMLSVKSVPAAVAKVPEPGSGGVARTSFFSFGSLFAKLRA

SEQ ID NO: 44792 - DNA, 746 bp, Panicum virgatum
  misc_feature: Ceres CLONE 2022125
  misc_feature: Encodes the peptide sequence at SEQ ID NO. 44793
cagttccgtccaagttcgagcaggggaagacgaggagcacgactgcacgagccaagcgaggcggccatggcggagctcgccgccgaccagcacgtccgctacatcgtcaccgtggagaagaaggactcgttcgagtcgctggtgatggagcacatccggctcaacggcgcctactggggcctcaccacactggatctcctccacaagctgcacgccgtcgacgccgccgaggtcgtcgactggatcatgtcctgctaccatccggaatctggtggatttggagggaacgtcgggcacgacccgcatgtcctctacacgctaagcgccgtgcaggtcctctgcctcttcgatcggctcgatgtccttgacattgacaaggttgctgattatgttgctggactgcagaatgaggatggatcattttctggtgatgtctggggtgaagtcgacactaggttctcgtatattgccctatgcaccttatcactactgcatcgtctgcataaaattaatatgcaaaaggctgtagattttgttgttagctgtaagaatttggatggtggatttggagctatgccaggaggggagtcacatgctgggcaaatattttgttgtgttggcgctcttgcaatcgctggttctctacatcacattgatagagatctccttggatggtggctttgtgagcgccagtgtaaagackgaggacttaatggggcgacctgagaaactagctgatgtttggt

SEQ ID NO: 44793 - protein, 219 aa, Panicum virgatum
  misc_feature: Ceres CLONE 2022125
  misc_feature (148)..(191): Pfam Name: Prenyltrans Pfam Description: Prenyltransferase and squalene oxidase repeat
  misc_feature (100)..(143): Pfam Name: Prenyltrans Pfam Description: Prenyltransferase and squalene oxidase repeat
  misc_feature (51)..(95): Pfam Name: Prenyltrans Pfam Description: Prenyltransferase and squalene oxidase repeat
  misc_feature: SWISSPROT Homolog: EC 2.5.1.60 Protein geranylgeranyltransferase type II
  misc_feature (213)..(213): Xaa is any aa, unknown, or other
MAELAADQHVRYIVTVEKKDSFESLVMEHIRLNGAYWGLTTLDLLHKLHAVDAAEVVDWIMSCYHPESGGFGGNVGHDPHVLYTLSAVQVLCLFDRLDVLDIDKVADYVAGLQNEDGSFSGDVWGEVDTRFSYIALCTLSLLHRLHKINMQKAVDFVVSCKNLDGGFGAMPGGESHAGQIFCCVGALAIAGSLHHIDRDLLGWWLCERQCKDXGLNGAT

SEQ ID NO: 44794 - DNA, 722 bp, Panicum virgatum
  misc_feature: Ceres CLONE 2022127
  misc_feature: Encodes the peptide sequence at SEQ ID NO. 44795
aggagaagaggaaagacaaggaggagcagattccttcctcccttcccccccacccctacccctcctcgtcgaaaccctagccccgcctcgccgccggcggtggtggccgcctgtccaacgcccagccctggttgttcgctgcacatactctcccccccaccgcgcgctgcctcccggagccgtcgcgaccgccgccggatccggatcggccggccgccatgtccaaggccagggtctacaccgacgtcaacgtgctgcgccccaaggagtactgggactacgaggcgctcaccgtccaatggggtgagcaggatgactatgaagttgtcaggaaagttggtagaggaaagtacagcgaagtctttgagggcatcaatgttaacaacaatgagaaatgcatcatcaagatcctgaagcctgtgaagaaaaagaagatcaaaagagaaattaaaatccttcagaatctttgtggaggccctaatattgtgaagctgcttgatattgttagggatcagcactcaaaaacacccagcctgatctttgaatatgtcaacaacacagatttcaaagtgctgtacccaacattgacagattatgacattcgctattacatctacgagttactcaaggcattagattactgccattcacaaggtattatgcaccgagatgtgaagcctcacaatgttatgatagatcatgagcttcgtaaactccggctg

SEQ ID NO: 44795 - protein, 167 aa, Panicum virgatum
  misc_feature: Ceres CLONE 2022127
  misc_feature (34)..(167): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 1 in US patent 7038110
  misc_feature: Functional homolog of the protein sequence given in SEQ ID NO 50314
  misc_feature: Useful for making plants with modulated flowering time
MSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLR

SEQ ID NO: 44796 - DNA, 681 bp, Panicum virgatum
  misc_feature: Ceres CLONE 2022129
  misc_feature: Encodes the peptide sequence at SEQ ID NO. 44797
aagccatgagatcaaacacaatactgcataaggttataactgatgcccttcctggcagtgttggtaaaagacttattggccttgttacaagtagagatgagattgctgacttgctaaagcttgatgatgtcattgatcttgtaattccaagaggtagcaataagctggtttctcaaatcaaggcatcaactaagatccctgttcttggccatgcagatggtgtctgtcatgtatacattgacaaatcagctgacatggatatagcaaaacgaattgtgatggatgccaaaattgattacccagcagcctgcaatgccatggaaacattacttgttcataaagatcttataaagtccccaggtcttgatgacatactgatatcactcaaaacagaaggagtttctatttatggagggcctgttgcgcacgaagtattgtccattccaaaagcagattcattccatcacgaatatagctctatggcctgcacagttgaatttgttgatgatgtacaatcagcaattgaccatatacatcgttatggaagtgcacatacagattgcattgtgactacagatagcaaagtagcagatacttttctgcgtcaagttgatagtgctgctgtgtttcatattgcaagtacacgattctctgatggcgctcgctttggattgggtgctg

SEQ ID NO: 44797 - protein, 226 aa, Panicum virgatum
  misc_feature: Ceres CLONE 2022129
  misc_feature: SWISSPROT Homolog: EC 1.2.1.41 Glutamate-5-semialdehyde dehydrogenase
AMRSNTILHKVITDALPGSVGKRLIGLVTSRDEIADLLKLDDVIDLVIPRGSNKLVSQIKASTKIPVLGHADGVCHVYIDKSADMDIAKRIVMDAKIDYPAACNAMETLLVHKDLIKSPGLDDILISLKTEGVSIYGGPVAHEVLSIPKADSFHHEYSSMACTVEFVDDVQSAIDHIHRYGSAHTDCIVTTDSKVADTFLRQVDSAAVFHIASTRFSDGARFGLGA

SEQ ID NO: 44798 - DNA, 1034 bp, Panicum virgatum
  misc_feature: Ceres CLONE 2022147
  misc_feature: Encodes the peptide sequence at SEQ ID NO. 44799
gtttggagaggtatacaagggtttgctccaggatggcacaattgtagctgttaaaagacggcattctcctcctagccaggaattcgttcaagaggttaattacctatcatctctccagcatcggaaccttgtaaaacttttggggtactgccaggagaatggcatgcagatgctagtttatgaatatatccccaatggcagcgtctcagcacatttgcatggtaacagccatgctgcaggtgtaaggctagaatttaagcatagactttctattgctcatggaactgctaaaggcctgagctacctgcattctctgaccccccctgcgatccatatgaacttcaaaacttctaatgtacttgtggatgaggatttagtaccaaaagttgcggatactgggattccaggcttgcttgatcgactcggtgttacaggactgtcttccagaacagctaatgattcttttgttgatcctcgaatgagggaatccatgagcctgaacttttccatacaaagcgatgtctacagttttggtgtgttccttgtggagttggttagcggacggagagctgtgtctgatcaacacataattcaatgggtgcagaacttcgaggaatcaagtgatatctctgcaattgcagacaacagaatgaccagtggtttcacctcagaaagcatgaaagaattgctgcgcttgacgtcatggtgcgtgaacccaatgagcgagcagcgtccatcaatgagcttggtggaggctgaaatacaccggattcacgagcagatcagcttgacgacagtcatgacagaacataccccaatcgtgactcttggtagccagctcttcagaacatcaaggtgaagaacggaatgcctagcatcttgtagcaaaactagttctcacatcagggcagtagattcgccttgttctcttccaaaagatttctcttgtcttcatagcgaatcttgagtaagctgcatcccaagtgtacaaaaaaggaacagctgagaggcttacccttcttttggattttctc

SEQ ID NO: 44799 - protein, 285 aa, Panicum virgatum
  misc_feature: Ceres CLONE 2022147
  misc_feature (1)..(254): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 51695
  misc_feature: Useful for making plants with altered cell wall content and/or composition
FGEVYKGLLQDGTIVAVKRRHSPPSQEFVQEVNYLSSLQHRNLVKLLGYCQENGMQMLVYEYIPNGSVSAHLHGNSHAAGVRLEFKHRLSIAHGTAKGLSYLHSLTPPAIHMNFKTSNVLVDEDLVPKVADTGIPGLLDRLGVTGLSSRTANDSFVDPRMRESMSLNFSIQSDVYSFGVFLVELVSGRRAVSDQHIIQWVQNFEESSDISAIADNRMTSGFTSESMKELLRLTSWCVNPMSEQRPSMSLVEAEIHRIHEQISLTTVMTEHTPIVTLGSQLFRTSR

SEQ ID NO: 44800 - DNA, 695 bp, Panicum virgatum
  misc_feature: Ceres CLONE 2022148
  misc_feature: Encodes the peptide sequence at SEQ ID NO. 44801
  misc_feature (555)..(555): n is a, c, t, g, unknown, or other
acaccttgcctctcccgtcccctctcgcaccaccactcaacaagcaaaccgcagaagcgagcaagtgccgcgccatagcagcctgatcgagctgagatactagcagctggtggttggtcggcatggcgaaggacatcgaggcgtcggggcccgaggccggcgcgttctcggccaaggactacacggaccccccgccggcgccgctcatcgacgcggaggagctcaccaagtggtcgctgtaccgcgcggccatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcgggcgggcacatcaacccggccgtcaccttcggcctgttcctcgcgaggaaggtgtcgctggtgcgcgcgctgctctacatcgtcgcgcagtgcctcggcgccatctgcggcgtgnggctcgtcaagggcttccagagcgcctacttcgtgcgctacggcggcggcgccaacgagctcagcgacggctactccaaaggaacggggctcgccgccgagatcatcggcaccttcgtgctcgtctacaccgtcctctcc

SEQ ID NO: 44801 - protein, 190 aa, Panicum virgatum
  misc_feature: Ceres CLONE 2022148
  misc_feature (33)..(190): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
  misc_feature (145)..(145): Xaa is any aa, unknown, or other
MAKDIEASGPEAGAFSAKDYTDPPPAPLIDAEELTKWSLYRAAIAEFIATLLFLYITVATVIGYKHQTDAAASGPDAACGGVGILGIAWAFGGMIFILVYCTAGISGGHINPAVTFGLFLARKVSLVRALLYIVAQCLGAICGVXLVKGFQSAYFVRYGGGANELSDGYSKGTGLAAEIIGTFVLVYTVL

SEQ ID NO: 44802 - DNA, 1054 bp, Panicum virgatum
  misc_feature: Ceres CLONE 2022149
  misc_feature: Encodes the peptide sequence at SEQ ID NO. 44803
cttccgtagagtcatctcgcgcgaaccgaccggcggctcctcccccggcagcctagggttctcctcctccgatcagccgtcagcgtgcactctccgacaagatctcacctgcccgtgctcctcggatggcgaccagcgaggagctcgcgcagatcgacatctccaaggaggagaaggacaagctggtgcaggaggtgacgcgctacgtgctcttcaagacgcaccagacctccggatgccccatcaagcgggaggagctcaccgggatcgtcaccaagaactaccgccagcgtgcccttcccacgctcgtcatcaacgaggccagggacaggctcgccgccaccttcgggtacgagatgagggagctccagaggacccgcgccccgtccacgcgcgctggccgggcgtcacagccgcaggtgaatgcggaggcgaagagctatgttctggtcagccaactagacccggaggtgtatagcaagtgcgttgaggacaaggcggctgcccctctgtctgctttttcttttactgccattagccttgttcaccttgctggtggcaaaatctccgaagaggacctctggcatcagttgaagcggctgggtttgaaggagaatgatgagaaccaccctgctcttggtaacaataagcaggcgcttgaactccttgtgcagcaaaggtacttgctgaaggagaaacttgctggaccagaaggtcatgttgtgatgtatgagcttgccgagagggcattggatgaatccagcagtgggaagctcaaagactacattgcaaagattgtgggcacaagcactgccgcagaagaaacttcaagttgatatgatgacatgatgatcaggtatctgccctgtttgttgcgggcgaggacaagctgactccattcaggcttggaagctatatcgtcttgcatggccgttcgtctgtcaaagccgggcgtatttgtacaggagaagagatgtgtgcttctcaggataggcggtagtgtctttaactgaacaatgttcacgacatgctgtaatcaacttagcattgcttg

SEQ ID NO: 44803 - protein, 236 aa, Panicum virgatum
  misc_feature: Ceres CLONE 2022149
  misc_feature (24)..(217): Pfam Name: MAGE Pfam Description: MAGE family
MATSEELAQIDISKEEKDKLVQEVTRYVLFKTHQTSGCPIKREELTGIVTKNYRQRALPTLVINEARDRLAATFGYEMRELQRTRAPSTRAGRASQPQVNAEAKSYVLVSQLDPEVYSKCVEDKAAAPLSAFSFTAISLVHLAGGKISEEDLWHQLKRLGLKENDENHPALGNNKQALELLVQQRYLLKEKLAGPEGHVVMYELAERALDESSSGKLKDYIAKIVGTSTAAEETSS

SEQ ID NO: 44804 - DNA, 613 bp, Panicum virgatum
  misc_feature: Ceres CLONE 2022154
  misc_feature: Encodes the peptide sequence at SEQ ID NO. 44805
acccagcccacccgccggttggtcacgctcacgctcctccccgatcccgatctcgatctccggccgacgccatggccgccgccgcaggcatcgcggcggtagtgggggtgctcatcctcctcgtcgcgggggtctcgggcgcgcgcctcccggcccgcggcgccgccgtccgcggaccggcgttgccgcgcgggggagcgccggccacggcggtgttcgcgctgggcagcttctggaggtcggaggcggcgtttggctgccttcccggcgttatccgcacctcggttggttatgctggcggctccaaggccaaccccgagtaccgcaacctcgccgaccacgccgagtgcgtcaaggttgagtatgatccccggctgattcactacaagcagcttttggacgtgttttgggcaagtcatgatccacgggaggtgtttgggcaagggccagatattggcaaccagtacagatctgtcatcttccctaatggaaccattgaggccagattggcttctcttagcaaagaaaaagaacaagctaaagatcgcagtagcattattaccacacagatccaaccattgggggcgttccatcctgctgaaccagaacatca

SEQ ID NO: 44805 - protein, 180 aa, Panicum virgatum
  misc_feature: Ceres CLONE 2022154
  misc_feature (45)..(180): Pfam Name: PMSR Pfam Description: Peptide methionine sulfoxide reductase
  misc_feature: SWISSPROT Homolog: EC 1.8.4.11 Peptide-methionine-(S)-S-oxide reductase
MAAAAGIAAVVGVLILLVAGVSGARLPARGAAVRGPALPRGGAPATAVFALGSFWRSEAAFGCLPGVIRTSVGYAGGSKANPEYRNLADHAECVKVEYDPRLIHYKQLLDVFWASHDPREVFGQGPDIGNQYRSVIFPNGTIEARLASLSKEKEQAKDRSSIITTQIQPLGAFHPAEPEH

SEQ ID NO: 44806 - DNA, 633 bp, Panicum virgatum
  misc_feature: Ceres CLONE 2022157
  misc_feature: Encodes the peptide sequence at SEQ ID NO. 44807
aacgcaaaccctagcctatagcacaaacccctgccgccggcgagggacacgcctcgagcctcgagcctcgagcgcggcgggcgaggaggagagagctaaagagagatggggcggccgtacgcggtgaaggggcgcaagaagaagcgcaggctcgacgaggcggcggcctcggacgccgccccgcccgccgaagaggcggaggagctgccgccgccggagagcggcgaggaaaaggagggggaggatggggcggcggagggggaggaggaggagcacgcgacgggggaggggctcccggtcgtgcccaggccggtggacgggaagcggcggcccggcgccatcttcgtgctcgagagggcctgcctcgaggtcggcaaagtcggcaagactatgcaaatcctgaactcagatgatcacgctaattatttgaggaagcagaatcgcaatcctgctgactataggcctgatatcattcatcaggctctacttgcgatatttgacagccctttaactaaagctggaaggctacaagctgtttatgtgaggactgaaaagggagtattgtttgaaatcaaaccttatgtccgcatgccacgaacatttaaacgtttttgtggtttgatgtcacaattg

SEQ ID NO: 44807 - protein, 175 aa, Panicum virgatum
  misc_feature: Ceres CLONE 2022157
  misc_feature (112)..(175): Pfam Name: Nep1 Pfam Description: Nep1 ribosome biogenesis protein
MGRPYAVKGRKKKRRLDEAAASDAAPPAEEAEELPPPESGEEKEGEDGAAEGEEEEHATGEGLPVVPRPVDGKRRPGAIFVLERACLEVGKVGKTMQILNSDDHANYLRKQNRNPADYRPDIIHQALLAIFDSPLTKAGRLQAVYVRTEKGVLFEIKPYVRMPRTFKRFCGLMSQ

SEQ ID NO: 44808 - DNA, 654 bp, Panicum virgatum
  misc_feature: Ceres CLONE 2022160
  misc_feature: Encodes the peptide sequence at SEQ ID NO. 44809
acctgcatggcaacaaaacccttgctccgctgagctgaggtcccttctcccgtcgccgccgggcgagcgccgcccatcccgtccctcgccgcctccgccttcagttcaccctccaagcaggcgccgccgcgcggagggttcgatccgtcttcaaggggggatagtctctcttccgccaggagagccgagatgaagccggtggtggggatcgtggtgtcgaaaaagatgcagaagtcggtggcggcggcggtggaccgcctcttccaccacaaggtgtacaatcgctacgtcaagcgcacctccaagtttatggcgcacgacgaggctgacgcctgcaacatcggcgaccgggttaggctggatccttccaggcccttgagcagacgtaagcactgggttgttgctgaaattcttcgcagagctaagatgtatgttccaccatctgcaactgcatccagtgaaaatgataccaaggctcaacagtctggtgttgctaccaaatgatccgcctttagtttctttgaggcaaagacacagttgcctttttgtctaaaaaaaagacacagttgcctacgttttctgtgtatgttaacttgtggaatgtgcatgcaatgtttaatccatagaagaaataacatggcatccatcattttt

SEQ ID NO: 44809 - protein, 104 aa, Panicum virgatum
  misc_feature: Ceres CLONE 2022160
  misc_feature (6)..(74): Pfam Name: Ribosomal_S17 Pfam Description: Ribosomal protein S17
MKPVVGIVVSKKMQKSVAAAVDRLFHHKVYNRYVKRTSKFMAHDEADACNIGDRVRLDPSRPLSRRKHWVVAEILRRAKMYVPPSATASSENDTKAQQSGVATK

SEQ ID NO: 44810 - DNA, 1408 bp, Panicum virgatum
  misc_feature: Ceres CLONE 2022164
  misc_feature: Encodes the peptide sequence at SEQ ID NO. 44811
gtcctcctcgctcgctcgctcggtcaccccaccacctctacctctccattatattgctcaagctagctccctccgcttctcgacccatccaatccaatcccacagcagcagtctctctctccatcgatcgatcagtagctagcagcaggcagcaatggcgacgcgcggggacgtggagaagggcggcgtgaagaaggaggccggcaaggtgccgtcgccgctgtacccgcagcacgagggggagcgggagtgggtgccgtggatcgtgcccgtcttcttcgtcgccaacatcacagtcttcgtcgtcaccatgtacgtcaacaactgccccgcccacaccaccgccagagacggcaagtgcatcggacgcttcctcggccgattcgccttccagccgctgcgccagaacccgctcctcggaccatcctccgccacgctcaccaagcttggggccctcgtgtggcagaaggtggtgcacgagcaccagggctggcgcctcctttccagcatgtggctgcacgccggcgtcgtgcacctggtggccaacatgatgagcctcctcttcatcggcatgcgcctggagcagcagttcggatacgtgaggattggtgccgtgtacctcctctccggcgtcggcggcagcgtcctgtcgtccctcttcatccgcaaccacatctccgtgggcgcctccggcgccctgttcgggctcctgggcgccatgctctcggagctcctgaccaactggaccatctacagcaacaaggtggccgccgtgctgacgctgctgttcgtggtggcggtgaacctggtgctgggcatcctcccgcacgtgaacaacttggcccacatcggcggcttcctcacgggcttcctgctggggttcgtggtgctcatgcgcccgcacttcggctggatggagcgctacggcatgcccgccggcagcgcctgcacctccaggaagtacctgctctaccagtggatcctcatggccatcgccctcctcctcctcgtcatcggattcgcggtgggcatggcgatgctcttccgtggctccaacgccaacgacagctgctcctggtgccactacctcagctgcgtgcccaccgccggatggacatgcaccaactgatctcatcatccatccacgaccatgagcataacacggacggcagagattcttttattttcctccaatttttcttcctacatccagcatgcgcacacacacacacatgttccttccgggcactgtagatagcgtaaagaaaaacgaaggcacgcactactcttttgatgggttgtcagtcagctgtagagttatcgttcagatcttatctcctgttccatttgattcattctttacataatgcaatgcaatgaattactattattgaggtttggaatctcc

SEQ ID NO: 44811 - protein, 324 aa, Panicum virgatum
  misc_feature: Ceres CLONE 2022164
  misc_feature (106)..(250): Pfam Name: Rhomboid Pfam Description: Rhomboid family
  misc_feature: SWISSPROT Homolog: EC 3.4.21.105 Rhomboid protease
  misc_feature: Functional homolog of the protein sequence given in SEQ ID NO 50231
  misc_feature: Useful for making plants with altered cell wall content and/or composition
MATRGDVEKGGVKKEAGKVPSPLYPQHEGEREWVPWIVPVFFVANITVFVVTMYVNNCPAHTTARDGKCIGRFLGRFAFQPLRQNPLLGPSSATLTKLGALVWQKVVHEHQGWRLLSSMWLHAGVVHLVANMMSLLFIGMRLEQQFGYVRIGAVYLLSGVGGSVLSSLFIRNHISVGASGALFGLLGAMLSELLTNWTIYSNKVAAVLTLLFVVAVNLVLGILPHVNNLAHIGGFLTGFLLGFVVLMRPHFGWMERYGMPAGSACTSRKYLLYQWILMAIALLLLVIGFAVGMAMLFRGSNANDSCSWCHYLSCVPTAGWTCTN

SEQ ID NO: 44812 - DNA, 645 bp, Panicum virgatum
  misc_feature: Ceres CLONE 2022167
  misc_feature: Encodes the peptide sequence at SEQ ID NO. 44813
tgctctcgcgcgtgtgcttcaggctttacatacactgttggggccggggaggagaggaggggggatagagagacaagatcgaggaaactgctagggagagccggagagggaaggaggagaggggagcggtcgggcgcgcggccatggggcaccactgctgcagcaagcagaaggtgaagcgcgggctgtggtcgccggaggaggacgagaagctggtcaagtacatcaccgcccatggccacagctgctggagcgccgtccccaagcacgccgggctgcagcggtgcggcaagagctgccggctccggtggatcaactacctccggccggacctcaagcgcggcaccttctccgagcaggaggagcgcaccatcatcgacgtccaccgcatcctcggcaaccggtgggcccagatcgccaagcacctgcccgggcgcacggacaacgaggtcaagaacttctggaactcgtgcatcaagaagaagctcatctcgcagggcctggaccccaagacccacaacctcctgccggcctccaggtctctcctccacggcaacggggcggcaaaccctagcaatcctgcccagttccactccaatggcgccatcgccaacggcggcgcaaccacgccgttcaccatcagct

SEQ ID NO: 44813 - protein, 167 aa, Panicum virgatum
  misc_feature: Ceres CLONE 2022167
  misc_feature (13)..(60): Pfam Name: Myb_DNA-binding Pfam Description: Myb-like DNA-binding domain
  misc_feature (66)..(111): Pfam Name: Myb_DNA-binding Pfam Description: Myb-like DNA-binding domain
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: Functional homolog of the protein sequence given in SEQ ID NO 50235
  misc_feature: Useful for biocontainment applications
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 51269
  misc_feature: Useful for making plants with modulated biomass
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: Functional homolog of the protein sequence given in SEQ ID NO 50477
  misc_feature: Useful for making plants with altered alkaloid content
  misc_feature: Useful for making plants with modulated nitrogen use efficiency
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1002 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 824 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: Functional homolog of the protein sequence given in SEQ ID NO 50232
  misc_feature: Useful for making plants with altered lignin content
  misc_feature: Functional homolog of the protein sequence given in SEQ ID NO 50233
  misc_feature: Useful for making plants with altered carbohydrate content
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 58 in the 10/666,642 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 442 in the 10/412,699 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1073 in the 10/374,780 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1010 in the 11/435,388 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 822 in the 10/412,699 US patent application
  misc_feature: The sequence is a functional homolog of SEQ ID NO 271 in the 11/479,226 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 836 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 569 in the 10/374,780 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 743 in the 10/666,642 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 126 in the 10/412,699 US patent application
MGHHCCSKQKVKRGLWSPEEDEKLVKYITAHGHSCWSAVPKHAGLQRCGKSCRLRWINYLRPDLKRGTFSEQEERTIIDVHRILGNRWAQIAKHLPGRTDNEVKNFWNSCIKKKLISQGLDPKTHNLLPASRSLLHGNGAANPSNPAQFHSNGAIANGGATTPFTIS

SEQ ID NO: 44814 - DNA, 1046 bp, Panicum virgatum
  misc_feature: Ceres CLONE 2022174
  misc_feature: Encodes the peptide sequence at SEQ ID NO. 44815
aagcagctcccattaatggactgcgcaacagcctaaactccgccgcgcatttcaaacggaaccagcagagccgagccgcgacagcgcagcgggcacgcgcgcgccctctggggctggagggaatggcggaggcgccggcgatcctctcgctctccgcggccgccgtggtggaggacgtgctgcggcagcacgggtgccgcctcagcgaccgcgatctcgcgtcacgcagggccgaggaagccgcggcgcggcggaacgaggcggcggggtggctgcgccgcacggtgggggcggtcgccgcgcgcgacctgccggaggagccgtccgaggaggagttccgcctcggcctccgcaacggccagatcctctgcggcgcgctcaaccgggtccacccgggcgccgtctccaaggtggtcgtgaacacggcggcggactccgtgctgcaggccgacggcgcggcgctgtcggcgttccagtacttcgagaacgtgcgcaacttcctggtggcggcgcaggagatcggcctgccgtgcttcgaggcctccgatttggagcagggagggaagagcgccagggtggtgaactgcgtgctcgcactcaagtcgtacggtgattggaagcaatgcggtggcaccggtccgtggaagtatggggggaatctgaaggtgacggcctccggcaagtccttcgggaggaagaactctgagccgttccgtaggagtcagtcgatgaatgaaggtgaagtgctctatgaggaggctggattcaatgccgactctcatcttgattccagtgacatgtcgacgtcgcgcccgctgaaaatgttggttagtgcagttttgtccgacaagaggccggatgaagttccacagctcttggagtccatgttgtgtaaacttgttgaagaattcgaaaatcgtctaaacaaccaaaatgaattggttaaagcggctctaaaaaatggtactgacagcacaaaatccttttcaaaatcaaaggttctggttgagactactccgaatactagtgggagaaagatggataca

SEQ ID NO: 44815 - protein, 307 aa, Panicum virgatum
  misc_feature: Ceres CLONE 2022174
  misc_feature (42)..(164): Pfam Name: CH Pfam Description: Calponin homology (CH) domain
MAEAPAILSLSAAAVVEDVLRQHGCRLSDRDLASRRAEEAAARRNEAAGWLRRTVGAVAARDLPEEPSEEEFRLGLRNGQILCGALNRVHPGAVSKVVVNTAADSVLQADGAALSAFQYFENVRNFLVAAQEIGLPCFEASDLEQGGKSARVVNCVLALKSYGDWKQCGGTGPWKYGGNLKVTASGKSFGRKNSEPFRRSQSMNEGEVLYEEAGFNADSHLDSSDMSTSRPLKMLVSAVLSDKRPDEVPQLLESMLCKLVEEFENRLNNQNELVKAALKNGTDSTKSFSKSKVLVETTPNTSGRKMD

SEQ ID NO: 44816 - DNA, 684 bp, Panicum virgatum
  misc_feature: Ceres CLONE 2022182
  misc_feature: Encodes the peptide sequence at SEQ ID NO. 44817
acagcaacgggaaaccacttgccgccgccaccaccaccaccagccgccgggattcccacgggcgggagggtgcggcggcgccgcgcgtgcgtccatccccttggattctcctggcgcaagtgcgtatggtatggacggcctgatcagcgcacgcgccgccggcctgaggagctcgctgcctgttcgccggtcgtcttcagctcggctgctaccgccggcttcgcaagtgccggttcggttcacgagccctccgttccgctctgctaaggtttgcaagagccgtggtttagtggcagcagcggcgctggaggtctccaaggacggctcctcggcggttcttgccaatcgccagccttccaaagatgctattgagacgttgcgcaacgccgatgcagtatgcttcgatgtcgatagcactgtcatcatggatgagggtattgacgagctcgctgatttctgtggggcagggaaggctgtcgccgagtggacagcgaaagcaatgacaggggatgttccatttgaggaggccctggccgccaggctgtctttaattaagccatcactctcccaagttgaggagtgcttggagaagaggccgcccaggatttctccaggaatggctgatttgattaagaagctaaaagctaatagtactgatgtgttccttgtgtcaggaggcttccg

SEQ ID NO: 44817 - protein, 184 aa, Panicum virgatum
  misc_feature: Ceres CLONE 2022182
  misc_feature: SWISSPROT Homolog: EC 3.1.3.3 Phosphoserine phosphatase
MDGLISARAAGLRSSLPVRRSSSARLLPPASQVPVRFTSPPFRSAKVCKSRGLVAAAALEVSKDGSSAVLANRQPSKDAIETLRNADAVCFDVDSTVIMDEGIDELADFCGAGKAVAEWTAKAMTGDVPFEEALAARLSLIKPSLSQVEECLEKRPPRISPGMADLIKKLKANSTDVFLVSGGF

SEQ ID NO: 44818 - DNA, 679 bp, Panicum virgatum
  misc_feature: Ceres CLONE 2022188
  misc_feature: Encodes the peptide sequence at SEQ ID NO. 44819
aaaaatcgccccccaaatccacacgaacatttcccctgccgcggccgccggggggaaggggggaaagatcccgtcccaatggctctcctcccccaaatcctccactcccctcacccccacccccgcctcgccgccgctgcctccccctcccgcgcattccctcgagcgccccgcctccatgcctccggcccccgcggccgcctcgctgcgtcggcgggcgcgtccgggcccgggcccgggccgtcgtcgccggagccgtacccccccgagtccgacgacgggctggtggagctcccgctgttcccgctcccgctcgtgctcttcccggacgccacacacgcgctgcacatcttcgagttccgctaccgcatcatgatgcacacggtgctgcagaccgacctccgcttcggcatcgtcttcgccggctccggcggctcggccgccgaggtcggctgcgtcggcgaggtcgtcaagcacgagcgcctcgccgacgaccggttcttcctcatctgcaagggccagcagcggttccgcgtcgcccgcgtcgtgcgcaccaagccctacctcgtcgccgccgtgcagtggctcgaggactgcccgcccgccgagccccccggccccggggaggacgccctggcgctcgccgccgacgtcgaggccctcatgcgggacgtcatac

SEQ ID NO: 44819 - protein, 200 aa, Panicum virgatum
  misc_feature: Ceres CLONE 2022188
  misc_feature (71)..(197): Pfam Name: LON Pfam Description: ATP-dependent protease La (LON) domain
MALLPQILHSPHPHPRLAAAASPSRAFPRAPRLHASGPRGRLAASAGASGPGPGPSSPEPYPPESDDGLVELPLFPLPLVLFPDATHALHIFEFRYRIMMHTVLQTDLRFGIVFAGSGGSAAEVGCVGEVVKHERLADDRFFLICKGQQRFRVARVVRTKPYLVAAVQWLEDCPPAEPPGPGEDALALAADVEALMRDVI

SEQ ID NO: 44820 - DNA, 698 bp, Panicum virgatum
  misc_feature: Ceres CLONE 2022208
  misc_feature: Encodes the peptide sequence at SEQ ID NO. 44821
gctagtccccatccatccatcgtcgtcgtcatcatcatcaccgtcacatcagcaatccacctcgcaccggcgcgcaccatccatctatctgccgccgtcctcaccgtccccacactccggcaggcggcatccatccaccaccactccgtcaagtcacctaagcgagaatggccgcccgcttcgccgccgccctcgtcgcagtcctcgccctcttcgccgcagccgcaacggcgcaggccccggccgcgacgcccaagagcgcgccggccccggcaccgcccaagatggccccgctgccgcggccaccgaccaagtccccggcggcctccccgcctgcgccgcccatggcgagcccggtctccgcgccctcggccgccgtcccggccatgagcccgttgggcgccggcgtcggcgacgcgctgcccccggctggtgcctccgtgctgaccccggccgccgcgccggccaccgagaagagcaccgccgcatctgccaccgccgccaccagcttcgtcgccgttgccggtgctgtggtcgcagccgtagtgttctaggcagcgtggcctggtctggcagtgggggctgacgcgatcctttcgctgtttctgcgccttcggtgctctgctcggctcggctgttgatacatgtactctgtttcttcgtttttggcgattctttatttattatttatttagctg

SEQ ID NO: 44821 - protein, 128 aa, Panicum virgatum
  misc_feature: Ceres CLONE 2022208
  misc_feature: Functional homolog of the protein sequence given in SEQ ID NO 50440
  misc_feature: Useful for making plants with altered carbohydrate content
MAARFAAALVAVLALFAAAATAQAPAATPKSAPAPAPPKMAPLPRPPTKSPAASPPAPPMASPVSAPSAAVPAMSPLGAGVGDALPPAGASVLTPAAAPATEKSTAASATAATSFVAVAGAVVAAVVF

SEQ ID NO: 44822 - DNA, 680 bp, Panicum virgatum
  misc_feature: Ceres CLONE 2022218
  misc_feature: Encodes the peptide sequence at SEQ ID NO. 44823
attctttacatcgatagtcacttgcgatagcatcgcttgtcgatctcgtgcatcgtcccctctgccctttttctgacctctctccacagtccacataatggcggctgaacctgctaaagctgaagctaaagaaatcggcaatcccgattctcgcctctacgtgtccaacttgaagtgggaattgaccgatgagaaccttaaggaactctttggtcagcacggcaaggttctcgaggcccgcattgttcgcgacaagcgtaccaactggtctcgcggctatggtttcgtcaccttcgagactgctgctggtgctgacgctgctttggctgctttgaacggcaaggacatccaagagcgccccattcgcgtggagaaggctcgcagcactggccccactgagagcaaggccaacggtgatgcccctgctgctggcgccggtgatgcggctgcccgtggtcgtggccgtggtcgtggtcgtggccgtggtcgcggtcgtggccgaggccgtggtggtcgtcgtggccgtggccgtggtgacggtcagggcgtcgccgaccctggcgctggcggtgatcaacagtaaacagccctggtccttgagtgaacgttgctcttcttcccgttcgccgctcttgtttggcgatcaaatcgcttgtgctttctagatacacatgctaatc

SEQ ID NO: 44823 - protein, 161 aa, Panicum virgatum
  misc_feature: Ceres CLONE 2022218
  misc_feature (20)..(91): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAEPAKAEAKEIGNPDSRLYVSNLKWELTDENLKELFGQHGKVLEARIVRDKRTNWSRGYGFVTFETAAGADAALAALNGKDIQERPIRVEKARSTGPTESKANGDAPAAGAGDAAARGRGRGRGRGRGRGRGRGRGGRRGRGRGDGQGVADPGAGGDQQ

SEQ ID NO: 44824 - DNA, 659 bp, Panicum virgatum
  misc_feature: Ceres CLONE 2022224
  misc_feature: Encodes the peptide sequence at SEQ ID NO. 44825
agtccatccatccaaatcctcggggcgagcgcgcgcggagagagagggattcccacggcgatggcggcggtagctagggttttccgcgggtccaggttcctcatgtccccggcgccgggcgcggcggcggcagcgggggcgaagaaagcggcggcgccaaaggtcaccaaggccgacgcgacggcggcgaaggagaagcgcgggatcatgaagccggtgccggtctccgaggagctgagcaggttcgccggcggcgcgcccgagctcgcccgctcccaggttgtcaagctcatctgggcccacatcaaggccaacggcctccagaacccggcgaagaaaaaagagatcaactgtgatgccgcactgaaaagcttgtttggtgggagggacaaggttgggatgctggagatcccgaagctactgaaccctcacttcatgaagaactaacagaagcagcagatggcaccaacgatggagctttcgtcttaagtctttattggatggcctcttttgtgatccatgttaagtccagctcccagtaggtagttaagccaaagttgtgtgatgacgtcaagaattcatacttgtgttcatctgttgggtttggggcgtgatgcatgtataaaggattcccagtgttatcgctactcttgtgatgt

SEQ ID NO: 44825 - protein, 128 aa, Panicum virgatum
  misc_feature: Ceres CLONE 2022224
  misc_feature (49)..(126): Pfam Name: SWIB Pfam Description: SWIB/MDM2 domain
MAAVARVFRGSRFLMSPAPGAAAAAGAKKAAAPKVTKADATAAKEKRGIMKPVPVSEELSRFAGGAPELARSQVVKLIWAHIKANGLQNPAKKKEINCDAALKSLFGGRDKVGMLEIPKLLNPHFMKN

SEQ ID NO: 44826 - DNA, 664 bp, Panicum virgatum
  misc_feature: Ceres CLONE 2022226
  misc_feature: Encodes the peptide sequence at SEQ ID NO. 44827
tgaagatcttaactgtttgctcaggccttgattcagcaggcaatgatttcaaagctctaatatatgagttcatacccaatgggaatctagatgagtggctgcataatccaagtagaaatgatggtacagaaactacattaaatatcaaccagagattagggattgctatagatgtggcctcagcacttgactacctccacaatcataaaccaacgccgattgtccattgtgaccttaagccaagcaatgttttactagattacgatctggttgctcatgtcgctgactttggactggcaaggtttctatctgatgacgccaattcatcacaaaattcaactagtatgagagcactgagaggaaccataggatacattgctccaggtaagccatagtactagattactgtttcactcacattctgcacaagtaacataatcatcagttcagcacggccatgacaacaatacactatcagaaggatctagctccatatcatgctaaaaagtatttctattggagcaaaaatactaggatttacaacttgcaacatccattaatatgcaaaaaaaaatgttttatatatgaacccgttatatggtcaaaactatattgattattaattcacctcatgacaacttcctttccagagtatggaattggc

SEQ ID NO: 44827 - protein, 130 aa, Panicum virgatum
  misc_feature: Ceres CLONE 2022226
  misc_feature: SWISSPROT Homolog: EC 2.7.11.1 Non-specific serine/threonine protein kinase
KILTVCSGLDSAGNDFKALIYEFIPNGNLDEWLHNPSRNDGTETTLNINQRLGIAIDVASALDYLHNHKPTPIVHCDLKPSNVLLDYDLVAHVADFGLARFLSDDANSSQNSTSMRALRGTIGYIAPGKP

SEQ ID NO: 44828 - DNA, 725 bp, Panicum virgatum
  misc_feature: Ceres CLONE 2022231
  misc_feature: Encodes the peptide sequence at SEQ ID NO. 44829
gataagatcgagctcggggaggttggggcgcaggaaaaaaaaatcatctccaatctccaaccaaactaaccctagcagcagccggcggttagggtttcgagcgagatggcggcggcggcgaggcagcgcgggacggtgaagtggttcaacgacaccaagggcttcggcttcatctcccccgaggacggcagcgaggacctcttcgtccaccagtcgtccatcaagtcggagggcttccgctccctcgtcgagggcgaggaggtcgagttctccgtctcggagggcgacgacggccgcaccaaggccgtcgacgtcaccggccccgacggatccttcgtcaagggcggctccggcggcggcgggggcgggggcggcttcgaatctcgcggcggggccggatctggcggcggcggccgcagctacggcggcagctggggcggcgggaggagatccggccccggcggcggtggcggcggcggcggcgcgtgctacaagtgcggggagcccggccacatggccagggactgccccaccgccgacggaggcggcggatacggcgggggaggctacggtggcggcggcggcggcggcggcggctgctttaagtgcggggagcctggccacatggccagggactgctccagcggcggaggaggctatggaggtggcggctacggaggaggcggcggcggtgcctgctacaactgcggccagaccggccacat

SEQ ID NO: 44829 - protein, 206 aa, Panicum virgatum
  misc_feature: Ceres CLONE 2022231
  misc_feature (6)..(73): Pfam Name: CSD Pfam Description: 'Cold-shock' DNA-binding domain
  misc_feature (126)..(143): Pfam Name: zf-CCHC Pfam Description: Zinc knuckle
  misc_feature (163)..(180): Pfam Name: zf-CCHC Pfam Description: Zinc knuckle
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 468 in the 11/479,226 US patent application
MAAAARQRGTVKWFNDTKGFGFISPEDGSEDLFVHQSSIKSEGFRSLVEGEEVEFSVSEGDDGRTKAVDVTGPDGSFVKGGSGGGGGGGGFESRGGAGSGGGGRSYGGSWGGGRRSGPGGGGGGGGACYKCGEPGHMARDCPTADGGGGYGGGGYGGGGGGGGGCFKCGEPGHMARDCSSGGGGYGGGGYGGGGGGACYNCGQTGH

SEQ ID NO: 44830 - DNA, 713 bp, Panicum virgatum
  misc_feature: Ceres CLONE 2022233
  misc_feature: Encodes the peptide sequence at SEQ ID NO. 44831
  misc_feature (630)..(630): n is a, c, t, g, unknown, or other
cagagccccgtcgccccgcgcacagccggtgtcagtgacgcagccgccgcaccgaggggagaggaagaggaccgagctcagctcgatcgctagcgagggcaggcaatggcgggagccggcggcctcctgacgctcgcggtggccgtcctgacgctgggcatcgccggggccgcgagggcgcagctgcggcagaactactacgccagctcgtgccccagcgccgagtccaccgtgcgctccgtcatctcgcagcgcctccagcagagcttcgccgtcggccccggcacgctccgcctcttcttccacgactgcttcgtccggggatgcgacgcgtcggtgatgctgatggcgccgaacggggacgacgagagccacagcggcgcggacgccacgctgtcgcccgacgccgtggacgccatcaacaaggccaaggcggccgtggaggcgctcccgggctgcgccggcaaggtctcgtgcgcggacatcctcgccatggccgcacgtgacgtcgtctccctgcttggtgggccaaactacgccgtggagctcgggaggctggacggcaagacgttcaacagggccatcgtgaagcacgtcctcccggggccgggcttcaacctggaccagctncactccctgttcgcgcagaacgggctcacacagacggacatgatcgcgctctcaggcgcgcacacgatcggcgtgacgcactg

SEQ ID NO: 44831 - protein, 202 aa, Panicum virgatum
  misc_feature: Ceres CLONE 2022233
  misc_feature (43)..(202): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51490
  misc_feature: Useful for making plants with altered carbohydrate content
  misc_feature: Functional homolog of the protein sequence given in SEQ ID NO 51637
  misc_feature: Useful for making plants with altered cell wall content and/or composition
MAGAGGLLTLAVAVLTLGIAGAARAQLRQNYYASSCPSAESTVRSVISQRLQQSFAVGPGTLRLFFHDCFVRGCDASVMLMAPNGDDESHSGADATLSPDAVDAINKAKAAVEALPGCAGKVSCADILAMAARDVVSLLGGPNYAVELGRLDGKTFNRAIVKHVLPGPGFNLDQLHSLFAQNGLTQTDMIALSGAHTIGVTH

SEQ ID NO: 44832 - DNA, 1267 bp, Panicum virgatum
  misc_feature: Ceres CLONE 2022246
  misc_feature: Encodes the peptide sequence at SEQ ID NO. 44833
attgacgcctcctcgagctgttcctgccggccgccccgcccggagctgctcacctgtgctccccagttcgactgccctcgattccccataccttttgctcacatccctcggataaccctaggagtcagtggaacggcgcggggcggctgctgctgctgcgagactgcgagcgcgaggagcttgcccggcgggggctgtgcgcgaggcgagccacgcgcgggacgcggcagcggcgttggtggcgagcacgttgcgaggctgcgcaccactgcgtcctccttccccatggtggagtaggtgaaagggatcgattgctctttcattgccaccgcggcaggccggcagccatggcggcggccgtcccctccggctacgcgcctccgctccctaccaccatcttcaaccctacccccgggaccggcttcgccccgttcactctgcgcctccgcctccgcccacgtcgcgccgccgctgttaccgccgccgccgccaccctccgtgaggtctgcgccggccgcgtcccggaccacgtcctgcagagggctgaggaggttgggtatgtcgtgcccaccgaggtgcaggagcaatccctgccgcttctgctgtccggccaggattgcattctccatgcgcagacaggctctgggaagacgctggcctatctcttgtctgtcttctctgccatcgacttcggcaggtcctccgtgcaagcactggttgtcgtccccacaagggagcttggcatacaggttaccaaggttgctagaattctcgcagccaaggcttgcaccgtcatggctttgctcgatggtggcatgctcaaaaggcaaaagagctgggtcaaggcagagccccctgcaataattgtagctacggtgccaagcttgtgtcaaatggttgagaggcgcactttcaaccttcaatccgttagagtgttagttatcgatgaggttgatttcatttttgggtcatcaaagcaagtaagctcccttcgcaaaatattaacctcttattcagcagcctctagtcgtcaaaccatatttgcaagcgcatcgatccctcagcacaatcgctttctgcatgactgtgtacaacataagtggaccaagagtgatgtggttcatgttcatgtcaaccctgtacagcccatgtctgcgcacctatgtcacaaatttgtggtctgccctaagaaggaaaggttgcatgtttttactatccttgcttgagaggggatgcaccaaagtccacaaccatatttgttgctgaa

SEQ ID NO: 44833 - protein, 292 aa, Panicum virgatum
  misc_feature: Ceres CLONE 2022246
  misc_feature (75)..(243): Pfam Name: DEAD Pfam Description: DEAD/DEAH box helicase
MAAAVPSGYAPPLPTTIFNPTPGTGFAPFTLRLRLRPRRAAAVTAAAATLREVCAGRVPDHVLQRAEEVGYVVPTEVQEQSLPLLLSGQDCILHAQTGSGKTLAYLLSVFSAIDFGRSSVQALVVVPTRELGIQVTKVARILAAKACTVMALLDGGMLKRQKSWVKAEPPAIIVATVPSLCQMVERRTFNLQSVRVLVIDEVDFIFGSSKQVSSLRKILTSYSAASSRQTIFASASIPQHNRFLHDCVQHKWTKSDVVHVHVNPVQPMSAHLCHKFVVCPKKERLHVFTILA

SEQ ID NO: 44834 - DNA, 705 bp, Panicum virgatum
  misc_feature: Ceres CLONE 2022252
  misc_feature: Encodes the peptide sequence at SEQ ID NO. 44835
  misc_feature (551)..(551): n is a, c, t, g, unknown, or other
gaaagcagccatacatacatctcttctcttctcgatcgatcgatcgatcgatcagcttcaacttcttaattaggcagctaatggagggcaaggaggaggatgttcggcttggcgcgaaccggtactctgagcggcagcccatcggcacggcggcgcagggcaccgaggagaaggactacaaggagcctcccccggcgccgctgttcgaggcggaggagctggcgtcgtggtccttctaccgcgccggcatcgccgagttcgtggccaccttcctgttcctctacatcagcatcctgacggtgatgggcgtgagcaagtcgtccagcaagtgcgccaccgtgggcatccagggcatcgcctggtccttcggcggcatgatcttcgcgctcgtctactgcacggccggcatctccggcggccacatcaacccggcggtcaccttcggcctcttcctggcgcgcaagctctcgctcacgcgcgcgctcttctacatggtgatgcagtgcctgggcgccatctgcggcgccggcgtcgtcaagggcttccagcanggcctctacatgggcgccggcggcggcgccaacgccgtcaacccgggctacaccaagggcgaccgcctcggcgccgagatcgtcggcaccttcgtcctcgtctacaccggtcttctccgccaccgacgccaagcgcagcgcgcgcgaactcgca

SEQ ID NO: 44835 - protein, 208 aa, Panicum virgatum
  misc_feature: Ceres CLONE 2022252
  misc_feature (46)..(205): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature (157)..(157): Xaa is any aa, unknown, or other
MEGKEEDVRLGANRYSERQPIGTAAQGTEEKDYKEPPPAPLFEAEELASWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQXGLYMGAGGGANAVNPGYTKGDRLGAEIVGTFVLVYTGLLRHRRQAQRARTR

SEQ ID NO: 44836 - DNA, 1276 bp, Panicum virgatum
  misc_feature: Ceres CLONE 2022253
  misc_feature: Encodes the peptide sequence at SEQ ID NO. 44837
ctataatggaagacaacaacgacaacaacgataagagtagaatcaacagcttattctccaaatacaacaggaatcggcgcaacagaccattgcccgtgttaaagactgacaaggatttggaagccgaaggattagcacgattatccattgatttgcccaattttcaagttactgatgaagctgaccgtccactgacttcatcgccgtccacctcagaaatagctcatgcttttgtaagtcgtacagagggcgcaccagcacctgcttttcatagacccaagttggatgagcatggtgggtttgccaatagacacagtataggttttgatgtgcctggtgctgtgcataccatagtgaccccaaaactgaaaacagagcgtcagattgatagtaaattggtggttgtaatggtgggattacctgcaagaggaaaaagttacattgtaaagaagctgagacgttatttgaactggttgcaatacgaaacaaaggtgttcaatgtgggcaacttgcgtcgtgtcaataaagcatctcaacagctggatcaatcagccaatttttttgatcctgacaacaaagatggtaataaaatacgtgatgaattggccatcatggtgcttgatcaactcatcgattggctgagaacgggaggaagagtcgctatccatgatgcaaccaattccaccatccaaagacgaaagcttctcatygatcgcctgcagcaggagcccgatatcaaggtgcttattctagagtcggtgtgtaccgacaagacagtccttgagcgtaatttccgcttaaagctatcaggtcctgactacaaggacaaggatccagccaaagccttatctgatttcagacatcgtgtggctaattacgaaagagcttatgaaccagtaggtgattgggaggaagaccatgacattcagtactgtaaactagtcaatgtgggaaagaaggtgattgcctataatatctcgggctatctctctggccaatgtatattttatttattgaatttcaaccttgcagaacgtcagatctttgtcacacgtcacggcgagagtgaggataacattactggaagaattggtggcgatgctcctttatctgctaaaggaagaaagttttccaaggctttggcaagatttgtcaaggaaagaagaattgcttttgctttagatctttgccagaagaaagattcaagaggagaaagagtccaaagatccattgaaaagattccgacgatgaggaacaggagagtgaacaagaacac

SEQ ID NO: 44837 - protein, 424 aa, Panicum virgatum
  misc_feature: Ceres CLONE 2022253
  misc_feature (120)..(344): Pfam Name: 6PF2K Pfam Description: 6-phosphofructo-2-kinase
  misc_feature: SWISSPROT Homolog: EC 2.7.1.105 6-phosphofructo-2-kinase
IMEDNNDNNDKSRINSLFSKYNRNRRNRPLPVLKTDKDLEAEGLARLSIDLPNFQVTDEADRPLTSSPSTSEIAHAFVSRTEGAPAPAFHRPKLDEHGGFANRHSIGFDVPGAVHTIVTPKLKTERQIDSKLVVVMVGLPARGKSYIVKKLRRYLNWLQYETKVFNVGNLRRVNKASQQLDQSANFFDPDNKDGNKIRDELAIMVLDQLIDWLRTGGRVAIHDATNSTIQRRKLLIDRLQQEPDIKVLILESVCTDKTVLERNFRLKLSGPDYKDKDPAKALSDFRHRVANYERAYEPVGDWEEDHDIQYCKLVNVGKKVIAYNISGYLSGQCIFYLLNFNLAERQIFVTRHGESEDNITGRIGGDAPLSAKGRKFSKALARFVKERRIAFALDLCQKKDSRGERVQRSIEKIPTMRNRRVNKN

SEQ ID NO: 44838 - DNA, 652 bp, Panicum virgatum
  misc_feature: Ceres CLONE 2022262
  misc_feature: Encodes the peptide sequence at SEQ ID NO. 44839
ggagggagggctgtacattttcccggtccgaaacgcaagccgtgcccgggcgggccgtcctataaaacgtctgctcggccgggcgggcgggagcgtctcccggagcccaccggccttccgttccgactcctcgccaccgccgcgggggaaggaactaggaaccagaccggcgccggcgaagcgcgtccggatggcggaggagcggcacgggtaagcgagcaagcagaggcgatggattccattccatggatccatcgagaagaagagcatttttgttgcagatcaagtgctagtaaagtaacctcgtctgctctgttttcttccgggggccgaagctgcgagcattacaggcgagggtgccgggtcgtggcgccctgctgcggcgaggtcttcggctgccgccattgccacaacgacgccaagaactcgctcgaggccgacccgcgcgaccgccacgagatccctcgtcacgaaataaacaaggtgatctgcacactctgttccaaagaacaggatgtgcaacagaattgttctaactgtggtgcctgcatgggggaatacttctgtgaaatatgcaaattctttgacgatgatttatcaaagggccaataccactgtgatggatgtggcatatgcagaactggtggtgcag

SEQ ID NO: 44839 - protein, 140 aa, Panicum virgatum
  misc_feature: Ceres CLONE 2022262
  misc_feature (36)..(119): Pfam Name: zf-CHY Pfam Description: CHY zinc finger
MDSIPWIHREEEHFCCRSSASKVTSSALFSSGGRSCEHYRRGCRVVAPCCGEVFGCRHCHNDAKNSLEADPRDRHEIPRHEINKVICTLCSKEQDVQQNCSNCGACMGEYFCEICKFFDDDLSKGQYHCDGCGICRTGGA

SEQ ID NO: 44840 - DNA, 700 bp, Panicum virgatum
  misc_feature: Ceres CLONE 2022268
  misc_feature: Encodes the peptide sequence at SEQ ID NO. 44841
aaagcaagcacaagaacaagagcagctagctagctctagcttagcttctttaatttgtgtagattaaaggagctagcgagattcattagcagtaatggcggcgaccaagatctacatcgtgtactactcgacctggggccacgtgacggctctggcggaggagctcaagaagggcgtcgagtccgtggacgacgtcgaggcgacggtgtggcgcgtccccgagacgctgccggaggaggtgctggggaagatgtacgcggcgcccaagcgcgaggaccaccaggtgatctcggcgaagcagctggcagaggccgacggcgtgctgctgggcttccccacgcggttcggcatgatggccgcgcagatgaaggcgttcctcgactccacgggcgggctgtggcaggagcaggccctggcgggcaagcccgcgggcttcttcttcgccaccggcacccagggcggcggccaggagtccaccgcgctcaccgccgtcacgcagctggcgcaccacggcatgatctacgtcccgctcggggccaccttcggcgcgcgcatgttcgccatggacgaggtccgggggggaagcgcctacggggccggcaccttcgccggcgccgacggcagcaggacgcccaccgagaccgagctcgccatggccaaccaccaggggaagcaattcgcggccgtcgccaagaagctc

SEQ ID NO: 44841 - protein, 201 aa, Panicum virgatum
  misc_feature: Ceres CLONE 2022268
  misc_feature (8)..(140): Pfam Name: Flavodoxin_1 Pfam Description: Flavodoxin
MAATKIYIVYYSTWGHVTALAEELKKGVESVDDVEATVWRVPETLPEEVLGKMYAAPKREDHQVISAKQLAEADGVLLGFPTRFGMMAAQMKAFLDSTGGLWQEQALAGKPAGFFFATGTQGGGQESTALTAVTQLAHHGMIYVPLGATFGARMFAMDEVRGGSAYGAGTFAGADGSRTPTETELAMANHQGKQFAAVAKK

SEQ ID NO: 44842 - DNA, 677 bp, Panicum virgatum
  misc_feature: Ceres CLONE 2022276
  misc_feature: Encodes the peptide sequence at SEQ ID NO. 44843
actctctctctctctctctctctctctctctctctctccgatccagcccctccataaccacgcgatcggccagatccctccggccgccggcgatccacccctccccggggggatggcgatggctcaccgcggtttcgcgccaccgctcctcgtcctgctcctgcttctatccaccgccgcgcggccgtctctcgcccagccgatcaagaacgacacgatcggcggcggccaccgctccaggaccgccggcgggttcacgccgaccacgatgatcgtgctcgtcgtcctcatctccgccttggtcgtcctcacgctcttctccatctacatcaaccgctgcgcgccggcgcgccctcccccgcgccggccgtcccgctacgccccggatcagcgggccgccgccgccgccggagccgcccgggcggaccgcgccggtctcgacaggggcaccgtggagtcgttccccaccgcggtctacggcgacgtcaaggcgcgcgtggcggccaagtcggggccgctcgagtgcgcggtctgcctcgccgcgttcgaggaccacgacgagctccgcgtgctcccggcctgctgccacgtcttccacccggactgcatcgacccctggctcgccgggcgcgtcacgtgcccgctctgccgcgccgacctcaccgtcgtctcgcctc

SEQ ID NO: 44843 - protein, 186 aa, Panicum virgatum
  misc_feature: Ceres CLONE 2022276
  misc_feature (136)..(177): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MAHRGFAPPLLVLLLLLSTAARPSLAQPIKNDTIGGGHRSRTAGGFTPTTMIVLVVLISALVVLTLFSIYINRCAPARPPPRRPSRYAPDQRAAAAAGAARADRAGLDRGTVESFPTAVYGDVKARVAAKSGPLECAVCLAAFEDHDELRVLPACCHVFHPDCIDPWLAGRVTCPLCRADLTVVSP

SEQ ID NO: 44844 - DNA, 760 bp, Panicum virgatum
  misc_feature: Ceres CLONE 2022279
  misc_feature: Encodes the peptide sequence at SEQ ID NO. 44845
aagcgtagagctagtaggtcatatctagctatctagcagctaaggaacatgaggggcatgggagagaagaggagacatgggggagggcatcatgtccatggtgttgggtttggagccggaggaggagttggacatgccgagcaagacgagaagcgcagggagccgaagaagctggacatgagcggcatgtccatggacagcatcccgcatctcagcatgcctcttggcaacatcactaccttggatctctccaacaacaacctacagagcattccagagtccataatcgcgaggcttctgaacgtggtggtgctggacgtgcgctccaaccagctcacgtcgctgcccaactccatcggctgcctctccaagctcaaggtcctcaacgtctccggcaacctcctccgcgacctgcccgccaccatcgaggaatgccgtgcgctggaggagctgaacgccaacttcaaccagctgacgaagctgccggacacgctggggttcgagctccacggtctccgccgcctctccgtcaactccaacaagctcgcctacctgccgtcgtccacctcccacatgacggcgctccggtcgctggacgcgcggctcaactgcctccgcgcgctgcccgacgggctcgagaacctcggcggcctcgagaccctgaacgtgagccagaacttccagtacctgcgcgagctcccctacggcatcggcctcctcgtctcgctccgggagctggacgtcagctacaactccatcg

SEQ ID NO: 44845 - protein, 237 aa, Panicum virgatum
  misc_feature: Ceres CLONE 2022279
  misc_feature: SWISSPROT Homolog: EC 4.6.1.1 Adenylate cyclase
MRGMGEKRRHGGGHHVHGVGFGAGGGVGHAEQDEKRREPKKLDMSGMSMDSIPHLSMPLGNITTLDLSNNNLQSIPESIIARLLNVVVLDVRSNQLTSLPNSIGCLSKLKVLNVSGNLLRDLPATIEECRALEELNANFNQLTKLPDTLGFELHGLRRLSVNSNKLAYLPSSTSHMTALRSLDARLNCLRALPDGLENLGGLETLNVSQNFQYLRELPYGIGLLVSLRELDVSYNSI

SEQ ID NO: 44846 - DNA, 696 bp, Panicum virgatum
  misc_feature: Ceres CLONE 2022281
  misc_feature: Encodes the peptide sequence at SEQ ID NO. 44847
agccgcagcgcgccgtacatggagcccgcgccgctctcgtcgctgcaggaggaagtggagggggagcccgccggggaggactcgtccgccttctccgccgccgccgtccctccccgcccggccacgcacagccacgcgctccacaagtacgcgccgctggactggtccgcctacttcgacgaggagcgccgcgttgtcatccccggcaccgacgatatcttcaatgtgtacacggccggatcggagggccccgtcgtgttctgtctgcacggaggcggctactcggggctttcatttgctctagcagcacgtcaaatgaaggacaaggcccgtgttgtttccatggatctacggggacacgggaagtcaacaacaagcaatgattcggatttgtccatcgaaactcttaccaatgatgtcatagctgtgatacgtgccatgtatggagattcaccaccagcaattatacttgttggacatagcatgggtggttcagtggctgtacatgtagctgcaagaagagaaattcgaaatcttcatgggcttgttgtcattgatgttgttgagggaacagcaatggcttcgctggttcatatgcagaagatcttatccaatcgggcacagcatttccctagcattgaaaaagcaattgaatggagtgtcaaaggtgggccgttaagaaatattgagtctgct

SEQ ID NO: 44847 - protein, 225 aa, Panicum virgatum
  misc_feature: Ceres CLONE 2022281
  misc_feature: SWISSPROT Homolog: EC 6.6.1.1 Magnesium chelatase
MEPAPLSSLQEEVEGEPAGEDSSAFSAAAVPPRPATHSHALHKYAPLDWSAYFDEERRVVIPGTDDIFNVYTAGSEGPVVFCLHGGGYSGLSFALAARQMKDKARVVSMDLRGHGKSTTSNDSDLSIETLTNDVIAVIRAMYGDSPPAIILVGHSMGGSVAVHVAARREIRNLHGLVVIDVVEGTAMASLVHMQKILSNRAQHFPSIEKAIEWSVKGGPLRNIES

SEQ ID NO: 44848 - DNA, 947 bp, Panicum virgatum
  misc_feature: Ceres CLONE 2022282
  misc_feature: Encodes the peptide sequence at SEQ ID NO. 44849
accggccctaaaaacgctgcgccccctcggcggagtcaggggcgccaccgcgccaatgtctcgccgccgcctcgccggcagcaagagctccaccacttccactccacggcgtccgtcgtgtgctccgctcgcgccggaacaacggagacggcgaccggcgggggtggagatgaagctgaagcagctggagggcctcctgggtggcctgacccagttccccgcccccaaggtggagctggagcagtacccgacgggccctcacatcgcgtcgcggatgctctacacggcggagaatagttttgataacataactggcaaagtggtagctgactttggctgtggctgtggcaccctggcagtggcgagtgctctactggatgctgaacatgttatcggaattgatattgacccacaatcacttgaacttgctcaagaaaattctgctgatctggagctggatatcgacttagtttggtctgacataaagaacttaaatttgaaaggcttccttgttgacaccgttgtcatgaatcctccttttgggacacgaaagaaaggagcagacatggagttcctttctatgggcttgaaggttgcttcgcaggctgtctattccctacacaagacttccactagagaacatatcaagaaggcagccttgcgtgatttcggtgctgtcagtgctgaggttctatgcgagctgcgctacgatctgccccaatcttacaagtttcacaagagaagggaggtggacattgctgtcgacttgtggcgctttgttcccaaaacccgatgcagccgctagcgccctgcgcccaggcgacgaggctgtgaaatgaacatgaacaatgaaaatggagatataatatactgttgtcttgcatagctcatgtctggaattgataaaaagaaaattcacgcgcggtgtagtatctattttctgtccc

SEQ ID NO: 44849 - protein, 211 aa, Panicum virgatum
  misc_feature: Ceres CLONE 2022282
  misc_feature (34)..(179): Pfam Name: MTS Pfam Description: Methyltransferase small domain
  misc_feature: SWISSPROT Homolog: EC 2.1.1.64 3-demethylubiquinone-9 3-O-methyltransferase
MKLKQLEGLLGGLTQFPAPKVELEQYPTGPHIASRMLYTAENSFDNITGKVVADFGCGCGTLAVASALLDAEHVIGIDIDPQSLELAQENSADLELDIDLVWSDIKNLNLKGFLVDTVVMNPPFGTRKKGADMEFLSMGLKVASQAVYSLHKTSTREHIKKAALRDFGAVSAEVLCELRYDLPQSYKFHKRREVDIAVDLWRFVPKTRCSR

SEQ ID NO: 44850 - DNA, 996 bp, Panicum virgatum
  misc_feature: Ceres CLONE 2022283
  misc_feature: Encodes the peptide sequence at SEQ ID NO. 44851
aggcggagacacacaggactcaaaaggagccggagccggaagccaaaaccccgagccccgcaaaacccctaaaccctagcccccttcctccgccctagcgattggaggcgaagacgcggccatggcggccctcctcaggcgcgtgtcgctgcggcgcgccttcaccgccgccgcttcctcttcttctcaccctgagagctatacgcaagggatctgtggctccacgtttcattacagagagttctcatctaaagccaaaaagaagtcaaagtcaagtggaactgactctggtgaggagaatatgtcgaagaaagacttggcattacaccaggctatcgaccaaataacatctgcatttgggaagggggcaataatgtggcttggccgtaaacaaggccatagagatgtacctgtagtatctactgggtctttcgctttggatatggctctaggaactggtgggcttccaaaggggcgtgtcatagaggtttatggcccagaggcttcaggcaagacaactcttgctctacatgtcattgcacaagctcaaaagaatgggggttactgtgcctttgtagatgcagagcatgctttggatccagctcttgcggaggcaattggcgttgacactaacaatttactcctttctcagccagactgtgctgagcaggcactcagtcttgtggacacactgattcgaagtggatctgttgatgttgttgtagtcgacagtgtagcagctcttgtcccaaagactgagcttgatggggagatgggtgacgcacatgttgctcttcaggctagattgatgagccaagctcttcgcaagctgagccactccctttcactttcccagacaattctgttatttattaatcagaccagggccaaggtagccacatttggatttgggggaccaactgaggtcacttctggtggcaacgccttgaagttttatgcttctgttcgcttgaacatcaagcgtattggtttggt

SEQ ID NO: 44851 - protein, 291 aa, Panicum virgatum
  misc_feature: Ceres CLONE 2022283
  misc_feature (66)..(291): Pfam Name: RecA Pfam Description: recA bacterial DNA recombination protein
MAALLRRVSLRRAFTAAASSSSHPESYTQGICGSTFHYREFSSKAKKKSKSSGTDSGEENMSKKDLALHQAIDQITSAFGKGAIMWLGRKQGHRDVPVVSTGSFALDMALGTGGLPKGRVIEVYGPEASGKTTLALHVIAQAQKNGGYCAFVDAEHALDPALAEAIGVDTNNLLLSQPDCAEQALSLVDTLIRSGSVDVVVVDSVAALVPKTELDGEMGDAHVALQARLMSQALRKLSHSLSLSQTILLFINQTRAKVATFGFGGPTEVTSGGNALKFYASVRLNIKRIGL

SEQ ID NO: 44852 - DNA, 580 bp, Panicum virgatum
  misc_feature: Ceres CLONE 2022283-R
gaaaagataaccttaaggcttaccttactgaaaatgagtgtgttgctaaagatctagagatgaaactaaggaaattgatggaaactgaagcacctaaagagcaggaggctgaagacggttccctgagtgatttgtctgaagagatcgtcgcaccagaaacatcgtcagaagaggatcaagcggctgcagtagaagcttaaccagttatttgatctactggcaattttttggaacttaacatatgaagcaattgttccactaaaacaatattttggtcatgaagccaccagcatgcagtgccgtgatgatcttattataacagccttcagttgctactgttcttgcagtatagtgtaacgtgaagagaatattcgctttctgtgaaatcatgctgagctagctagtgacagaggaaggttgtcagggtgaggtactgtggctatttaaacattggtgaatggtgaggacccgtgagatgtgatatagtcgtgtatatatgctgcataccttgatgactcctcgtgttgaagtctaattcagaagcattcttaattgagtgctgctagaatttttattggtc

SEQ ID NO: 44853 - DNA, 717 bp, Panicum virgatum
  misc_feature: Ceres CLONE 2022293
  misc_feature: Encodes the peptide sequence at SEQ ID NO. 44854
aggtgtcgaagagctctctgacgctgggggagctagcgtgcgcggtgctgctccccgtgctcgccgtggtcgacgcggccctgctcgcggcctcgaggtgcttcgagaggagcccgcccaggctgctttcggctctcgacgcaggcgcgcgcctccgagctggcggacgcctcaccttccgtgagctcgccgagctcgccgacgagtcccgctgcttctcggtgaacgaggtggaggcgctgtacgagctgtacaagaagatcagctgctccatcatcaacgacggcctgatccataaggaggagctgcagatggcattgttcaatgtgccgtctggggaaaatcttttcctagatagagtttttgatctttttgatgaaaagaaaaattctgttattgaatttggagagtttgtccatgcaataagtgtgtttcacccaaacgctcctcttgaagataaaattgatttttcattcagattgtatgacttgaggcaaactggtttcattgagcgtgaagaggtgaaacagatggtgaatgctaccttgatggagtcacagctggagctgactgacgatcttgtggaagtgatactagataagactttcgaggaagttgatactgataaggacagcaggattagcagatcggagtggaaagcttttgtgttgcggcacccttctgttataaagaagatgacactgccggcactgaagg

SEQ ID NO: 44854 - protein, 238 aa, Panicum virgatum
  misc_feature: Ceres CLONE 2022293
  misc_feature (197)..(225): Pfam Name: efhand Pfam Description: EF hand
  misc_feature: SWISSPROT Homolog: EC 2.7.11.17 Calcium/calmodulin-dependent protein kinase
  misc_feature: Functional homolog of the protein sequence given in SEQ ID NO 51003
  misc_feature: Useful for making plants with modulated drought sensitivity
  misc_feature: Functional homolog of the protein sequence given in SEQ ID NO 51004
  misc_feature: Useful for making plants with modulated water use efficiency
  misc_feature: The sequence is a functional homolog of SEQ ID NO 2 in US patent 7250555
VSKSSLTLGELACAVLLPVLAVVDAALLAASRCFERSPPRLLSALDAGARLRAGGRLTFRELAELADESRCFSVNEVEALYELYKKISCSIINDGLIHKEELQMALFNVPSGENLFLDRVFDLFDEKKNSVIEFGEFVHAISVFHPNAPLEDKIDFSFRLYDLRQTGFIEREEVKQMVNATLMESQLELTDDLVEVILDKTFEEVDTDKDSRISRSEWKAFVLRHPSVIKKMTLPALK

SEQ ID NO: 44855 - DNA, 616 bp, Panicum virgatum
  misc_feature: Ceres CLONE 2022303
  misc_feature: Encodes the peptide sequence at SEQ ID NO. 44856
gggcgctgccattgtatacgtgctcgaacggtcgaacctgctcgtgcactccagcatctcaagttctcatagcgagaggggagagagcggcagaggtgggagggaggaagatgagcggcagcgtggagacgcaggcgcgggcgttcgcggacgaggtgcgcggcggcgccctggaggcgaagaactggatgctggacctcggccacccgctcctcaaccgtgtcgccgagagcttcgtcaaggccgccgggatcggcgcggtccaggcggtcgcgagggagtcgtacttcatggccatcgaaggcgagggaggatcggtgtccggcgccaccggctcgaggaaacgctcgttcccggaactcaatgggacgaacagtggtagcaagtcggccgaggccatggtgaaaaacgtgagcaaagagtcgttgcagtggggactcgcggctggcgtgcactccggcctgacctacggcctgacggaggtgcgcgggacgcacgactggcgtaacagcgccgtggccggcgccatcacgggcgccgccgtcgcgctcacgtcggaccgcgcgtcgcacgagcaggtcgtgcagtgcgcaatcgccggcgcggcgctctccac

SEQ ID NO: 44856 - protein, 168 aa, Panicum virgatum
  misc_feature: Ceres CLONE 2022303
  misc_feature (27)..(168): Pfam Name: Tim17 Pfam Description: Tim17/Tim22/Tim23 family
MSGSVETQARAFADEVRGGALEAKNWMLDLGHPLLNRVAESFVKAAGIGAVQAVARESYFMAIEGEGGSVSGATGSRKRSFPELNGTNSGSKSAEAMVKNVSKESLQWGLAAGVHSGLTYGLTEVRGTHDWRNSAVAGAITGAAVALTSDRASHEQVVQCAIAGAALS

SEQ ID NO: 44857 - DNA, 619 bp, Panicum virgatum
  misc_feature: Ceres CLONE 2022305
  misc_feature: Encodes the peptide sequence at SEQ ID NO. 44858
gagcaggaggtggtgctggaggaggcggcggccttggtggaggcggcggcggcatgggcggtggcggaggcggtgggctgggcggaggctctggcggtgggttcggcggcggagcgggcggaggactcggtcatggcggaggtcttggcggcggcggcggcattggtggaggaggcggaggcggcctcggtggaggcggaggcgccgggggcggccttggtggcggtgccggaggaggcctcgggcacggcggcggcctgggacgcggcgttggtatgggcggaggcggcggcggcctcggcatcggaattggcgtcggcgtgggcgtcgggatgggcgcgggtgctggcggcggcgccggtgctggcgcgggcggcggcgggcgttgatgagccgtcgactgggaagaaggttgtgcatggctgcatgcccgcatgcaatgcggcctgcgtaacggacgccctctgcttcctttccttccaaacgctcgttacgacgtggttaaattaaattacagttgatctcgctcgtctctgtgaactgtgtgtcgctgtgtagctagcgcgtgctcaaaaagagctcgatattgtcagtgtcaaccaacaagtgcttttgtcat

SEQ ID NO: 44858 - protein, 128 aa, Panicum virgatum
  misc_feature: Ceres CLONE 2022305
  misc_feature: Functional homolog of the protein sequence given in SEQ ID NO 50702
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
AGGGAGGGGGLGGGGGGMGGGGGGGLGGGSGGGFGGGAGGGLGHGGGLGGGGGIGGGGGGGLGGGGGAGGGLGGGAGGGLGHGGGLGRGVGMGGGGGGLGIGIGVGVGVGMGAGAGGGAGAGAGGGGR

SEQ ID NO: 44859 - DNA, 700 bp, Panicum virgatum
  misc_feature: Ceres CLONE 2022307
  misc_feature: Encodes the peptide sequence at SEQ ID NO. 44860
tctaatgaaacatgggaagtgacccttccagctgaggaagttcctcctgaacttccagagccagcactgggaataaacttcgctcgtgatggaatggccgagaaagattggctcacgctggttgctgtacacagtgatgcgtggttaattgctgtggcattttactttggagctcgctttggatttgataaagatgccaggagacggctctttacgatgatcagtaattttcccactgtatatgaagttgtgacaggaagtgggaagaagcaatcaaaaccccccaacaacaacggcaaaagcaagtcgggttctaaaccatccaagaaacccaattcaaatagcaagccagcaaagcagcccctgccaaagcaggaggaacagatggtcaaagaagagggaggtgataaggatcaagcttacctgtgcggaacatgtggagggagctattctaataatggtgaattctggataggctgtgacatttgtgagaactggtaccatggcaattgtgtccgcatcactcctgccaaggcagagcacatcaagcagtacaagtgcccggcttgcagcaacaagaggagcagagagtgagcgtgggacgctcctggctgatgtagttagggttggtagggcttgagccgggggattcttgcttcctgctgtttcagcagcggcagactgccagttgccccagcag

SEQ ID NO: 44860 - protein, 197 aa, Panicum virgatum
  misc_feature: Ceres CLONE 2022307
  misc_feature (142)..(193): Pfam Name: PHD Pfam Description: PHD-finger
  misc_feature: SWISSPROT Homolog: EC 1.14.11.27 [Histone H3]-lysine-36 demethylase
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50174
  misc_feature: Useful for making plants with altered alkaloid content
  misc_feature: Functional homolog of the protein sequence given in SEQ ID NO 50175
  misc_feature: Useful for making plants with altered lignin content
  misc_feature: Useful for making plants with modulated flowering time
SNETWEVTLPAEEVPPELPEPALGINFARDGMAEKDWLTLVAVHSDAWLIAVAFYFGARFGFDKDARRRLFTMISNFPTVYEVVTGSGKKQSKPPNNNGKSKSGSKPSKKPNSNSKPAKQPLPKQEEQMVKEEGGDKDQAYLCGTCGGSYSNNGEFWIGCDICENWYHGNCVRITPAKAEHIKQYKCPACSNKRSRE

SEQ ID NO: 44861 - DNA, 685 bp, Panicum virgatum
  misc_feature: Ceres CLONE 2022308
  misc_feature: Encodes the peptide sequence at SEQ ID NO. 44862
  misc_feature (583)..(583): n is a, c, t, g, unknown, or other
agtccccacttcactcctccgcttgccagttcttccccgcaaggctctcgttgatccgtcgagggtcgtgcactccaccggctagcaatataatggcggatcgcgacgcgcgcggcggcatctacggcggcacccacaccggccagcagggcggcggcggcggccggccggtgggggagcaggtgaagggcatgatccacgacaagggccccacggcgtcgcaggcgctgacggtggcgacgctgttcccgctcggcgggctgctgctggtgctgtcgggcctcgcgctggcggcctccgtggtggggctcgccgtggcgacccccgtgttcctgatctccagccccgtgctcgtccccgccgcgctgctcatcgggatggcggtgacggggttcctcacgtcgggcgcgctgggtctgggcgggctctcctcgctcacgtgcctcgccaacacggcgcggcaggcgttccagcgcaccccggactacccggactacgtggaggaggcgcgccgcaggatggcggaggccgcggcgcacgcgggccacaagaccgcgcaggccgggcacgccatccagagcanggcgcaggaggccgccgggggcggcgccggcgcgggcggcggcagggcgtcctcgtgaacgagctggccagtgcacggtgctaccactacgcggacacagca

SEQ ID NO: 44862 - protein, 182 aa, Panicum virgatum
  misc_feature: Ceres CLONE 2022308
  misc_feature (41)..(161): Pfam Name: Oleosin Pfam Description: Oleosin
  misc_feature (164)..(164): Xaa is any aa, unknown, or other
MADRDARGGIYGGTHTGQQGGGGGRPVGEQVKGMIHDKGPTASQALTVATLFPLGGLLLVLSGLALAASVVGLAVATPVFLISSPVLVPAALLIGMAVTGFLTSGALGLGGLSSLTCLANTARQAFQRTPDYPDYVEEARRRMAEAAAHAGHKTAQAGHAIQSXAQEAAGGGAGAGGGRASS

SEQ ID NO: 44863 - DNA, 678 bp, Panicum virgatum
  misc_feature: Ceres CLONE 2022316
  misc_feature: Encodes the peptide sequence at SEQ ID NO. 44864
aaatcttcaacctcaagcaccaagcaagaagaaccagctgaaatcacgcgtccaagaacgcccccccgcctccattagaaattttagcattggattggagccaccaccaccaatggcttgttccaccgcatctctagcggcgacgctgctggcgttcgcgctgctgttccaggcctgcctcgccgggaggcggctcaccgcgctcgtgcaggagccggccatcaccatgaagtaccacaagggcgcgctcctgtcgggccgcatcgccgtcaacttcatctggtacggcaacttctccgcgccgcagcgcgcggtcatcaccgacttcgtctcgtcgctgtccgcggccccggcggcggggcagccggagccgtcggtcgccacctggttccggacggcgcgcaagtactacgccaactccaaggcgcggttcccggcgctgcacgtcggctcccacgtcctcgacgcgtcctactccctcggcaagcgcctctcggacggcgacctcctcaagctcgccgccaaggggtcctcgagccgcgccatcaacgtggtgctcaccgccgtcgacgtcgccgtggacgggttctgcatgtcccggtgcggcacgcacggcgcgtcccggcggtcgcgctccggccggttcgcgtacgtgtgggtgggcaatccggcgacgca

SEQ ID NO: 44864 - protein, 188 aa, Panicum virgatum
  misc_feature: Ceres CLONE 2022316
  misc_feature (39)..(188): Pfam Name: Phi_1 Pfam Description: Phosphate-induced protein 1 conserved region
MACSTASLAATLLAFALLFQACLAGRRLTALVQEPAITMKYHKGALLSGRIAVNFIWYGNFSAPQRAVITDFVSSLSAAPAAGQPEPSVATWFRTARKYYANSKARFPALHVGSHVLDASYSLGKRLSDGDLLKLAAKGSSSRAINVVLTAVDVAVDGFCMSRCGTHGASRRSRSGRFAYVWVGNPAT

SEQ ID NO: 44865 - DNA, 416 bp, Panicum virgatum
  misc_feature: Ceres CLONE 2022338
  misc_feature: Encodes the peptide sequence at SEQ ID NO. 44866
acccgcagcccagttaagctccggaccgactccggcgacctccccaccaccatggccgccgccggcgaggcctccagcaagctcctccgcttcctctacttcgtcggcgccggagtgatctgcaccaaggccatcaacacctttcgcgactacgagcacaagaaggaggcctcagcggccgtcgccgcggcagaagcagcgttggcttctgcatcggcgcccgaaccagcgcctgcaaccgtcgccgccgccgccggaaagccctgattgcggagtggggcctgtcttcgccggttagggttcttcggatgttgtgctcaagaggaggaatatatattatcttttgtttctgatatttttattatatgtatcgtactgtggtgacatgatgaatcaataatagcccctttttcccc

SEQ ID NO: 44866 - protein, 71 aa, Panicum virgatum
  misc_feature: Ceres CLONE 2022338
  misc_feature: Functional homolog of the protein sequence given in SEQ ID NO 50452
  misc_feature: Useful for making plants with altered carbohydrate content
MAAAGEASSKLLRFLYFVGAGVICTKAINTFRDYEHKKEASAAVAAAEAALASASAPEPAPATVAAAAGKP
